United States Patent 9,315,822 (GENES AND USES FOR PLANT IMPROVEMENT) - sequence listing, part 2

SEQ ID NO: 3813 - protein, 501 aa, Aeromonas hydrophila
MRCPYLHGLITCWQEVKINMAVIPVIMAGGSGSRLWPMSREHFPKQFLNLYGNNSMLQETVNRLAEIECTAPLILCNEKHRFIVAEQLRQLDILANNIILEPVGRNTAPAIALAAIQSLKDVDDTHDPILLVLAADHLIKDQRAFTNAVNSAIPFAESGKLVTFGIVPNAPETGYGYIHRGSELKSFLNEDKAYGVNQFVEKPNLAVAKGYLTSGEYYWNSGMFMFSARRYLAELKLSRPDIYQACVASMNDIRSDLDFIRINNDEFKQCPSDSIDYAIMEKTSDAVVIPMDAGWNDVGSWSSLWDISDKDACGNVSRGDVILTESHNNYVSAESILVSTIGVDNLVIIQTKDAILVSNKDKVQDVKSIVEELKRCGRKEYKTHREVYRPWGQYDSIDDGNGYQVKKILIRPGERLSTQMHHHRAEHWIVVSGTAKVTNAEREFLITENESTFIPIGAIHSLENPGKVDLELIEIRSGKYLEEDDIIRFSDKYGRVDGGEK

SEQ ID NO: 3814 - protein, 538 aa, Acidobacteria bacterium Ellin345
MPTPKPLVLIILDGWGYAPPSNANAISLARKPNYDKLLTDFPNTLIHTSGRYVGLPPGQMGNSEVGHLNIGAGRVVYMDITKIDLAIENKSLFKNQTLLDAMKHAANGRQLHFFGLLSDGGVHSHQNHLYALLRMAKENGVERVFVHPFMDGRDTLPTNGVKYVDQLQQKMREYGIGKIASISGRYYAMDRDKKWDREKLASDAMLHGRGEGGRYKDPVQGIKESYNKGVTDEFIIPFVCVDDNDQPIGVIRDGDACINFNFRADRARQITRVLARNSGITKDGGRELDAADTLDATIPRDTIPKDLHYTCMTQYDPKFTLPIVIPPDTLTHILANEMAAMNMRNLRVAETEKYAHVTYFFNGGIEKPYPGEERELVQSPKVATYDLKPEMSANGIADVIEHAVEKGAFDVIVVNFANADMVGHSGKIPPTITAVETVDSCLGRVYNVVRKKGGAMLITADHGNAEQMIDPETGGPQTAHTTNPVPFIFVAEDAKKRFSLRPDGALQDISPTMMGILGIPQPKEMTGHDLRVDLTVKK

SEQ ID NO: 3815 - protein, 396 aa, Brucella suis 1330
MAETQVRNFNINFGPQHPAAHGVLRLVLELDGEVVERVDPHIGLLHRGTEKLMEAKTYLQAVPYLDRLDYVAPMNQEHAYALAVERLLDIEVPKRGQLIRVLYSEIGRILNHLLNVTTQAMDVGALTPPLWGFEEREKLMVFYERACGARMHAAYFRPGGVHQDLPDQLIEDIGKWIDPFFTTLKNLDDLITPNRIFKQRNVDIGVVKLEDAWAWGFSGVMVRGSGAAWDLRKSQPYECYSEMEFDIPVGKNGDCYDRYLIRMEEMRQSARIMRQCVDLLLGKERVGPVSNTDHKIVPPKRGEMKCSMEALIHHFKLYTEGYHVPAGEVYAAVEAPKGEFGVYLVSDGSNKPYRCKLRAPGFAHLQAMDFLCRGHMLADVSAILGSLDIVFGEVDR

SEQ ID NO: 3816 - protein, 148 aa, Pisum sativum
MASKRILKELKDLQKDPPTSCSAGPVAEDMFHWQATIVGPADSPYAGGVFLVTIHFPPDYPFKPPKVAFRTKVFHPNINSNGSICLDILKEQWSPALTISKVLLSICSLLTDPNPDDPLVPEIAHMYKTDRTKYEATARSWTQKYAMG

SEQ ID NO: 3817 - protein, 283 aa, Alternaria alternata
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSPSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIA

SEQ ID NO: 3818 - protein, 233 aa, Sulfolobus solfataricus P2
MCGSMLVIRLNKVTSTQDFAEAISNMLFEDFLVIAEEQTKARGRLGRSWYSPKGGLWFTYVKKNFKTEEIQLSSLKVAVAVLDVLRKFVDAKIRWPNDIVVNDKKIAGILIEAKTYEEDIKLADLFIGAGIDILIKEFPSDLNATSLYLEIGKEVELNIDEVIGKIEEHLKLDNRKIIDIVNQYLSIKDREVTLKGENWEKRCKALFVDYMGRLVTECGIYEVEEIYRVEVSH

SEQ ID NO: 3819 - protein, 283 aa, Cochliobolus heterostrophus
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMECDVDVRKDLYGNIVMSGGTTMYPGISDRMQKEITALAPSSMKVKIIAPPERKYSVWIGGSILASLSTFQQMWISKQEYDESGPSIV

SEQ ID NO: 3820 - protein, 610 aa, Clostridium perfringens ATCC 13124
MGKITREAIHHIAQSNYSYGYDNETLHLRVKTKKGEVNKVEIRIGDPYIWDEGGCDGGNMNATGGRWTGGKSYPMRKECETKYFDHWIVEYKPLTKRSRYGFILYGDEETLLFTEKRIEELDGKYDEAKLSDIGNFYCFPYLNAIDVAKTPKWVKDTVWYQIFPDRFCNGDKSIDPENVEPWGTEPTRDNFMGGDLQGVLDKLDYLCDLGINGLYFCPVFEATENHRYETIDYFKVDPALGGNEVFKKLVSEAHKRGMKIMLDAVFNHIGYFSPQWQEVLKNNEKSRYKDWFCIKKFPVLENGLENVDGNNLNYETFGRIATMPKLNTENPEVVEYLLKVAKFWVEEMDIDGWRLDVCNEVDHVFWRKFREVVKGTNKEVYILGEVWHDGLPWLMGDQFDAVMNYPVTDAVKEYFCLNQSNTEDFKYMIEANKVSYLRQIGETIFNLLDSHDTPRILTVAEGNKDKMKLAYLFMFTQAGSPCIYYGDEVGMEGNQGMGMEFHRRCMVWDENKQDKDMLKFMKQIIKIRKENKELNLLDNNWIRANRAENILIYSKENIFIIMNNSENEEKIYLPKEIKNNKVKDLFEEKIEPLKEDIGLKPFAFKVYKKL

SEQ ID NO: 3821 - protein, 333 aa, Pichia pastoris
MAITVGINGFGRIGRLVLRVALSRADIKVVAINDPFIAPEYAAYMFKYDSTHKAYKGEVSASGNKINIDGKEITVFQERDPVNIPWGKAGVDYVIESTGVFTTLEGAQKHIDAGAKKVVITAPSKDAPMFVVGVNEEKYTSDLNIVSNASCTTNCLAPLAKVVNDTFGIESGLMTTVHSMTATQKTVDGPSHKDWRGGRTASGNIIPSSTGAAKAVGKVIPELNGKLTGLAFRVPTVDVSVVDLTVNLKKETTYEEIKSVIKAASEGKLKGVLGYTEDAVVSSDFLGDERSSIFDASAGIQLTPSFVKLISWYDNEYGYSTRVVDLLQHVAKA

SEQ ID NO: 3822 - protein, 283 aa, Cochliobolus heterostrophus
HTFYNELRVAPEEHPVLLTEAPINPKSNREKMTQIVFETFNAPAFYVSIQAVLSLYASGRTTGIVLDSGDGVTHVVPIYEGFAPPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3823 - protein, 313 aa, Shewanella sp. MR-7
MAIQWYPGHMHKARKEIEEAMPQVDLVIEVLDARIPYSSENPMVSKLRGDKPCIKLLNKSDLADPDITAQWIEYLEREQGVKATAITTLQPGMLKMLPDLCRKLVPSRDKTEKDIRTMIMGIPNVGKSTIINTLAGRVIAKTGNEPAVTKSQQRINLRNGIVLSDTPGILWPKVDNEASSYRLAVTGAIKDTAMEYEDVALFAAGYFLKAYPKEICERYNISELPKDDMALLEEIGRKRGALRPGGRIDLHKASEVVLHDYRSGRIGLLSLETPAMAEIEKAEVERILAEKAAEKAAKLEAEKLKRSGKRHNV

SEQ ID NO: 3824 - protein, 353 aa, Mannheimia succiniciproducens MBEL55E
MIILFNLNIIGENLMAIKIGINGFGRIGRIVFRAAQTRDDIEVVGINDLIDVEYMAYMLKYDSTHGRFDGSVEVKDGNLVVNGKTIRVTAERDPANLNWGAIGVDIAVEATGLFLTDETARKHITAGAKKVVMTGPSKDATPMFVRGVNFSAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYETIKQAIKDAAEGKTFNGELKGVLGYTEDAVVSTDFNGCALTSVFDADAGIALTDSFVKLVSWYDNETGYSNKVLDLVAHIYNYKG

SEQ ID NO: 3825 - protein, 305 aa, Brassica napus
  misc_feature (140)..(140): Xaa can be any naturally occurring amino acid
  unsure (1)..(305): unsure at all Xaa locations
MKLAGLKSIENAHEDSVWAATWVPATEERPALLLTGSLDETVKLWRADELDLVRTNTGHSLGVAAVAAHPSGIIAASSSLDSFVRVFDVDTNATIAVLEAPPSEVWGMQFEPKGTILAVAGGSSASVKPSDTASWRLKKXSKKFVLSVAWSPNGKRLACGSMDGTICVFDVDRSKLLHQLEGHNMPVRSLVFSPVDARVLFSGSDDGHVNVHDAEGKTLVGSMSGHTSWVLSVDASPDGGAIATGSSDRTVRLWDLKMRAAIQTMSNHNDQVWSVAFRPPGGTGVRAGRLASVSDDKSVSLYDYS

SEQ ID NO: 3826 - protein, 271 aa, Triticum aestivum
MEVATATEASAPAASGGASRRGHPFPWLDVAISEPYYFLHLIAFFSYFAARTTAPSAEDDAELHSRLIRREIQAVLVFLVLFTVKIVKEEHWETFIADSLLYAKGLLLVVTFVIDYWLTVGYLLGFIVIYAMAQQPPYDGLGHLNHLTPLQLESLLTEEPTTRFWLVEFRTSFLTPCIQASSVMPELSNLYSNKNISFGLVDLGHFPNAAARFGISMWDHLPTYILFDKATEVARLPEIGNGTKVFVPKVTKKLLCQHFDLDRRLIEFLST

SEQ ID NO: 3827 - protein, 475 aa, Ralstonia eutropha JMP134
MYQDLALYIDGEFIKGGDRKEQDVLNPATQEVLGKLPHASRADLDRALAAAQRAFESWKKTSPLERSKILRRVGELARERAKDIGRNITLDQGKPLAEAVGEVLVCAEHADWHAEECRRIYGRVIPPRQPNVRQIVVREPIGVCAAFTPWNFPFNQAIRKIVSAVGAGCTLILKGPEDSPSAVVALAQLFHDAGLPPGVLNIVWGVPSEVSTYLIESPIVRKISFTGSVPVGKQLAALAGAHMKRVTMELGGHSPVLVFDDADIEPAAEMLARFKLRNAGQVCVSPTRFYVQEKAYDKFLARFTEVIGSIKVGNGLEDGTQMGPLAHERRVFSMEQFLDDANQRGGKVVAGGSRIGDKGYFFAPTVVTDLPDDAKLMVDEPFGPVAPVTRFKDTAEVLRRANSLPFGLASYVFTNSLKTATEVSNGLEAGMVNINHFGMALAETPFGGIKDSGIGSEGGQETFDGYLVTKFITQV

SEQ ID NO: 3828 - protein, 140 aa, Desulfitobacterium hafniense Y51
MTKILVPVDGSPNSDKAIHYALTLARCKDDLLIFLNVQPNYNTPNIKRFATQEQIKVMQEETSKEVLDHSLEIAKDSIAPIRTLLRTGDPGREICKEAQESAVDSIVMGYRGLGAVKRAILGSVATHVLHETSCPVTIVP

SEQ ID NO: 3829 - protein, 780 aa, Candida albicans SC5314
MSSPTSLDDLSNMPETGNTIKTLHELKQESSPDSNNEMNIDGEMSNDNSNHSNSNHKMHTYDGDFVMDNEYNDYEELRKSLVNKRRLSSIKRPHGPFLDHNNQIDKRSLLRLPTEILLQIFHYLERRDWYSLLTTCSEIADLIIEMLWFRPHMQNDSAFKKIKEVMEINKSVTHWDYRQFIKRLNLSFMTKLVDDELLSLFIGCPRLERLTLVNCAKLTRYPITQVLNGCERLQSIDLTGVTDIHDDIINALANNCPRLQGLYAPGCGNVSEEAIIKLLRSCPMLKRVKFNSSTNITDESILVMYENCKSLVEIDLHGCENVTDKYLKSIFLDLTQLREFRISNAPGITDKLFESIPEGHILEKLRIIDITGCNAITDRLVEKLVSCAPRLRNVVLSKCMQITDASLRALSQLGRSLHYIHLGHCGLITDYGVAALVRYCHRIQYIDLACCSQLTDWTLVELANLPKLRRIGLVKCSMITDSGILELVRRRGEQDCLERVHLSYCTNLTIGPIYLLLKNCPKLTHLSLTGISSFLRREITQYCREPPSDFNEHQKSLFCVFSGHGVNQLRNYLNQVVEERTYQIDQGDIHTLFNERRRRFLNGDIDMDEEEMNIWERRRGLGVTADLGHPDMAEINREIFRELNEGNMGPDEMREHFQRLIRNHHQQRLLEHQNRLNQQLVQQRQQQQQQEPQLEQENLQNRGQVETQAPDQLPNEGQLRLQPPLQQQRAQNTIINNPQNAPQIEQPAVFPNGENQTLPLVLNEDEDVDMEPVDLFPRNT

SEQ ID NO: 3830 - protein, 335 aa, Polaromonas sp. JS666
MSQRISLTRYLVEQQRREGHIPAQLRLLLEVVARACKGISQSVNKGALGGVLGTAGSENVQGEVQKKLDIIANEVLIEANEWGGHLAAMASEEMDSIYLVPNRYPQGEYLLLFDPLDGSSNIDVNVSIGTIFSVLKKPDDHAGVEEKDFLQPGNKQVAAGYCVYGPQTTLVLTVGDGVAMFTLDREQGSFVLIEENVRIPEDTKEFAINMSNMRHWDAPVKRYIDECLQGTEGPRGKDFNMRWVASMVADVHRILSRGGIFMYPWDKREPEKAGKLRLMYEANPMGWIVEQAGGSATNGKQRILDIQPGKLHERVSVILGSKNEVERVTGYHSGL

SEQ ID NO: 3831 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIGVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNNDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 3832 - protein, 530 aa, Saccharomyces cerevisiae
MSATKSIVGEALEYVNIGLSHFLALPLAQRISLIIIIPFIYNIVWQLLYSLRKDRPPLVFYWIPWVGSAVVYGMKPYEFFEECQKKYGDIFSFVLLGRVMTVYLGPKGHEFVFNAKLADVSAEAAYAHLTTPVFGKGVIYDCPNSRLMEQKKFVKGALTKEAFKSYVPLIAEEVYKYFRDSKNFRLNERTTGTIDVMVTQPEMTIFTASRSLLGKEMRAKLDTDFAYLYSDLDKGFTPINFVFPNLPLEHYRKRDHAQKAISGTYMSLIKERRKNNDIQDRDLIDSLMKNSTYKDGVKMTDQEIANLLIDVLMGGQHTSAATSAWILLHLAERPDVQQELYEEQMRVLDGGKKELTYDLLQEMPLLNQTIKETLRMHHPLHSLFRKVMKDMHVPNTSYVIPAGYHVLVSPGYTHLRDEYFPNAHQFNIHRWNNDSASSYSVGEEVDYGFGAISKGVSSPYLPFGGGRHRCIGEHFAYCQLGVLMSIFIRTLKWHYPEGKTVPPPDFTSMVTLPTGPAKIIWEKRNPEQKI

SEQ ID NO: 3833 - protein, 362 aa, Glycine max
MPPKQQQSKADLAKKQKIVEDKTFGLKNKNKSKNVQKYVQNLKQSVQPRPDAAKVDAKKKKEEEKAKEKELNDLFKIAVTQPKVPVGVDPKSILCEFFKVGQCAKGFKCKFSHDLNVQRKGEKIDIYSDKRDQETMEDWDQETLEKVVESKKTEYNQNKPTDIVCKYFLDAVEKKQYGWFWVCPNGGKNCHYRHALPPGYVLKSQMKALLEEESEKISIEEEIENQRAKVATTTPMTPELFFEWKKKKIEERDANIAAQQAERAKNDRMSGRELFLSNASLFVDDAEAYDVYQREPESYETEENGSRNAAEDGPSSSATAAADGDYLDDIDDDDELDMDELDELEASLSKTSIQIKETGAEA

SEQ ID NO: 3834 - protein, 268 aa, Ehrlichia canis str. Jake
MNILLIGCGNLGSILLNKWSHNAQISKVIVVQPSLSKRDAFNSITKVTFVKDYEKISRDFVPQVVVIAIKPQQIFDVMPNYGIYSKSASFISLCAGIDVNLLKKCLGNTATIIRVMPNIAMSLSKSVNLSYMEEESHNEKQKVSIIFNDTGLIYWIQKEDIFDKLSPITGSGPAFFFSLAEELVKHTVEAGINEEDAIKLVSQTFIGSAKLLETRKTTISNIISSITSRGGITQAALQVLNLDLPKTISSCLKAAMERLLYLKDMHNK

SEQ ID NO: 3835 - protein, 214 aa, Lycopersicon esculentum
QSFKLPNPLISQNHKLTTTSTTASRSFSCKSQSTSTDSTNTEVQELSVYEINERDRGSPAYLRLSQKTVNSLGDLVPFSNKLYTADLKKRIGITAGLCILIKHEEEKKGDRYEAVYSFYFGDYGHIAVQGAYLTYEETYLAVTGGSGIFAGVSGQVKLQQLIFPFKLFYTFYLKGIPGLPSELLCTAVPPSPTVEPTPEAKACEEGAALKNYTN

SEQ ID NO: 3836 - protein, 366 aa, Prochlorococcus marinus str. MIT 9313
MAFNQTEVVLGGIAHIPLVIGAFYIVKALFYRGQDGELAPFSFSYRQAAQRKSSSTTTSTEKPDTKSPPAQTAIPINLYKPKAPFEGTVLENYSLVKEGAVGRVNHITFDLAGSDPHLSYVEGQSIGIIPAGTDANGKPHKLRLYSIASTRHGDNLEGKTVSLCVRQLQYELDGKTIDGVCSTYLCDIKPGAKTKITGPVGKEMLLPDDEEANVIMLATGTGIAPMRAYLRRMFEPTERSKNGWKFRGKAWLFMGAPYTANLLYDEDFERYLREFPDNFIYTKAISREQQNPKGGRMYIQDRVMEYADQIFKMIENPKTHVYMCGLKGMEPGIDEAMTAAATAKGIDWSELRPQLKKAHRWHVETY

SEQ ID NO: 3837 - protein, 283 aa, Cochliobolus heterostrophus
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3838 - protein, 214 aa, Rhodospirillum rubrum ATCC 11170
MNQIFANPLSLPGTAQERVSRAVDSLRQGQGVIVVDDEDRENEGDLIFAAETLTAEQMSRMIRDGSGIVCLILTDPDLDRLALPPMVAHNTSRNGTGFTVSIEAREGVTTGVSAADRVTTIRAAIDPASTADDLARPGHVFPLRAHADGLSARRGHTEATIALMRLAGLRPAGVLCEVMNPDGTMARLPTLIGYGQAHGLPIVSIEDLVAVGAR

SEQ ID NO: 3839 - protein, 265 aa, Brucella suis 1330
MSFALSPVAANEGYRLETFEAVGSTNAVALERAAGGDPGKLWLVTKKQESGRGRRGRAWSTPEGNLASTLLLVESYEMKTAATLGFVAGLSLADALDAVFAATGPAVPPTIGLKWPNDVLVNGAKLTGILLESSILAKNLFAVAIGIGTNVVAFPDDLPYPATSLRALGSKCDAETLFAALSDAWSVNYRVWNEGRGLDDIRKRWLKRAHGLGQHVTMQVEGRVVEGRFETIDEACRFVIREDEGSRVAVTAGDVYFGTAATIRK

SEQ ID NO: 3840 - protein, 284 aa, Streptococcus thermophilus CNRZ1066
MATIQWFPGHMSKARRQVQENLKHVDFVTILVDARLPLSSQNPMLTKIVGDKPKILILNKADLADDNRTKEWRTYFESQGIKTLAINSKEQSTVKLVTDAAKSLMTEKIQRLRERGIQKETLRTMIIGIPNAGKSTLMNRLAGKKIAVVGNKPGVTKGQQWLKSNKDLEILDTPGILWPKFEDELVGLKLALTGAIKDQLLPMDEVTIFGLNYFKTYYPERLEERFKGIDLEEEAPEIIMEMTRKLGFREDYDRFYNLFVKDVRDGKLGRYTLDIVGVDTDGDN

SEQ ID NO: 3841 - protein, 164 aa, Pyrenophora teres
EIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3842 - protein, 410 aa, Mannheimia succiniciproducens MBEL55E
MTNKVSLDKSKIKFLLLEGVHQNALDVLHAAGYTNIEYHKKALEPDELKEAIKEAHFIGLRSRTNLTADILEHANKLIAIGCFCIGTNQVALEAAEEKGIPVFNAPFSNTRSVAELVLGEILLLMRNIPAANAQVHRGEWNKSAAGSHEVRGKKLGIVGYGHIGSQLSIIAESLGMNVFFYDVETKLPLGNAQQVSTLEELLSSCDIISLHVPELPSTKNLMSAERIAQLKPGSILINAARGTVVDIDALAEALEQGKIHGAAIDVFPKEPASAAEAFESPLRKFDNVILTPHIGGSTAEAQENIGTEVASKFVKYSDNGSTLSAVNFPEVSLPEHRTAKRILHIHHNRPGILNKINQVFVDENINIAAQYLQTDAKIGYVVIDVETDDSTDLLQKLKSIEGTIRARVLF

SEQ ID NO: 3843 - protein, 219 aa, Mannheimia succiniciproducens MBEL55E
MNQLEMKKVAAKAALQFVKPDMIVGVGSGSTVNCFIEELGAFRDQIKGAVAASKASEELLRKQGIEVFSANDVSSLDIYVDGADEINPQKMMIKGGGAALTREKIVSSLAKNFICIVDSSKQVDILGSTFPLPVEVIPMARSQVARKLVALGGSPEWREGVITDNGNVILDVHNFIIMNPIEMEKELNNVAGVVTNGIFALNAAHTVIVGTPDGAKIIE

SEQ ID NO: 3844 - protein, 337 aa, Ajellomyces capsulatus
MVVKVGINGFGRIGRIVFRNAIEHGEVDVVAVNDPFIETHYAAYMLKYDSTHGQFKGTIEVNSNGLTVNGKAVTFYQERDPANIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 3845 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHAFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTRGMAISVYLIPVWLIVLGIGYLFKEKTAKAVKAH

SEQ ID NO: 3846 - protein, 283 aa, Venturia inaequalis
HTSYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKERLCYVALDFEQEIQTASQSSSLEKSYELPDGQVITIGNERFRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 3847 - protein, 337 aa, Ajellomyces capsulatus
MVVKVGINGFGRIGRIVFRNAIEHGEVNVVAVNDPFIETHYAAYMLKYDSTHGQFKGTIDVNSNGLTVNGKAVTFYQERDPASIPWGKHGVEYVVESTGVFTTTEKASAHLKGGAKKVIISAPSADAPMFVMGVNEKTYDPSVNVLSNASCTTNCLAPLAKVINDNFGLTEGLMTTIHSYTATQKTVDGPSSKDWRGGRTAAQNIIPSSTGAAKAVGKVIPSLNGKLTGMSMRVPTANVSVVDLTCKTEKPVTYDQIKQTIKKASEGELKGILGYSEDALVSSDLNGDSRSSIFDASAGIALNDHFIKLISWYDNEWGYSRRVVDLIAYIAKVDAGK

SEQ ID NO: 3848 - protein, 851 aa, Ipomoea batatas
MNAISNLLRIKDVSFSISFLLNFSYYPNLCILRFRHSVKLKAFLSDPEAPSSVIGRRQLPGALFFSGVACDQDSRVISLAISAVPLFGSLPPEIGLLDRLLNLTLTSVNLSGALPSEMAKLTSIKAINMSNNLLSGHFPGEILVGMTELQVLDVYNNNFSGRLPHEVVKLKKLKILNLGGNYFTGEIPEIYSNISSLQTLNLQTNSLTGNIPASLAQLQNLRELRLGYLNTFERGIPPELGSITTLQMLDLRECNLSGEIPKSLGNLKQLYFLYLYGNSLTGHIPAELSGLESLVHLDLSENNMMGEIPQSLAELKSLVLINLFRNTFQGTIPAFIGDLPKLEVLQLWNNNFTSELPVNLGRNRRLRFLDVSSNQISGRVPENLCMGGKLEALILMENKFSGPFPQVLGECKSLNGVRVEKNYLNGAIPPGFLQFAVGLIYVCLQNNYFSSELPTKMLAKNLTDLDLHNNRINGQIPPAFGNLENLWKLSLHSNRFSGKIPNQISHLKKMVTMDLSSNSLTGEVPASIAQCTQLNSFDLSANNLTGKIPKEISSLERLNVLNLSRNLLTGSVPSELGLMNSLTVLDHSFNDFSGPIPTNGQLGVFDNRSFYGNPKLFYSPPSSSPVNHNNHSWTTKRILIITVLILGTAAAFLSAVIWVRCIIVARREKIMKSNNAWKLTTFKKLEYKVEDVVECLKEENIIGQGGAGTVYKGSMPDGVIIAIKRLDRRGTGRRDLGFSAEIKTLGRIRHRHIIRLLGYASNRDTNLLLYEYMPNGSLSGILHGTNGANLLWEMRFRIAVEAAKGLCYLHHDCSPPIIHRDVKSNNILLTSDYIACIADFGLAKSFNNVGV

SEQ ID NO: 3849 - protein, 138 aa, Haemophilus ducreyi 35000HP
MLQQTLCLIKPDATQRNLIGKIISYLENAGLKIKAIKKLQLTQAQAEKFYLEHQDKPFFASLVGFMISAPIVAIVLEGENAIAHYRELMGATNPEQREAGTIRALYAISNQENSVHGSDSETSAKREIDYFFSKEEIC

SEQ ID NO: 3850 - protein, 101 aa, Arabidopsis thaliana
  misc_feature (83)..(83): Xaa can be any naturally occurring amino acid
  unsure (1)..(101): unsure at all Xaa locations
MASSMLSSATMVASPAQATMVAPFNGLKSSGGFPGTRKGNNDITFITSNGGRGNWMPGWASIGKEKVETFFYLSDLTDFQLAXGGDFLIRNQGVPWGGIQV

SEQ ID NO: 3851 - protein, 117 aa, Picea mariana
QGNFFKSMSSFLQEAEEDIARIQSEENRAFSLVRETTEYFHGDAAKEEGRPLRFFVVVKDFLGVLDQVCREIGKTRTRMAQSSPRPPQVVAHAISMPLFPKALQRRPDSSDDESSSP

SEQ ID NO: 3852 - protein, 435 aa, Nitrosomonas europaea ATCC 19718
MTITNQQLFERSRQYIPGGVNSPVRAFKSVGGTPVFFQRGQGAYFWDVEGKSYIDYVGSWGPLILGHAHPDVVRAVQIAAGHGTSFGAPTAAELEIAELLCRLLPSLEMVRLVSSGTEAGMSAIRLARGYTGRNRIIKFEGCYHGHDDALLVKAGSGALTFGHPSSAGVPAETAGHTLVLNYNDVAGVEETFSKMGTEIAAVIVEPVAGNMNLIKATSQFLETLRTLCTKHGSLLILDEVMTGFRVGLECAQGLYGIKPDLTILGKVIGGGLPMAAFGGRRDVMECLAPLGSVYQAGTLSGNPVAVAAGLETLHQIQVPGFFDKLSTMTRKLTEGLTAVAAKHSVAFCAQAVGGMFGLYFRKSPPESFAEVMESDREAFNHFFHAMLKEGVYFAPSAFEAGFVSAAHSNEEIDKTLAVADRIFGQGMRRTEKATL

SEQ ID NO: 3853 - protein, 347 aa, Arabidopsis thaliana
MASSLTRNCSRFSKAISVRFMSNLPENTVYGGPKPQNPNQRVTLTHLRQKHRRGEPITVVTAYDYPSAVHLDTAGIDVCLVGDSASMVVHGHDTTLPISLDEMLVHCRAVARGAKRPLLVGDLPFGTYESSSSQAVDTAVRVLKEGGMDAIKLEGGSASRITAAKAIVEAGIAVIGHVGLTPQAISVLGGFRPQGRNIASAVKVVETAMALQEAGCFSVVLECVPPPVAAAATSALKIPTIGIGAGPFCSGQVLVYHDLLGMMQHPHHAKVTPKFCKQYANVGEVINKALMEYKEEVSKKVFPGPSHSPYKITASELDGFLTELQKLGFDKAASAAALAAENMEPSK

SEQ ID NO: 3854 - protein, 266 aa, Gluconobacter oxydans 621H
MPPSPRLVVGNWKMHGLREQSGRLARAVAEGAQSLPDDVRLVLCPPFTQLASVHGIINAEGPATPLRLGAQDCHTTSSGPHTGDISAEMLADLGVRYVILGHSERRQAHGETDVLIRQKVEAAEAAGLIPIVCIGETTQERLEGRTTTVLATQVEGSLTDGFTGILAYEPVWAIGSGTIPPIDELERTLSLLHGLLQSRLKTDDIRVPILYGGSVTPAQAPTIFSIGSLGGVLVGSASLEAESFLRIAEAASFRLTSQPLSGPYRS

SEQ ID NO: 3855 - protein, 516 aa, Polaromonas sp. JS666
MALPDLGLDLRRLPAPLPMWHGQVGRDAWSSAARTIADSGGRLVSVWGVDRRASGGAMAACAAYAVFEGLVWLELPLDDATPGFPDLSSAFPCAGRMQRAMADLSGLHADGSRDDRPWLDHGMWAPGNPPLQHHAEPKAAGVGTLPADYPFVCVEGDGVHEIAVGPVHAGIIEPGHFRFSVVGEKVLRLEEHLGYTHKGIERRFTELTPIEGHRLAGRVSGDSTVAYAWAYCMALESAWGSRIPARATWLRALMLERERVANHLGDLGALGNDAALAFGLAQFSRLREDWQRLSKEAFGHRFMMDAVVPGGVAVDLAPPMLDRLRKQCDDIERDVRALKVVYDEHAGLQDRLLTTGRVTPQLAAQLGLTGLAGRASGQTADLRCDHEWAPYDRFEVAMATHRNGDVAARVTVRFEETFESLRLIRAICAGLPGDATHVDLRPPAVPTMGAGWVEGWRGEVFVALEIGGDGRVVRCHCHDPSWQNWPVLEHAIIGNIVPDFPLINKSFNLSYSGHDL

SEQ ID NO: 3856 - protein, 1043 aa, Arabidopsis thaliana
MDEHGDHRQSNPFNDQQTSSGKILRIRLENFMCHSNLEIEFGDWVNFITGQNGSGKSAILTALCVAFGCRARGTQRAATLKDFIKTGCSYALVYVELKNQGEDAFKPEIYGDTLIIERRISDSTSLTVLKDHQGRKISSRKEELRELVEHYNIDVENPCVIMSQDKSREFLHSGNDKDKFKFFYKATLLQQVDDILQSIGTKLNSANALLDEMEKTIKPIEKEINELLEKIKNMEHVEEITQQVLHLKKKLAWSWVYDVDRQLKEQNEKIVKFKERVPTCQNKIDRKLGEVESLRVSLTEKKAQVACLIDESTAMKRELECLRQSMKKAAREKIALEEEYHHKCSNIQKIKDRVRRLERQIEDINEMTIRSTQVEQSEIEGKLNQLTVEVEKAESLVSSLKEEENMVMEKASAGGKEKEHIEEMIRDHEKKQRNMNAHINDLKKHQTNKVTAFGGDKVINLLRAIERHHRRFKMPPIGPIGAHVTLINGNRWASAVEQALGNLLNAFIVTDHKDLVALRDCGKEAKYNNLKIIIYDFSRPRLDIPRHMIPQTEHPTILSVLHSENTTVLNVLVDVSCVERHVLAENYEVGKIIAFERRFSRGPVQTTLPPRPRRPTRLCASFDDQIKDLEIEASREQSEIQECRGQKREAEMNLEGLESTMRRLKKQRTQLEKDLTRKELEMQDLKNSVASETKASPTSSVNELHLEIMKFQKEIEEKESLLEKLQDSLKEAELKANELKASYENLYESAKGEIEALEKAEDELKEKEDELHSAETEKNHYEDIMKDKVLPEIKQAETIYKELEMKRQESNKKASIICPESEIKALGPWDGPTPLQLSAQINKINHRLKRENENYSESIDDLRIMHGEKEQKIGKKRKTYKSCREKLKVCKDAVDSRWNKLQRNKDLLKRELTWQFNHHLGKKGISGNIRVSYEDKTLSIEVKMPQDATNSAVRDTRGLSGGERSFSTLCFTLALQNMTEAPIRAMDEFDVFMDAVSRKISLDTLIDFALKQGSQWMFITPHDISMVKSHEKIKKQQMAAPRS

SEQ ID NO: 3857 - protein, 275 aa, Pasteurella multocida subsp. multocida str. Pm70
MQAKSICFIGGGNMAQAIIFGLLKQGYPANQITVSDPNAAKRQCLAEKGVNTVEASQTDTQDAVETSEVLLLAVKPQMIAAVCQGLSAVDFSQKLVISIAAGVSVTKLQSRLPTAKQIVRVMPNTPALVAEGMSGLFAQNSLKPEYKQFTQDLLNAVGKTCWVTQEADMHTITAGSGSSPAYFFLFMEAMQQALCQMNMDEDTARLLVQQSALGAAKMVIENPDLPIATLRENVTSKGGTTAAALQVLNQQQLQHIVQQAMQACVERSQQMEKLF

SEQ ID NO: 3858 - protein, 333 aa, Aspergillus oryzae
MSSTQSRYAKAHESLGGPGDARPTALQIVQDENRVNDLTDKVIMITGCSSGLGIETAKALFHTGATLYLTARDLGKAKTALGDLVDSPRVHLLHLDLNSLASVRACAEEFKSKESTLNILIEDAGVMACPEGRTADGFETQFGTNHLAHFLLFYLLKPQFLSSSTFSFQSRLVVVASSAHRVSSVHFDNITLEGEYEPWKAYGQSKTANIWTANEIERRYGSQGLHAFSLHPGAIATELLRHVSDEQKSVWDADDWLKKYWKSPEQGAATSVWGAVARDLEGTGGKYLDNCQIASPADPTKRHGPGYATWAYNPDGEAKLWAKTLELLELKDE

SEQ ID NO: 3859 - protein, 466 aa, Candida glabrata CBS 138
MDINPLQDSFQRAMNLSRSPGAVSTSPTQSFMNTLPRRLSVSKQQKALKPFSTGDMRILLLENVNQTAVDIFKDQGYQVEFYKSSLPEEELIEKIKDVHAIGIRSKTKLTANILKHAKNLVVIGCFCIGTNQVDLDYAASIGVAVFNSPFSNSRSVAELVIAEIISLARQLGDRSIELHTGTWNKVSQKCWEVRGKTLGVVGYGHIGSQLSVLAESMGMHVLYYDIVTIMALGTAKQVSTLDELLNKSDFVTLHVPETPETKNLLSAPQFAAMKDGAYVINASRGTVVDIPSLIQAMKAGKIAGAALDVYPNEPAKNGADAFSDKLNNWTSELVSLPNVILTPHIGGSTEEAQSAIGIEVAHALSKYINEGISVGSVNFPEVSLRSLDLDQENTVRVLYIHKNVPGVLKTVNNILSNHNIEKQFSDSCGEIAYLMADISDVNQSDIKQIYDELDKTSSKISIRLLY

SEQ ID NO: 3860 - protein, 404 aa, Salmonella enterica subsp. enterica serovar Typhi
MSPIEKSSKLENVCYDIRGPVLKEAKRLEEEGNKVLKLNIGNPAPFGFEAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVNIAREHNLIIFADEIYDKILYDDAEHHSIAALAPDLLTITFNGLSKTYRVAGFRQGWMVLNGPKKHAKGYIEGLEMLASMRLCANVPAQHAIQTALGGYQSISEFILPGGRLYEQRNRAWELINDIPGVSCVKPRGALYMFPRIDAKRFNIHDDQKMVLDFLLQEKVLLVQGTAFNWPWPDHFRIVTLPREDDLEMAINRFGRFLSGYHQ

SEQ ID NO: 3861 - protein, 279 aa, Gibberella zeae PH-1
MSVVSLLGVNVLNNPAKFVDKYEFEITFECLEQLEKDLEWKLTYVGSATSDQYDQELDSLLVGPIPVGVNKFIFEADAPNISRIPDAEILGVTVILLTCAYDGREFIRVGYYVNNEYDSEELNAEPPVKPIIERVKRNVLAEKPRVTRFAIKWDSEASAPAEYPPEQPEADLVADGDEYGAEEADEEAAEEAEEEAKSKGKASSGEDAEMAGVEHEGENAADEDELSDDGSVDIEGESEDDLEEEEEGEGEGEADGDAMEVDSAEKPATSTAKPVSVAS

SEQ ID NO: 3862 - protein, 338 aa, Zea mays
RCLDSKDGLETYPDIGHAAFGTAGRIIISIILYMELYACCIEYLILESDNLSKLFPNAHLTMGNLTLDSHMLFAILTALVVMPTTWLRDLSCLSFISAGGVIASIVIVSCLFWVGLVDHVGTVESEGTALNLPGIPIAIGLYGYCYSGHGVFPNIYSSLKKSNQFPAVLFTCIALSTVLFAAAAIMGYIMFGESTESQFTLNLPPNLVASKIAVWTTVTNPITKYALTMTPLALSLEELLPPNKQTYPNIMMLRSALVVSSLIIALSVPFFGLVMSLVGSFLTMFVAYILPCACFLSILRSKVTWYQVVLCVFIIVVGLCCVGVGTYSSLSKIIQKYQ

SEQ ID NO: 3863 - protein, 377 aa, Stevia rebaudiana
MADTEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 3864 - protein, 142 aa, Streptococcus thermophilus CNRZ1066
MKVGNMQKTFFIIKPDAVKRHLIGQVLDRIERRGFVIERMEMLMLDEERLKEHYAQLADKPFFPSISEFMMSGPAVIGIMSGPGVIKSWRDMMGATNPGDAAPGTIRGDFATAPDGDMIPNIVHGSDSEESAAREIKIWFGE

SEQ ID NO: 3865 - protein, 557 aa, Schizosaccharomyces pombe
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 3866 - protein, 194 aa, Zea mays
  misc_feature (154)..(154): Xaa can be any naturally occurring amino acid
  misc_feature (174)..(174): Xaa can be any naturally occurring amino acid
  unsure (1)..(194): unsure at all Xaa locations
DSADVEQRHHVVSFPATTDTSSVVLEGNSSEAIQILYQVWEDPSSSPQALRALEQAITKLCERLTEEKRGEDLRTLLTKLIPFFSLIPKDKSAKIVRGIIDTLIKIPGTTHLPITLCKEMAEWTRAEKSTFLKPSEKARLAALLMENKEYVEAXLTLLTTLVKDVKRLDDHVLXLADIDLLESKLHYRVEKLTL

SEQ ID NO: 3867 - protein, 208 aa, Lycopersicon esculentum
ASGSKDFDFFYFVQQWPGSYCDTKQSCCYPTTGKPAADFGIHGLWPNNNDGTYPSNCDPNSPYDQSQISDLISSMQQNWPTLACPSGSGSTFWSHEWEKHGTCAESVLTNQHAYFKKALDLKNQIDLLSILQGADIHPDGESYDLVNIRNAIKSAIGYTPWIQCNVDQSGNSQLYQVYICVDGSGSSLIECPIFPGGKCGTSIEFPTF

SEQ ID NO: 3868 - protein, 246 aa, Solanum tuberosum
MATVSSASAALRAISSSSYKLPSAFQITSLSQKIQSLKLPNPLISQTHKLTTTSTTASRSFSCKSQNSSTDSTNTEVQELSVYELNERDRGSPAYLRLSQKNVNSLGDLVPFSNKLYTADLKKRIGITAGLCILIKHEEEKKGDRYEAVYSFYFGDYGQIAVQGSYLTYEDSYLAVTGGSGIFAGVSGQVKLQQLIFPFKLFYTFYLKGIPDLPSELLCTAVPPSPTVEPTPEAKACEDGAALKNY

SEQ ID NO: 3869 - protein, 554 aa, Clostridium perfringens ATCC 13124
MNKKWWKELIAYQIYPKSFMDSNGDGIGDIQGIISKLDYLKDLGIDLIWLCPMYKSPNHDNGYDISDYKDILDEFGTMDDFNELLSEVHNRGMKLIIDLVINHTSHEHPWFIESRASRDNPKRDWYIWREGKGDEEPNNWESIFKGSAWEFCENSEEYYLHLFAKEQPDLNWENKEVRNELYKMINWWLDKGIDGFRVDAISHIKKEEGLKDMDNPEGLKYVSSFEKHMNVEGINSHLKELKEETFSKYDIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSISEYDDVKTINTYNERIESGVSEEIALKEAWVTSRDNSRTPMQWNSSENAGFTCGKPWIGVNENYKTINVEVEERDENSVLNFYKKLIKLKKSNEALIYGVYDLILEEDENIFAYTRTLNNEKFLIMANLTGENAKYMYEKEKLNSKDLILNNYEVCEHKNLTEFTLKPYECRVYKLS

SEQ ID NO: 3870 - protein, 887 aa, Gibberella zeae PH-1
MATEQQRLPTRERRPSTSAPIVDIQGAVGPTGISRPKHTRTATGFGPSEIKNFEASIPEPQREAWKRNQSRGFTGKDGFEQEVVRHVETTLARSVLNCDENAAYAATSLAFRDRLILDWNRTQQRQTYRDSKRVYYFSLEFLMGRALDNAMLNVGQKDIAKAGLSELGFRIEDIITQENDAALGNGGLGRLAACFLDSLASLNYPAWGYGLRYRYGIFKQEIVDGYQVEVPDYWLDFNPWEFPRHDVVVDEQIQFFGHVRKTTDSNGKSVAIWEGGEIVQAVAYDVPIPGYDTPTTNNLRLWSSKASGGEFDFQKFNNGDYESSVADQQRAETISAVLYPNDNLDRGKELRLKQQYFWVAASLYDIVRRFKKSSRPWREFPDQVAIQLNDTHPTLAIVELQRILIDIEHLEWDLAWDIVVKTFSYTNHTVLPEALEKWPVGLIQHLLPRHLQIIYDINLFFLQKVEKAFPNDRDILSRVSIIEESQTKMVRMAFLAIVGSHKVNGVAELHSDLIKTTIFKDFVEIYGPDKFINVTNGITPRRWLHQANPRLSELIASKVGGNGFLKDLTNLNQLEKYAEDKEFRKEWSEIKYANKVRLAKLIKSLVGVTVNPSALFDVQVKRIHEYKRQQLNIFGVIHRYLYLKSLTPEERKKVVPRVSIFGGKAAPGYWMAKQIIHLVNAVGSVVNNDEDIGDLLKVIFLPDYNVSKAEIITPASDLSEHISTAGTEASGTSNMKFVLNGGLIIGTCDGANIEITREIGENNIFLFGNLAEDVEDLRHNHQYGSHEIDPDLQKVFAEIEKGTFGSVHDFSALVAAVRDHGDYYLVSDDFHSYNETHKLVDEAYQNQEEWIKKTITSVSRMGFFSSDRCIDEYAESIWNTEPLVIHD

SEQ ID NO: 3871 - protein, 298 aa, Oryza sativa (japonica cultivar-group)
MALVRERAMVYGGGCDAEAFGGGFESSQMGYGHDALLDIDAAALFGGYEAAASAGCALVQDGAAGWAGAGASSSVLAFDRAAQAEEAECDAWIEAMDQSYGAGGEAAPYRSTTAVAFDAATGCFSLTERATGGGGGAGGRQFGLLFPSTSGGGVSPERAAPAPAPRGSQKRAHAESSQAMSPSKKQCGAGRKAGKAKSAPTTPTKDPQSLAAKNRRERISERLRILQELVPNGTKVDLVTMLEKAISYVKFLQLQVKVLATDEFWPAQGGKAPEISQVKEALDAILSSSSPLMGQLMN

SEQ ID NO: 3872 - protein, 331 aa, Salmonella enterica subsp. enterica serovar Typhi
MTIKVGINGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 3873 - protein, 454 aa, Medicago truncatula
MDLIELSKAVENVELVDTLDTDVSFVRILWVDNSGQHRCRAIPRKRFYDVVTKNGVGLAFVSMVMTSFLDGSPAGSGLGSVGEARLTPDLSTKRTIPWSKQDEIVLGDLNLQPGQAWEYCPREALRRVSKILKDEFDLAMNAGFENEFFLLKSAIREGKEEWIQFDSTPYCSSSAFDVASPILREVTSALHSMGIPVEQLHAEAGKGQFELVLGHMVCTKSADNLVYTRETVRAIARKHGLLATFVPKYTLDDLGSGCHVHLSLWQNGRNVFMASDESSKYGISTLGKEFMAGVLHHLPSILSFVAPLPISYDRLQPNTWSGAYMFWGNENREAPLRASTPPGTPNGFASNFEFKSFDGCANPYLGLSAIIAAGIDGLRRHLSLPEPVDTNPDPEKLQRLPKSLSESLEALHKADFLEEFIGDKLLTAIKAIRKAEIDHYSKNKDAYKQLIHRY

SEQ ID NO: 3874 - protein, 90 aa, Triticum aestivum
MAGAAKASWMVAMSVGAVEALKDQAGLCRWNYALRSIHRAAKARASVRGSVSQGTKQLPSSAAAVAERRRTEKAEEGLRTVMYLSCWGTN

SEQ ID NO: 3875 - protein, 495 aa, Geobacter sulfurreducens PCA
MNKKRSPKTVLAAGPSSKRGDLIELAVTALDEDGNGIGTHDGTNVHVIGALPDERVRARLTHVGKRHLHAEAVEVLTPSRARLAQPSCKRAGSCDGCPLIVMHYPDQLNWKRTFTERQIRRYQTLGAAEVLATLPSPNQLHYRNSAKLVVSGTFRRPVIGIYRRNSHQVMDIGTCPLHHPLINRVVTAVKEGIAKCKVQVYNPRTGSGLLRYLVVRISERTGTAMAVFVTVERNYNEIHHLAKHLQQSVPQVEVVVQNVNSSEGNVILGQRDYFLTRQHALTEELGGIRFTISPRSFFQVNSGGARIIYETVRQWSSLTGKESVVDLYCGIGGIALFLAGTAREVHGIEVVEAAVNDAESNARLNRIHNCSFEAGDAAELIEELVEEGERLDLVVLNPPRKGCDAGVLNKVAAAGPARIVYVSCAPATLARDLDILAGLGYATLRVQPVDMFPQTPHVENIALLVKKLPRNDRLESPAKERSRPRASHKAKGGAV

SEQ ID NO: 3876 - protein, 993 aa, Xylella fastidiosa Temecula1
MFSASHFCSGSLMMSHPLSSLRDLEYHGAFVERHIGPNDVEIAQMLRVVGYDSLESLTDAIVPEKIRSTVALDLPKGITEEEALAKIRVIANKNRVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQVDVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDALAIHCAAAAAGMNLRMIDNAQIGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPVVQWSGYRQLIDELEAMLVECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKGDSEIQDLIEEDASRC

SEQ ID NO: 3877 - protein, 644 aa, Oryza sativa
  misc_feature (256)..(256): Xaa can be any naturally occurring amino acid
  misc_feature (314)..(314): Xaa can be any naturally occurring amino acid
  unsure (1)..(644): unsure at all Xaa locations
MATFTGITVGTYSGFIPNGFYSIIPDKKLKENFPTIPSLDDLQTLEADGLKADIIIVDVERDKKLFMLKQLSGALVKGLNSSPALVIKKIAGLVFDCFKSLDPDVSPARSPTEDNHFFGNKGSQLLGQIKHGSCRPRAILFKVLADAVGLESKLVVGLPDDGGVGFVDSYKHMSVVVSLNSMELLVDLMRFPGQLIPFSAKAIFISHISAAGESDSAENDSCDSPLEPNSPLYGLSDKVEAEGAFSKKVLVAWFFXNSTSCSEPNIANAFWRRSQRRGVAEEPRGASSSFFYPFCEPSYSFDKPRTHLQIRWSXGASTSKTRRIRGRSISITPEIGDDIVRAVRAMNETLKQNRLQRDHVNEGSPSYVGEDQNNASDCPNNDDTSGGVVATNNGPRNRNGSTQKAMSLPSSPHEYRAQISETINPCDFVRFFGEVFRGIWNGTDVAIKVFLEQDLTTENMEDFCNEIYILSLLFNHNMHTNFENFTISFQPAAASKWGLMCIHRMKIVHRDLKSANCLVNKHWTVKICDFGLSRVMTDSPMTDNSSAGTPEWMAPELIRNEPFTEKCDIFSLGVIMWELCTLSRPWDGISPVQVVYTVANEGSRLEIPEGPLGKLIADCWAEPQDRPSCQEILTRLLDCEYAVS

SEQ ID NO: 3878 - protein, 757 aa, Bacteroides thetaiotaomicron VPI-5482
MSQLPTLIADLALILICAGVMTLLFKKLKQPLVLGYVVAGFLASPHMPYTPSVMDTANIKTWADIGVIFLLFALGLEFSFKKIVKVGGSAIIAACTIIFCMILLGIGVGMGFGWHRMDSLFLGGMIAMSSTTIIYKAFDDLGLRKKQFTGLVLSILILEDILAIVLMVMLSTMAVSHNFEGTEMLESIGKLLFFLILWFVVGIYLIPEFLKRCRKLMGEETLLIVSLALCFGMVVMAANTGFSAAFGAFIMGSILAETIEAESIDRLVKPVKDLFGAIFFVSVGMMVDPAMIIEYAIPIIVITIAVILGQATFGTFGVILSGKPLKTAMQCGFSLTQIGEFAFIIASLGVSLHVTSDFLYPIVVAVSVITTFLTPYMIRLAEPASSFVDAHLPASWRKFLMRYSSGSQTVLNHENLWKKLLLAMVRITVVYSIVSISIIALSFRFVVPFFKENLPHFWASLLGAVFIILCISPFLRAIMVKKNHSVEFMTLWHDNRANRAPLVSTIVIRIMIAALFVIFVISGLFKASIGLIIGVAVLAVLLMVWSRRLKKQSILIERRFFQNLRSREVRAEYLGEKKPEYAGRLLSHDLHLADLEIPGESTWAGKTLMELNLGKKYGIHIASILRGKRRINIPGGSVRLFPMDKIQVIGTDEQLNVFSSAMQSGAKIDWEMYEKGEMTLKQFIIDADSVFLGKTIRESGIRDKYHCMIAGVEREDGTLMVPDVNAPFEEGDVVWVVGEKENVYQLVDQKNEKIQVK

SEQ ID NO: 3879 - protein, 340 aa, Thiobacillus denitrificans ATCC 25259
MNLDELQAVARAIVAPQKGVLAADESGPTIKKRFDTIAVESTEKSRRRYREIMFTAESIERYIGGVILYDETLRQSTRDGTPFPQLLAGRGIIPGIKVDQGAKPLALCPGEKVTEGLDGLRERLVEYHGLGAQFAKWRAVIDIDAHDLPSPFGIHANAHALARYAALCQEVGLVPIVEPEVLMDGAHDVERCEAVTARALEAVFAELDAHGVGLEGVLLKPNMVVAGKKSTRQAGVQEVAEATLRCLRRHVPAAVPGIVFLSGGQSAEEATAHLSAMNAMGPHPWQVSFSYGRALQAPVLAAWRGHEANAAAAQAALLERARLNGLARDGAYGPEMESAG

SEQ ID NO: 3880 - protein, 471 aa, Treponema denticola ATCC 35405
MKKTKIVCTIGPASDSERVLAEMFKAGLNVCRLNFSHGSHEEHKVKIDRIKKIREELKMPIALLLDTKGPEIRLGLFEKPVEIVQGQEFIITTRDVIGTNQICSISYKNIAAEIKPKSRILINDGLLELQVIDILNDTDIECVAVNSGTLSSRKGVNIPGLRVNLPYMSEKDISDIEFGIENDVDFIAASFTQRADDIIQIRKLLEKHKSTIAVIAKIENQEGLDNIDEILAEADGIMVARGDMGVEIEPEKIPHLQKQLIKKANLAGKPVITATQMLESMTHNLRPTRAEVTDVANAILDGTSAVMLSGETAAGEYPVETVAMMTSIANSIEETLDYEKLFAENASLHETTITNAIARATCSTALALDANAIITASASGITPRALSKFKPRVPIIAITESPQVMRKMALDWDVYPVLADPIKSTDNMFDVCSQIAKDTGHVKKGDIAILTAGIPIGKAGSTNLLKVEIIE

SEQ ID NO: 3881 - protein, 181 aa, Arabidopsis thaliana
  misc_feature (10)..(10): Xaa can be any naturally occurring amino acid
  misc_feature (144)..(144): Xaa can be any naturally occurring amino acid
  unsure (1)..(181): unsure at all Xaa locations
MAASMLSSFXFVTSPAQATMAGPFTDMKSFAFFPDTRKANNDITFITNNGGRINFLKAWPPFEKKTVGTLYYLPDLTDVELAKEVDYLLRNKRIPCVEFHLEHGFVYREHRNTTGYYDGRYWTMRKLTLIGCTDYAQVLKEVEXCKKDYPGALIMIIGINNTRHVQSITIIAYKRSSFTDA

SEQ ID NO: 3882 - protein, 432 aa, Ralstonia metallidurans CH34
MVRCAHARPAYRILHRDAPCLSNSPAFSPTIMASALLLENIHASAQQLLGRHQIDLATQGKALAGDALLAAVRDHELLGIRSATTLTAEAFAKAQRLLTVGCFCIGTSQVDLGAAAHAGIPVFNAPFSNTRSVAELVIGQAIMLMRRIPEKSRAAHSGQWQKTAKGAFEIRGKTMAVIGYGNIGAQVGILAEAMGMRVVFYDIRPRLSIGGAMPVHSLEDALSQADVVTLHVPATPQTRNLMDAKALAAMRHGSILINASRGTVVDIPALAQLLDNGQLAGAAIDVFPEEPRSNADPFVSPLQGKPNVILTPHVGGSTEEAQENIGVEVATKLVNFLETGATLGAVNLPQIQPAPQQAPARVLNIHYNRPGTLSHFNQALAEIGANIVAQQLQTEGDIGYAITDISLVPPAGWAEALMKDDAFIRTRVIVAP

SEQ ID NO: 3883 - protein, 325 aa, Oryza sativa
MMMTRASMGAMEGAAVDEVVRRLVEGGRGGRQVQLSEAEIRQLCVEAKRVLLSQPNLLRIHAPVKICGDIHGQFVDLLRLFDLGGYPPTSTYLFLGDYVDRGKQSLETICLLLAYKVKYPDKIFLLRGNHEDAKINRVYGFYDECKRRFNVRLWKIFCDCFNCLPMAALIDDKILCMHGGLSPELNSLDQIKDIERPTEIPDYGLLCDLVWSDPSPDSEGWGESDRGVSCTFGADKLVEFLEKNDLDLICRAHQVVEDGYEFFAQRRLVTIFSAPNYCGEFDNAGALLSIDESLMCSFQILKPNDTGAPHSRKPTSNKTPKTGNA

SEQ ID NO: 3884 - protein, 601 aa, Photobacterium sp. SKA34
MTNDFLVLSVVFLAAAIIAVPLAQKLGLGSVLGYLIAGIAIGPWGLGLISDVDAILHFSEFGVVLLLFLIGLELNPKKLWQMRKPILGLGGGQVVITSGVIAVVVMSLNGFLPSLTWRDTAVIGMGLALSSTAIALRVIEEQQLSGSETGQSGFAVLLFQDIAVIPMLALLPALAGGKGGSWNDAFWMLGGIAVLLVGGHFLLRPLFRYVVMSGVRELFNVAALLLVLGIALIMQALGLSMALGAFLAGVLLAESEYRHELEIAIEPFKGLLLGLFFISVGMAVNIGLLWQYPLQILAAVLALVAVKGVVLYLLARIFGVREKSRSQMAAILSQGGEFAFVLFTAARAEGLLDAQLLAFLLVVVSISMMTTPLILTLQNRWFVRSFKASEQPEPESDIVDREPRVIITGFGRFGQVIGRLLFANKIKVTVLERDPSQIQFLRKFGYKVFYGDATQLDLLRAAGADNAEAIIICTDAPTEVMEVVAMCQQHFPHLKILARARSRVEAHQLLSQGVECFSRETFAGALDLGRQALISLGMHPYKAQRAEAHFRKIDTQALRDLLPQHSEEVNLASRQKEARKELEEIFDREMRGEEERHHGWD

SEQ ID NO: 3885 - protein, 279 aa, Bacillus halodurans C-125
MLQDHKITFLGAGSMAESIIAGLLSKKLLLPSQVIATNLCDEAKLTKLEDRYGICTTQNRQEAVRQGTIIFLAMKPKNIEEAIEEIRGEITEKQLFISVLAGTTTSYIETLLAHEVPVVRTMPNTSAKVGASATGLCGGRYANASHVKLATLIFTAIGTVTEVTEDKLDAVTGLAGSGPAYFYYMVEAMERAAVQSGLTESEAKAFISQTLIGTGKRLEQTSKTAEELYKEVMSPGGTTEAGLRVLEQQQMQQAIEEAITAAINRSRELGSTPSLEIKK

SEQ ID NO: 3886 - protein, 452 aa, Burkholderia sp. 383
MPSRHGVDLIRARALFDRERRAFTEAMPVSRALSAEASEHLLFGVPLHWMQDWSTPFSLYVKEARGATFTDVDDHRYVDFCLGDTGAMFGHAPEPVARALVEQATRGYTTMLPSEDAAWVARELARRFKLPVWQFALSASDANRFVLRWARAATGRKTIVVFNGCYHGTVDDVFVDLVDGRPMQRDSLLGQSYDLLANTRVVEFNDLAALEAALKGGDVACVLAEPAMTNIGMVLPDPGFWEAARELTRRYGTLLVIDETHTISSGPGGYAVAHDLEPDLLVVGKPIAGGVPCAVYGFSAEFAERAKQAKLNAPPGHSGIGTTLTANMLAMHAMRATLAEVATDAAYAHMFELAARLATGLEQAIAKHGLPWCVTRIGARTEFQFAPVPPRNGTLAGAQLDSELEHIVHLYLLNRGVLITPFHNMMLVCPQTTADDVDRLVTQFDACLGELV

SEQ ID NO: 3887 - protein, 226 aa, Zea mays
MSGVFGRVFGKSKEQSQATALASLDKLNETLEMLEKKENLLVKKANLEVEKAKNFTKAKNKRAAIQCLKRKRLYEQQIEQLGNFQLRIHDQMIMLEAAKATTETVDALRTGASAMKAMHKSTNIDDVDKTMDEINDNMENMRQIQDLLSAPMGAAADFDEDELEAELADLEGEELEAELLAPTTTAPSTAPVRVRVPTAQQSTRPSGQSSKAEDDELAALQAEMAM

SEQ ID NO: 3888 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLNVANEVDHAFWREFRRLVKSLNPDALIVGEIWHDASGWLMGDQFDSVMNYLFRESVIRFFATGEIHAERFDAELTRARMLYPEQAAQGLWNLLDSHNTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 3889 - protein, 140 aa, Triticum aestivum
  misc_feature (123)..(123): Xaa can be any naturally occurring amino acid
  unsure (1)..(140): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLLCSGXTDATQVINEVEEVRRST

SEQ ID NO: 3890 - protein, 399 aa, Bordetella bronchiseptica RB50
MRFADRMARIAPSPSSMAGQRMRELRAAGRDVIGLTAGEPDFATPDNIQQAALRAMRNGQTKYTDVGGVPELKAAVAEKFRRENSLAYRQDQIIVSSGAKQVIFNALLCLVQRGDEVVIPAPYWVSYPDMVRFAGGTPVAVACAQQHRFKLQPDELERAVTPRTRCLILNSPNNPSGAAYDETELKALAQVLLRHPDICVITDDIYEHLLYDGRRFATIAAVEPALADRVLTVNGVSKSYAMTGWRIGYAGGPAALIANMVKLQSQSTSCPSAVSQAAAIEALTGPQDIIASSRKLFQARRDLLVRRINAIPGLHCDTPDGAFYVFASCAGLAGKRTPQGRTIDNDTDLALHLLDAEGVVVIQGDAYGMPGFFRLSIAASETLIEEAQRRIAAACAALH

SEQ ID NO: 3891 - protein, 403 aa, Brassica oleracea
MNCLFLLKSKKPEPRNQQKDRRKAQNSAPGQRNKSETPSFNLHRPRSLPSGRSIRNLDREREQSLRVFTYEELSEATCGFSRRLKIGHGGFGNVYKGKIPTTRDSDPPLVVAIKKLNPQGLQGHKQWLAEVEFLGVVNHQNVVKLLGYCSEDGENGMERLLVYEYMSNRSLEEHLFTRGARTLPWKQRLEIMLGAAEGLAYLHEVKVIYRDFKSSNVLLDDEFCPKLSDFGLAREGPQGDNTHVTTAKVGTEGYAAPEYVQTGHLRLKSDVYSFGVVLYEIISGRRTIERNKPPAERRLLEWVKEYPPDSRRFSMIVDPRLRNNYPSAGTRSLAKLADLCLKKNDKERPTMEIVVERLKKIIEECDSGDSYIAASKESSQVRCNSRAAGPVEGSLRGGVSVRE

SEQ ID NO: 3892 - protein, 451 aa, Mycobacterium sp. JLS
MARDAAEVEVMAKQLKEDGVRFSIAAYTDLHGNIKGKMVPIDHFVQMAGGSELFTGAALDGLPQDVSDEELSAHPDLDRGFVLPWRKDIALFLSDLYVGGEPFEASTRNILGRQMKAAEELGYVFNLGVETEFFVLEDGPVGPSALSERDTLEKPCYAVPMLLDNFGWLQELVDYMNELGWDVYSFDHEDAQGQFEIDFAYADGLSMADRVSFFRLMANEVARRHGAYVSFMPKPFADRTGSGAHFNMSLAGLDDGHNVFESADDPRAAGLSDIGYHFAAGIVRHAAAICAVIAPTVNSYKRLVRQGSMSGSTWAPIFASCGNNNRTNMLRIPLGGGRVECRAVDSAANPHLAAALLLAAGLEGVREQLELEHFHTDNLYEVDAGEYEKRGLSLLPRTLEEAVDAFEADPFTKQVCGEKLWQSFIDYKRSEWTSYATAVTDWERDRYLKFF

SEQ ID NO: 3893 - protein, 278 aa, Aspergillus oryzae
MADLIESAKRAAGQAAVKNHYPKDAKYVGIGSGSTIVYVVEAIKESGVDTSQTKYVPTGYLSKQLIVSNGLTAVDFDSLPEGTVLDIAFDGADEVDDDLNLIKGGGACLFQEKIVALQAKEFVCVADSRKLQSRLLSNWKYIPIEVAPIAASRVLGELRELGSISPALRLNTTAPEGAPKPTPLKTDQAFNIIDAPFKSLLTKADIAAGQDGTGKDGVWEVEALSRAIKQIPGVLDVGIFSGETGPQAQARGGTGGQKPIAAYFGMPDGSVSVRKASA

SEQ ID NO: 3894 - protein, 152 aa, Candida glabrata CBS 138
MSNNERTFIAIKPDGVQRGLIGKILGRFETRGYKLVGIKLIQADQKLLEQHYAEHIGKPFFGPMTAFMSSGPILATVWEGKDAVKQGRAMLGATNPTQSAPGTIRGDFGIDLGRNVCHGSDSVESANREIGIWFKKEELVEWKPSNLAWIYE

SEQ ID NO: 3895 - protein, 269 aa, Pyrococcus abyssi GE5
MRDRLFFLLSKYGIRPNDRIGQHFLIVKDVIDKAIEVAEVSKSDVVLEVGPGLGFLTDELSKRAKKVFTIELDRRIIEILRNEYSWNNVEIIQGDAVKVEWPSFNKVVSNIPYQISSPFTFKLLKMEFERAVVMYQLEFALRMTAKPGDRNYSRLSLMTQALADVEIVMRIGKGAFYPKPKVDSALVLITPKKDRIELNESLVKALFQHRRKVVSKALRESAHMLGIKDVKTVKDILSSVPHSNKRVFHLTPEEVKEIEEYLREHRIIS

SEQ ID NO: 3896 - protein, 422 aa, Sulfolobus tokodaii str. 7
MEKFIKDPIHGNIKIDDSLIDNMYFQRLRHVIQNGMAYMVFPSMRHSRFEHSLGTYYIASKMVENVQASEKEIIDKKELIKELALYHDIGHFPFSHTFEFAMEILEYLNKNIYNSIIKLTGFRDMEYKLHEMMGINILRSIRKTELADLMSNAYSSKDIKEINDPLVKIAKLIVNSELDADRLDYLQRDSYYSGAKFGIIDPERLLITMKITTDGYVFPPKAIDDLEHFFLARFHMYSSVYNHPVIEIYNRIMAYFIAFAINSSLLDIPSNLEEFAEFTDEKIYLALLKVKNDNRFSHFYESLVKRKKYMRAVVEGDQAKNLFKIISSNEKSKRNLYDTVLNYYGKIVIGKSELTTEIGNIFIERKMLKESYNNPLSEEGGLTKIPERYRIYVGAYDEVSKNDILKYFNDTFGIRLAFKANS

SEQ ID NO: 3897 - protein, 109 aa, Arabidopsis thaliana
MFPFTHVHAFNKGNEEVYMDVENGKNGEGSVFRMPLHYPRYSKEDYQDMPEWKLDRVLADYGLSTYGDLAHKRDFAIGAFLWISTRNPKLYQEKSINSKLKKDTKSAHA

SEQ ID NO: 3898 - protein, 392 aa, Oceanobacter sp. RED65
MDLKLSNRVQSIKPSPTLAVTNRAAELRAAGKDIIGLGAGEPDFDTPEHIKDAAKQAMDNGFTKYTAVDGTPDLKKAIIAKFKNDNGLNYEANQILVSCGGKQSFFNLSLALLNPGDEVVIPAPYWVSYPDMVKIAEGVPVIIETDASARFKITPEQLDNAITDKTKLVVLNSPSNPSGMAYTKAEFEALGDVLRKYPNVLIATDDMYEHILWTEEDFNNIVTVNPDLYERTIVLNGVSKAYSMTGWRIGYAAGPQPLIASMKKIQSQSTSSPTSIAQVAAQAALEGNQQCVKDMVTVFKKRHDFMVDALNEIDGIECLNGDGTFYLFPSFKGAQAKLNCETDTDLAEKLLEAGVALVPGSAFGTPGHMRISFATSDSNLEQSIERLKKALG

SEQ ID NO: 3899 - protein, 154 aa, Haloarcula sinaiiensis
MSEHERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 3900 - protein, 154 aa, Haloarcula quadrata
MSEHERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 3901 - protein, 75 aa, Arabidopsis thaliana
  misc_feature (2)..(2): Xaa can be any naturally occurring amino acid
  misc_feature (9)..(11): Xaa can be any naturally occurring amino acid
  misc_feature (15)..(15): Xaa can be any naturally occurring amino acid
  misc_feature (25)..(25): Xaa can be any naturally occurring amino acid
  misc_feature (57)..(57): Xaa can be any naturally occurring amino acid
  misc_feature (67)..(67): Xaa can be any naturally occurring amino acid
  unsure (1)..(75): unsure at all Xaa locations
MXSSMLSSXXXVTSXAQATMVAPFXGLKSSASFPVTRKANNDITSITSNGGRVSCMXVWPPIGKKKXFETLSYLP

SEQ ID NO: 3902 - protein, 418 aa, Desulfotalea psychrophila LSv54
MSEPIFIFYKESVNVMAVSSIEEAIEDIKAGKMVILVDDEDRENEGDLCMAAEFVAAADINFMATHGRGLICLTLTPKLVDQLALPMMVQENKSPYGTGFTISIEAKTGVETGISAADRARTIQVAVADGAGPQDLVSPGHVFPLRAREGGVLCRTGQTEGSVDLARLSGATPAGVICEIMKDDGTMARMPDLEIFAAEHELKIVTVADLVEYRLRQDLLVHRQVAARIPTADAGEFTAIVYTNDVDNFEHLALVKGDLEAAEEVLVRVHSECLTGDLFGSARCDCGPQLHEAMRMIDRAGCGVVLYMRQEGRGIGLINKLKAYNLQDNQGLDTVEANIELGFKADLRDYGIGAQILRDLGITKMSLLTNNPKKIIGLEGYGIEVISRVPIEIEASEENEGYLRCKRDRMGHLLNMKE

SEQ ID NO: 3903 - protein, 501 aa, Aspergillus oryzae
MELLPKLVILLLAALGIASVSIRRFLNRRQFARRCGCQPVARSFSKDPFLGLDTIPGTIRAIRQHRVLGRSCEIFRAYGNTFTVKELHQSAIVTIEPENIQAVLSLNFKDYTLRHRLELFMPLLGRGIFNTDGQHWASSRALIRPSFAREQVANLSLLERLMQDLFVLLPRDSTTVDLQELFFRYTIDSATDLLFGQSVGALKKSQSGLAFADALQYALKAIPVRDMLGPLNAVYRDRKTDECNRICRDFVQQYVEEAVYAAGPKKEEKESRTTETKRRYILSHELASRTSDKQRMVDELINVLLAGRDTTGSLLGNLFFMLAKNPVIWAKLRAEVAVLQNRPPTYEELRGLRYVQCCVNESLRLHPVVPTNKRKAMRDTVLPRGGGNDGLSPVFVPAGTLVGYNIYAMHRRTDFYGPDAKEFRPERWEDGKLQPRWGYLPFNGGPRICLGQRYALTEASYVLVRMAQEFRGLESRDPGSWEEGLVLTVCPRNGTKVGLIP

SEQ ID NO: 3904 - protein, 458 aa, Xanthomonas axonopodis pv. citri str. 306
MSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 3905 - protein, 259 aa, Rhodospirillum rubrum ATCC 11170
MALPVVESTNLTARTLFGGAAAKDLAALDRTVVWAGEQSGGRGRQARVWHSPPGNLYHSYLLRAPKPVGQCAQLSFVAAVALAEAVERLCPLADPRCKWPNDIVCHGGKISGMLLELIEEGEGGNPWLVLGIGVNIITAPVTGALFPALALADLGCAVTVEDMLGAIAARLDHWLARWQAEGFAGIRAAWIARALGIGFPIEVRLSEETRLPGIFQGLDAEGHLLLEEPSGRVRRISAGDVFFPGRHGGSEGCSLQSTA

SEQ ID NO: 3906 - protein, 255 aa, Thermotoga maritima MSB8
MTIGIVGVGNMGSIFAEKFSKEAERILLVEKDSEKLSRFNAPPYEIADLEKVREADLIVLAVKPQDAPIVLSALKGFDGILLSIVAGLKIEEIRKYGIHKVARIMPNVAVRVGEGVLATAFSADMSLEERELVKSLLEKLGFVVEIEEKLFSAVTALTGSGPAFIFVVVEAFLDAALKMGIPLDTAKELVYRLFKGSAELLTETGEHPALWKHRVSSPAGTTIEGLITMERFAVRSGVIESLISSYRRALELEEK

SEQ ID NO: 3907 - protein, 291 aa, Mycoplasma pulmonis
MNSKKNNNENDNLNEIKINWFPGHMAKGMREIEEKAVVADLFVILLDVRAPLSCYNKSFDKIAPNKPRLFVFSKIDLGDKDKYNKIKEHFGSNKNVVFVDLKKPQSRQIILKKIDYLLKEKVLQEQKKGLNKPRLRVFVLGVPNTGKSTFINLLLKEKKVKVGNMPGITRGQQWIKVDNILLLDTPGILWPNLDDQDVAIKLSIIGSIRSEIIPSDFLFKNTYKIISKNYPEILTNMNLFSSNDENKIHENLLKIAEQKNMFIKNGEYDLERARKWFYNFIKNSKGLTYDF

SEQ ID NO: 3908 - protein, 250 aa, Streptococcus thermophilus CNRZ1066
MATQEVRAVSLRGRVSSYLADFSKLDNVYRFVEEIKRDFQRIDILFNNAGLYAGKERKASGENVELTFMLSVLVPYIFITELIPLLEKLPDGLVINTSSYMHHFAKVKDLDFGFEKEYNPGLAYNNSKLYTIWMTRYLARDFFLKGSNTTINAYHLGLILTNLGNNSSDKKTEKSLFGRLMKSLSKDLDQGIETGYYLTLSEEVSCLTGYYFDEKKVKSVSEKVYSFEKTQKLMNYCQEKVKMFKEKQNV

SEQ ID NO: 3909 - protein, 271 aa, Anabaena variabilis ATCC 29413
MVRPRRVFAQHWLKSEKALDAIVKAAECSTNDRILEIGPGTGILTRRLLPLVEALLAVEIDRDLCKLLVKQLGQKENFLLLQGDFLTLDLVANLLTFPKFQKPNKVVANIPYNITGPIIEKLLGTIANPNPEPFDSIVLLIQKEVAERLYAKAGSRTFGALSVRVQYLADCEFICDVPAGAFHPPPKVDSAVVRLRPRQIQIPARDPKRLENLVKLGFGAKRKMLRNNLQSVVDRDRLSQLLEQLNINPQARAEDISTQQWVELANLLGVE

SEQ ID NO: 3910 - protein, 226 aa, Malus transitoria
MGTGIIYMVMMVFSLILLILSSSTVGFDYYQFTQQYQPAVCHSNPTPCKDPPDKLFTVHGLWPSDSNGNDPKYCKAPPYQTIKILEPQLAIIWPNVLNRNDHEGFWRKQWEKHGSCASSPIQNQKHYFDTVIKMYTTQKQNVSEILSKANIKPGRKNRTLVDIENAIRNVINNMTPKFKCQKNTRTSLTELVEVGLCSDSNLTQFINCPRPFPQGSRYFCPTSIQY

SEQ ID NO: 3911 - protein, 308 aa, Streptococcus thermophilus CNRZ1066
MDLTFGVTVIRKWKRDIENSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 3912 - protein, 220 aa, Bacillus cereus ATCC 10987
MNLKQLAGEYAATFVKDGMKIGLGTGSTVYWTIEKLGERVKEGLSFQAVPTSKETEVLAQQLNIPLISLNDIQSLDLTIDGADEIDSNLHLIKGGGGALLREKIVASSSKELLIIADESKLVTHLGTFPLPVEIIPFSWKQTESKIQSLGCQTTLRLKNNETFITDNNNMIIDCVFPHNITNPANLHNHLKMITGVVETGLFVNMTSKAIIGTKNGIQEL

SEQ ID NO: 3913 - protein, 967 aa, Aspergillus nidulans FGSC A4
MSPPNRKSFATNVAAFVAEHELDGVDFDWEYPGAIDIPGTPPGLETDGPNYYKFLIVMRGQLAKEKSLLIAAPASYWYLKAFPIAQMAKQLDYIVFMAYDLHGEVGSTRFSPVANIRKANGMPVTSMQQRAVRRETAYEVTATGSTLQQQKGVCTDTGGYISNAEIDEIAILGDNVQTWHDGASNSDIMVYNDTQWVADMSRTTKETRRLHWKNYNFAGTIDWAVVLQSYADDEYYDYETGEGGEELLPPLPDDPDCSGSYHDLESIEKDFGTIDELCLGQYILEVLQKNFTSSLAAYDDLMKDGYDGKFKTYAKSVVSASKKVVENFMYENGKSYFSCSSQRPSSVDCRYCEEYDCIPEGNCDNPEVHCETPEYRYRNMTQPCPPDYSLRGQCQTIDARYSQSVYWTLEYPDAFWADLYTETGVAQEDIERKNVRHFPCYLTEKHCENTYWDYNFPVPSEYDEEDVVNPKDVVSEAYNKLKALLPQLSDVVERVKNEKFFGDINELIDAVSMPVLMVSDAIEHMQSIIEIAKEIEEAKAKAILFAFMGAIIFFVPVIGEVMGAVSSLASIGRIVSLLGATGNVGLDVYTILDDPENAPLAIFSLILSPLALMDVVKVGQAARAHIILYDSLNPKIFSRIMFRSSNTFNPNTDIPDLSGKVYVVTGGSAGIGFGICAHLLQHNPAALYLLGKKEEHIQEATEGLKKYGDTSKVHSVQIELEDLKQTDQVAKELASKLDRLDGLICNAGLGSGVFNLTNDGIDSHMQVNHISQFHLSRILLPLLQKTSNSRLVLQSSDLHRAISDVKFESLEELNTDIGPTKLYNRTKLAMVLYIRALAERKGKGQLGFDPKTDTGPWMNATHPGAVSTDQQKQAEDAYGVLGKVGVAIVRPFLKDPVDQGCRPALFAATGEDIVKDAIQGQYIVPDRSPTSPSSEAQNHQLQENLWKLTEKILVDKLGSVPYETQYV

SEQ ID NO: 3914 - protein, 474 aa, Candida albicans SC5314
MSSSQFYNKGVDESVVSRQEIEEFTKRNEFFLKPSSRKYAKQYFSMYQYRLKNLRDRVHKTAMEKWGHGTKKINGNTIEKQDKILDIASGKLCWVIGTVFCDAKYKLDILNDVEKGTDDVLPLEPVTYVNEDEQPIVMLEDESGRAILNNDNFLAKNLLVTGCIVAVLGIEIQAGIFEIMDIAYPDCAPQKPLPLGENKRGKIALVSGLNIGDEGHYDLKLELLKQYLLGELGNAEDKLDGSLISQLIIAGDSIMPIQNLRAEMDLKNFVTTNNYGSKNISKYNVESFKKLDEFLTDILVSLPVAVMPGKNDPAEICLPQQPLHRSLFKNNSSLLDGNRLTRLTNPQWIDAQTVKILGTSGQNVDDIQKYIVPKKDHQFTSIEIMENNIKWQNFVPTAPDTLYCYPYENYDPFIFSDDLPHVYFVGNQQQFDSKLFEHDGVNVRLISIPKFKESGQFVLLDLDTLETEVVTIEI

SEQ ID NO: 3915 - protein, 478 aa, Thermococcus kodakarensis KOD1
MRLPGQKTKIIATLGPASLNEKTITAMVRAGMSVARINFAHGDLKQHEKSIKLVRKVSERLNRPVAILGDLPGVKIRVGEIEGGSVTLRRWQTVTLTTRDVIGNEAVIPVEFKDFPRLVSKGDVIYLSDGFIALRVEDVRDQDVICKVLVGGTLFSRKGINIPKARLAIEAITEKDLEFLEFSLEHGVDAVGISFVGSAYDVLKARRFVEERNGKLFLIAKIERPDAVRNFDEILRAADGVMVARGDLGVEMPIEKLPILQKKLIQKANCAGKPVITATQMLESMTHEKLPTRAEVTDVANAILDGTDAVMLSEETAVGKYPVETVKMMARIAKTTEAYRDSKWAERTVEWKMSELRGTRPTKGTIKDAITRSIIEALNSIDIKYILTPTRMGQTARLIARFKPKQWVLAFVTDEWVKNTLMFSYGVYPFLVEDTSEEEILRVITGLGLVDEGDTVLLTKGTPIGKTAGTNTIRIFNV

SEQ ID NO: 3916 - protein, 338 aa, Arabidopsis thaliana
MADKKIRIGINGFGRIGRLVARVVLQRDDVELVAVNDPFITTEYMTYMFKYDSVHGQWKHNELKIKDEKTLLFGEKPVTVFGIRNPEDIPWAEAGADYVVESTGVFTDKDKAAAHLKGGAKKVVISAPSKDAPMFFVGVNEHEYKSDLDIVSNASCTTNCLAPLAKVINDRFGIVEGLMTTVHSITATQKTVDGPSMKDWRGGRAASFNIIPSSTGAAKAVGKVLPALNGKLTGMSFRVPTVDVSVVDLTVRLEKAATYDEIKKAIKEESEGKLKGILGYTEDDVVSTDFVGDNRSSIFDAKAGIALSDKFVKLVSWYDNEWGYNSRVVDLIVHMSKA

SEQ ID NO: 3917 - protein, 138 aa, Arabidopsis thaliana
  misc_feature (2)..(2): Xaa can be any naturally occurring amino acid
  misc_feature (11)..(11): Xaa can be any naturally occurring amino acid
  misc_feature (17)..(17): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (52)..(53): Xaa can be any naturally occurring amino acid
  misc_feature (57)..(59): Xaa can be any naturally occurring amino acid
  misc_feature (64)..(64): Xaa can be any naturally occurring amino acid
  misc_feature (68)..(69): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (96)..(96): Xaa can be any naturally occurring amino acid
  misc_feature (100)..(100): Xaa can be any naturally occurring amino acid
  misc_feature (105)..(105): Xaa can be any naturally occurring amino acid
  misc_feature (109)..(109): Xaa can be any naturally occurring amino acid
  misc_feature (111)..(111): Xaa can be any naturally occurring amino acid
  misc_feature (117)..(119): Xaa can be any naturally occurring amino acid
  misc_feature (121)..(122): Xaa can be any naturally occurring amino acid
  misc_feature (124)..(125): Xaa can be any naturally occurring amino acid
  misc_feature (128)..(129): Xaa can be any naturally occurring amino acid
  misc_feature (131)..(131): Xaa can be any naturally occurring amino acid
  misc_feature (133)..(136): Xaa can be any naturally occurring amino acid
  unsure (1)..(138): unsure at all Xaa locations
MXSSMLSSAAXGTSPAXATMVAPFTXLKSSAXFPXTRKNNKDITSIASNGGXXNCMXXXPPIGXKKFXXLSYLPDLRDXKLGKEXDYXLRXKGIPXGEFXLKNGXFVYXEXGKTPGXXXGXXWXXGKXXLXGXXXXLK

SEQ ID NO: 3918 - protein, 162 aa, Oryza sativa
MTEAGGERRIGVAMDFSPSSKKALQWAADNLLRKGDTLVLLHIRHHGRDEAKNVLWSHTGSPLIPLEELMETAVRQRYDIPSDEEVFDMLNAVSREKELSVVLKMYWGEPREKVCEAVGELNLESLVMGSRGLGQIQRILLGSVTNYVLSNASCPVTVVKAK

SEQ ID NO: 3919 - protein, 477 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGAATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 3920 - protein, 302 aa, Oceanobacter sp. RED65
MAIQWFPGHMHRARKQILETIANIDLVIEVLDARLPYSSENPIIPDLLKDRPCLKLLNKTDLADPELTQVWLDYFNSRENTRAIALTGLDKKQVKRITQYCHEMLPERRESKKSIRTMIVGIPNVGKSTLINTLAGRTVAKAGNLPALTRHPQQIKINDGIVLSDTPGILWPKIHNVKSGFRLAASGAVRDTALDYFEVAEFAGQMLIDLYPERLVERYKLKALPESGEEVIDAIGRKRGCLRSGGVVDMHKAAEILIHELRNGKMGKLTYETPDIMEAEEAALAEERARKEAEAEEKKAKK

SEQ ID NO: 3921 - protein, 300 aa, Prochlorococcus marinus str. MIT 9313
MSWKVADIPDQKGRVALVTGANSGLGLETAKALLNKGARVIMACRSLPTGEDVRQVILERNDSTKLDLIELDLADLASVRRAAEQVESQYSRVDLLINNAGVMATPKTLSKQGLELQFAVNHLGHMALTLKLLPLLAKQHGARVVTVTSGAQYMGRIAWDDLQGIKQYDRWAAYSQSKLANVMFALELDKRMRQTASGIASLLAHPGLARTNLQPKSVAANKSWQEGLAYRLMDPMFQSAAMGSLPQLHAATAPTAQGGEQYGPRFNFRGYPKLCSVAPLALREEDRQRLWSISEKLLEI

SEQ ID NO: 3922 - protein, 795 aa, Pyrococcus abyssi GE5
MAEKKEVKLKVASAYQRDVGRGIVRLDRKTMRELGISPGDVVEIIGTKNTAAIAWPAYPEDEGLGIIRMDGTIRKNAGVGLGDEVTVRKAEVREAKKVTLAPTEPIRFGRDFVEWLHERLVGRPVVRGDYIKVGVLGQELTFVVTATQPSGVVQITEFTDFNISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPAIIFIDEIDAIAPKRSEVTGEVEKRVVAQLLALMDGLKSRGKVIVIGATNRPDAIDPALRRPGRFDREIEVGVPDRQGRKEILQIHTRGMPIEPDFRKDDVLKILEDFKREGKFTKIIDKAIEEVNKSKEEEIPQVLKKIDAELYDEVKTRLIDKLLDELADVTHGFVGADLAALAREAAMAALRRLIREGKIDFEAETIPREVLDELKVTRRDFYEALKMVEPSALREVLIEVPNVHWDDIGGLEDVKQELREAVEWPLKYPEAFKAYGITPPKGILLYGPPGTGKTLLAKAVATESQANFIAVRGPEILSKWVGESEKNIREIFRKARQAAPTVIFIDEIDAIAPRRGTDVNRVTDRIINQLLTEMDGIQENAGVVVIAATNRPDILDPALLRPGRFDRLILVPAPDEKARFEIFKVHTRGMPLADDVDLKELARRTEGYTGADIAAVCREAAMIAMRRALEKGIIKPGMKASEIRRLAKVTMKDFEEALRKIGPSVSKETMEYYRKIQEQFKQARG

SEQ ID NO: 3923 - protein, 375 aa, Exophiala dermatitidis
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYSFSTTAEREIVRDIKEKLCYVALDFEQEIQTASQSSRLEQSYELPDGQVITIGNERFRAPEALFQPSVLGLESGGIHVTTFNSIMKCDVDVRKDLYGNIVMSGGTTMYPGIADRMQKEITALAPSSMKVRIIAPPERKYSVWIGGSILASLSTFQQMWISKQEYDESGPSIVHRKCF

SEQ ID NO: 3924 - protein, 223 aa, Solanum chacoense
MFKSQLTSVFFMLLFALSPIYGDFELLELVSTWPATFCYAYGCSRRRPIPNNFTIHGLWPDNKSIILNNCNVANKERYIKIEDPKKLTELDKRWPQLRYDKLYGIDKQYLWEKEFLKHGTCSINRYKQAAYFDLAMNIKDRFDLLGTLRNHGINPGSTYDLDDIERAIKTVSIKVPSLKCIEKPPGNVELNEIGICLDPEAKYTVPCPRTGSCHELGPRIKFR

SEQ ID NO: 3925 - protein, 253 aa, Propionibacterium acnes
MSAYGHGRHEHGQNFLTNHKIINSIIDLVKQTSGPIIEIGPGSGALTHPMAHLGRAITAVEVDAKLAAKITQETSSAAVEVVHDDFLNFRLPATPCVIVGNIPFHLTTAILRKLLHAPAWTDAVLLMQWEVARRRAGVGASTMMTAQWSPWFTFHLGSRVPRSAFRPQPNVDGGILVIRRVGDPKIPIEQRKAFQAMVHTVFTARGRGIGEILRRQGCFHHVQKHNHGCAREESTPRPYLPDCTPTTGSISSR

SEQ ID NO: 3926 - protein, 429 aa, Pseudomonas syringae pv. phaseolicola 1448A
MPRAEPGTPCQFSSGHRFTQMSKTSLDKSKIKFLLLEGVHQSAVDVLKAAGYTSIEYHTKSLPEAELKEKIADAHFIGIRSRTQLTEELFDCAKKLVAVGCFCIGTNQVDLNAARERGIAVFNAPYSNTRSVAELVLAEAILLLRGIPEKNASCHRGGWIKSAANSFEIRGKKLGIIGYGSIGTQLSVLAEGLGMQVYFYDTLTKLPLGNATQVSSLNELLGMSDIVTLHVPETSETQWMIGEKEIRAMKKGSILINAARGTVVELDALADAIKDKHLIGAAIDVFPVEPRSNDDIFESPLRGLDNVILTPHIGGSTAEAQANIGLEVAEKLVKYSDNGTSVSSVNFPEVALPAHPGKHRLLHIHENIPGVLSEINKVFAENGINISGQFLQTNEKVGYVVIDVDAEYSDLAQAKLQQIKGTIRSRVLF

SEQ ID NO: 3927 - protein, 962 aa, Shewanella sp. MR-7
MTKQTLTQLEQHDLFLRRHIGPDSSQQQEMLNYVGAESLDDLTAQIVPESIRLNQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVVVTVAADIMSLVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTLRTDIEALFDVILGAGHGLDVAALDAQIVAQGSQSIPEALVRQDAILSHPTFNRYQSETEMMRYIKRLESKDLALNYSMISLGSCTMKLNAAVEMLPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDPAFDSRPYSREVAVFPSAAVRTNKFWPTVNRIDDVYGDRNLFCACVPLSDYE

SEQ ID NO: 3928 - protein, 388 aa, Mycobacterium sp. MCS
MRALCWNGVNKLSVETVDDPEILNPHDVILKVTLTTTCGSDLHFIDGYLPGMREGDIFGHEFMGEIVETGREVRDVKVGDRVVVPSFIGCDRCWYCEHDLYSCCDTTNPNAELQQPLLGYPSGGIYGYTHPFGGYAGSHAQFVRVPFGDTNCFPIPGDITDEQALFLSDAVPTGFMGADFCDVNGGDTVAVWGAGGVGLMAAKSALLLGAERAIVIDRIPERLSLAGEFGLETIDYGAADSVQESLREMTGGRGPDACIDAVGMEGHSTGLQQVYDRAKQLLRLETDRASALRQAILACRKGGVVSVLGVYGLTDKFPMGVVTNKGLTLRSAQQHGQRYMARLFDYVEQGDLDPAKLITHDLPLEQGVRAYDMFKNKQDNCIRVALRP

SEQ ID NO: 3929 - protein, 653 aa, Paenibacillus sp. A11
MFLEAVYHRPRKNWSYAYNGTTVHLRIRTKKDDMTAVYALAGDKYMWDHTMEYVPMTKLATDELFDYWECEVTPPYRRVKYGFLLQQGHEKRWMTEYDFLTEPPANPDRLFEYPFINPVDVFQPPAWVKDAIFYQIFPERFANGDTRNDPEGTLPWGSADPTPSCFFGGDLQGVIDHLDHLSKLGVNAVYFTPLFKATTNHKYDTEDYFQIDPQFGDKDTLKKLVDLCHERGIRVLLDAVFNHSGRTFPPFVDVLKNGEKSKYKDWFHIRSLPLEVVDGIPTYDTFAFEPLMPKLNTEHPEVKEYLLKAAEYWIRETGIDGWRLDVANEVSHQFWREFRRVVKQANPDAYILGDVWHESSIWLEGDQFDAVMNYPFTNAVLDFFIHQIADAEKFSFMLGKQLAGYPRQASEVMFNLLDSHDTARLLTQADGDKRKMKLAVLFQFTYFGTPCIYYGDEVGLDGGHDPGCRKCMEWDETKHDKDLFAFYQTVIRLRQAHAALRTGTFKFLTAEKNSRQIAYLREDDQDTILVVMNNDKAGHTLTLPVRHAQWTHLWNDDVLTAAHGQLTVKLPAYGFAVLKASSDWSSWGRPPFTGEHASPSKRGASFCRSPSFPLTSSHWLDPVSTLSCSWVQLFSKLVNYKFSEQLSCMSLKS

SEQ ID NO: 3930 - protein, 241 aa, Frankia sp. EAN1pec
MQPLVLERAGRKHLSGHRSMQFGRETTAAEVLQGVDLEGRRAIVTGASSGIGVETARALADAGAEVTLAVRNTEAGGRVADDIIAGTGNKAIFVSKLDLADRASVTGLVEAWNGPLHILVNNGGVMALPQLQRTPEGWEQHFATSHLGHFALALGLRDALAAAGSSRVVSVSSDGHVHANAPVDFDDIRFERRDYSGHRAYAQSKTANILFAVEGAKRWAKDGIAVNALHPAGSRPASSGT

SEQ ID NO: 3931 - protein, 826 aa, Rhodospirillum rubrum ATCC 11170
MDTVIRTDFELDEGIDFTDVEQIKHGLVTSMVRGVGFDPASATEHDWFLALASLLRGHLSEKGMMTSRAQYGSDTKRVYYLSLEFLTGRRLVKHLLDLGIESAVRAALRELGQDLDRVAEQESDAALGNGGLGRLAACFLDSMATHGYPGYGYGIRYEFGMFSQTIENGQQVEHPESWLRNGNPWEIVRHNVSYPVRFGGHIVCFRDEGGEERCRWVDANEVIAEAYDLKETGYGGAYGCNLRLWSARATQDFDLSYFNEGNYIEAVKDKTTSENLSKVLYPMDTTLMGQELRLKQEYFFVSASLQDILARFFKVHKDPKQIPAKIVIQLNDTHPALAVPEMMRLLMDNHALSWDAAWDITRDTFAYTNHTLLPEALETWPVAMLEAILPRHLEIIYKINYGFLQQVRRAFPGDVAMLRRMSLIDEDTHRVRMAHLAVVGSRRVNGVAALHTKLLRERVFPDFDAFFPEKFVNVTNGITQRRWLLQSNPPLAALVSETIGEGWLTDLDRLRDLEKLADDPAFQDRFLTIKAGAKARAAALIAERCGVVVSTASLFDIQIKRIHEYKRQLLNIMQVIARYNAIRRDPKAVMTPRTVIFGGKAAPGYYVAKKIIRLINDVAETINHDPAVRDLLKVVFVPNYNVSTAEILIPSCDLSEQISTAGTEASGTGNMKFALNGALTIGTLDGANIEIREEVGDDNIFIFGHTAQEVSQIKAQGYDPWSWYAADDEMRTVIDMIRDGFFSTEEPDRYRPIADALLGSDTYLVLADFRSYMDAQKAVDGLYTNQRVWARQAILNIARVGKFSSDRAIHTYAKDIWGVRPMDALS

SEQ ID NO: 3932 - protein, 80 aa, Arabidopsis thaliana
  misc_feature (60)..(60): Xaa can be any naturally occurring amino acid
  unsure (1)..(80): unsure at all Xaa locations
MASSMLSSATMVASPAQAIMVTPFTGIKSTAAFPSTGNAKKYTTSHQKRTVSRVHCKHVXPPIVKKKFETLSYRPDLTDS

SEQ ID NO: 3933 - protein, 125 aa, Triticum aestivum
  misc_feature (65)..(65): Xaa can be any naturally occurring amino acid
  misc_feature (92)..(92): Xaa can be any naturally occurring amino acid
  unsure (1)..(125): unsure at all Xaa locations
PGALQYLSGVILFEETLYQSTKGGKPFVDILKAGNVLPGIKVDKGTIELAGTNGETTTQGFDDLXGKRCAKYYEAGCRSAKWRASSKIRRTXHPQSPSDQNVKGLVPIHICQENGLGAIVGPESC

SEQ ID NO: 3934 - protein, 143 aa, Arabidopsis thaliana
  misc_feature (80)..(80): Xaa can be any naturally occurring amino acid
  misc_feature (96)..(98): Xaa can be any naturally occurring amino acid
  misc_feature (106)..(106): Xaa can be any naturally occurring amino acid
  misc_feature (112)..(112): Xaa can be any naturally occurring amino acid
  misc_feature (118)..(118): Xaa can be any naturally occurring amino acid
  misc_feature (124)..(126): Xaa can be any naturally occurring amino acid
  misc_feature (133)..(133): Xaa can be any naturally occurring amino acid
  misc_feature (136)..(138): Xaa can be any naturally occurring amino acid
  unsure (1)..(143): unsure at all Xaa locations
MASSMLSSAAVVTSPAQATMVAPFTGLKSSASFPVTRKANNDITSITSNGGRVSCMKVWPPIGKKKFETLSYLPDLTDVXLAKEVDYLLRNKWIPXXXFELEHGFXYREHGXNTPGYXDGRYSXXXESFPLFXCTXXXLKYLK

SEQ ID NO: 3935 - protein, 486 aa, Silicibacter pomeroyi DSS-3
MTTLALNDPGLLETRAYVNGVWIEGGARFAVQDPATGDLIAEVADLGAADTAAAIDAAHAAGPGWAALTGKERGAILRRWHDLMIQNADDLATILTAEMGKPWAEARGEILYGASFLEWFAEEAKRVYGETIPGHQRDKRIVVLKQPVGVVGSITPWNFPNAMIARKVAPALAVGCTFVARPAELTPLSALAMAVLAERAGVPAGVFNVIPSQDAAGVGAELCANPKVAKITFTGSTRVGRLLMQQCAPTIKKMSLELGGNAPFIVFDDADLDAAVDGAMIAKFRNNGQTCVCANRIYVQARVYDAFADKLAAKAAQLRVGNGFDTGVTTGPLINSAAVSKVEAHIADALAGGAEVVLGGTRAPLGGTFFAPTVLRDVTRDMLVCREETFGPLAALVRFESEDEVIDMANDSEFGLAAYFYSRDLARVWRMAEALESGMVGVNTGLISTEVAPFGGIKQSGLGREGSRHGIEDYLELKYLCLGGIG

SEQ ID NO: 3936 - protein, 481 aa, Helicobacter pylori
MIVRTQNSESKIKEFFEFCKENEVEFVDFRFSDIKGTWNHIAYSFGALTHGMFKEGIPFDASCFKGWQGIEHSDMILTPDLVRYFIDPFSADVSVVVFCDVYDVYKNQPYEKCPRSIAKKALQHLKDSGLGDVAYFGAESEFFIFDSIKIKDASNSQYYEVDSEEGEWNRDRSFENGVNFGHRPGKQGGYMPVPPTDTMMDIRTEIVKVLNQVGLETFVAHHEVAQAQGEVGVKFGDLVEAADNVQKLKYVVKMVAHLNGKTATFMPKPLYGDNGSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIIEQGIIQMPHTLRRSLEEMLADKQYLKQGQVFSEQFIHAYQSLKFHSEVFPWESKPHPFEFITTYSC

SEQ ID NO: 3937 - protein, 400 aa, Roseovarius nubinhibens ISM
MSILSDTLARVKPSPTVAVTTLANELKAAGKDVIGLGAGEPDFDTPEHIRAAGKRAIDEGKTRYTAPDGIAELKQAICDKFKRDNGLDYTPKQVSVGTGGKQILYNALMATLNPGDEVVIPAPYWVSYPDMVLLAGGTPVVAEASLESRFKLTPDQLEAAITPKTKWFIFNSPSNPTGAGYSRDELKALTDVLLRHPHVWVMTDDMYEHLAYDGFEFCTPAEVEPALYDRTLTCNGVSKAYCMTGWRIGYAAGPEPLISAMRKIQSQSTSNPCTISQWAAVEALNGSHEFIAANNEVFKRRRNMVVERLNAIEGITCPTPEGAFYVYPSIAGLIGKVTPGGTKIADDETFAKALLEDKGVAVVFGAAFGLSPNFRVSYATSDAALAEACDRIEAFCKGLS

SEQ ID NO: 3938 - protein, 165 aa, Vicia faba
MVEDRKVGVGIDFSKNSKNALKWAIVNMADKGDTFYLIHINSNSSDESRSKLFAKTGSPLIPLEELKEAGVMKQYGVQTDVEVIDLLEIAATQKEVSVVAKLYWGDARQKLMDSIEDLKLDALVLGSRGLSTIKRILLGSVSNFVMVHSPCPVTIVKDYSSSSSD

SEQ ID NO: 3939 - protein, 164 aa, Vicia faba
MVEDRKVGVGIDFSKNSKNALKWAIVNMADKGDTFYLIHINSNSSDESRSKLFAKTGSPLIPLELKEAGVMKQYGVQTDVEVIDLLEIAATQKEVSVVAKLYWGDARQKLMDSIEDLKLDALVLGSRGLSTIKRILLGSVSNFVMVHSPCPVTIVKDYSSSSSD

SEQ ID NO: 3940 - protein, 1002 aa, Zea mays
MAMAPSTAAASTLLPVLLLIATATQCTAADSFSSPNAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFASLKNLTLLNLFRNRLAGEIPEFIGDLPNLEVLQLWENNFTGGIPTNLGVAATRLRIVDVSTNKLTGVLRSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKQQQQQEGPHDSPPQQDLLSI

SEQ ID NO: 3941 - protein, 396 aa, Mesorhizobium loti
MLAHRTNLFGTSGTAAARAAAKAAADAGKEIIDLTAGEIWSELAPTIRDGAIDAINKGVNRYTDSVGMVELREALARKISLDTGQIWKAEEVAVTSGAKQALFNAAMVLLNPGDEVIIPAPYWTTFPAQVLIAGGTPVFVDTKSNGYVPRPEHIKEAVTERTRAIVVNTPSNPAGAVYDVETLMAIAELAVSRNLWIIFDECYGDFVHGGHTHHPIVSVAPEIRARALIVNSFSKSLALTGWRIGYLAGPKGVINAVKALQSHTTSNPNVIAQHAVLAHLQRGGSDYEGKLRSRLTSARRVGLDVLSSLTRVPVARAQGGFYFYLDLSHLLRPGAEDGASTTADDIVTGLLAEAGVAAVSGTAFGDPAGLRLSYGIPPEKLATGLARLVEFLNAWK

SEQ ID NO: 3942 - protein, 124 aa, Physalis crassifolia
KNNALLMDCRPPPNYTNFPRNKMFADLDKHWTQLKIKENNTETDQSTWSYQYIKHGACCQNLYDQNMYFSLALHLKDRVNLLTNLIKQKISPGGQYTLDEIAKAVKAVLNSVPNIKCIKVKGPQ

SEQ ID NO: 3943 - protein, 142 aa, Yersinia pestis biovar Medievalis str. 91001
MALERTFSIIKPNAVANNDIGAIYARFERAGFKIIAAKMLHLTKEQAEGFYAEHKGRPFFDGLVEFMTSGPIMVQVLEGENAVQRHRDIMGATNPDNALAGTLRADFSDSFTANAVHGSDAVESAQREIAYFFAADEIFPRS

SEQ ID NO: 3944 - protein, 186 aa, Glycine max
  misc_feature (184)..(184): Xaa can be any naturally occurring amino acid
  unsure (1)..(186): unsure at all Xaa locations
TLARAAAAAVMDGGGGVGGGMGPVGGGVGGMVGPVGVGGGGGGSDVELVSKTLQFEHKLFYFDLKENPRGRYLKISEKTSTTRSTIIVPHRRRRLVPRPLRLLHPHRRARRLQQGATPRYQGVLLRYWGEQERRYLKVSEASVNRNRSTIIVPAGSSGEEGWEAFRNVLLEINDEASRLYVLPXHQ

SEQ ID NO: 3945 - protein, 308 aa, Neurospora crassa
MADHTEVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTECFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKFGRR

SEQ ID NO: 3946 - protein, 837 aa, Shewanella sp. MR-7
MSHNSELSPNTSGVPPKKRATKAAPSKPKATLEPCEPCDALPATFNRHVRYGLSRGEVAHGELFQSLALSVKEQMLDEWRETRIKDSCYDNKQVAYLSLEFLMGRALGNALLNLDLEQDSREALSQYSVSLEELEEAEHDAGLGNGGLGRLAACFLDSCASMDLSVTGYGIRYEYGMFAQKIVDGYQVERPDRWLREGNPWEVRVPHHNVMVKFFGHTESYVDKQGRRHMIWVDTQDVLAVAYDMPVPGYRNGRVNSLRLWKAEATDDFDLAEFNQGDYTEAVACKNLAEQITMVLYPNDASENGKELRLRQQYFLSSASLQAILKRWVHHHGHDFSDFAAKNVIQLNDTHPSIAVPELMRLLVDEYGLEWDAAWAITSQTMAYTNHTLLPEALERWPVRMMALMLPRILEIIYEINARYLDLVAHHWPGDGAKLACMSIIQDGPDPHVRMAYLAIVASFSVNGVAALHTQLLKSGLFKDFYSLWPEKFNNRTNGVTPRRWLAHCNPALAKLLTSHLGKGWVTDLSQLTALNALTQDASFIQKWREVKQANKVQLAKMIAKECGVEFDPAMLFDVQVKRIHEYKRQLLNILHVIHLYHQIQQGHTEHLVPRCVLIGGKAAPGYFMAKLIIKLASNVAHMVNCDPVVAPYLRFAFLPNYNVSAMEKICPGTDVSEQISTAGKEASGTGNMKFMMNGALTIGTLDGANIEMLEEVGEDNFFLFGLNAEQVTQMRCDYQPQRIIAESHALSEVMALLKSGHFNLLEPGIFDPIIASIESADDQWMTAADFDSYRLAQEAVAKAYKDPKKWTQMSIRNTAASGRFSSDVTIAGYRDDIWKL

SEQ ID NO: 3947 - protein, 1859 aa, Ustilago maydis 521
MDSLFGRKKRSRQFHSSEAADKAIPYERTATGRTPVPVDSVLASSSYHNNASPTSSKLSIGNPSGNPSLGHGIQRSSAYSDVQYDVPRSRLVSNAHEFAPYPSTSSIISHTNGSTVSSSSGLSSHRRNPSATSMSRHGVSTHDSMHSTSSSLSPNGATCSSRYTSNTSSGLANGGVHMPHDIVSRMSVASGGYSHADTPSASNSHSSLARESYQPGGKAPDFVLQRPPDDQVERLFAELMDKRDFLNVPGGNLSDELKETARRNMLNFSVDKKWTLVYNDKLTEWHAEKERDRNRRQHAGLSGAQAGGGSGLVITRNSPEWFIKKFMDGTVTTKHIESLAVTLRTCAIGWIQSFVEAKGTPVLASFLSGLHAKGIKNDNDLSLEYEVLKAFRSLFNSKPGANDALAQPKCISGITHSMISLQLTTRKQAADILLFLCHWDKPTGHRLVLKAFDDLKTSQGDHGRFDAWFRVLEQTIDGRGKMGSMVGASDEVKKLSVVGPHESSLNEYAINNMFLINAILNSDIVPEFEVRVHLRNQMEASGLQRILIKMHAFKNPDLDAQIGVFEKGAEADHEDVVETFNKEVLTDLSDPVDVFRAIVGKVEGSRAYDFFLSALQHLLLIRRDGDDLVHYYQLIDSMVTSVVMDRKGAVEGNDLSSLLGVSVNNVLSRFADQDHINSMQSELQKAKAKAASLEQEKLQLESKLKAGSDGLIGKLQEQIEKLEDDLALARGNAGAARDEMDEMEKAYIDRVVALEIQIRELYDMLREAQMDVSDVAAPGKGSLDRKQLVDTLEKQLERNKTIRKLEANARKNKAGAKGGDVPPVPAMPGVPTDDDRKRISASVRRQPTLARQAANDGQEGEDGADDEEEQDEGHDEEPLDPEAAKWKIQATLAAGMAQNTDLASRMVDARESRRRKAQAPTPGGKTKRTSHPAVRTLLDEIRRQRDDDSDSDDELIAGRGKKKPDPEVLSVAEAVAAPEAATQGLATPPPPPPPPPPPPPPPPMLPPAAGGMSTSQKALLDAAAMPPPPPPPPPPPPPAPGMMPSFSQMSSHSFSTEMRSAFSTPDSSRPGSMIPSITSTPAPPAPPPPGSVTESPMQDSGPYRNSMMNVRASYAPMNLGPAGPIAAPPAPGVAGLFANHALSRKEVLAMASSKMKQLQWDKLSPQHAAETIFGKHELTADEEALVKTLQQEGLFEEMEEDFKAKQPRQKDKIELKTHLSLQTRQGIEMVLKRVKSSLTESKQASPEEVAHHIINCNEAVLDQSFLTELLRHYPESETKGQLGEYRNASDEELRLLHPADRLVVLLMTVPHLKEKVKGLLYMTKYKETFDLIKSGMVKVRDASEGLMKAKAFARLLSLILMMGNYLNSTGVQGGAFGFKITSINKLVDTKASDGTTLLHFVERTISKCFPEVEAFMDELELPAEACRVQLWDLRRDLAELKSGSFQHRKELDRLLDESEENLQDPYVKIMLPFLNDAASELQRLNDQVQFTERVYNEALKYFGEGLDPKKRGLGQLANQTMRTEDFFGIFKEFLAAYKKVKVDNVRIGEQRAMEAKRRAAAEEREKERQEALARKEAGVDDSAVLETLLGSLRSGGGGPNKQRRKARERRQTNAAAAAAAAATAASAGADGSNDSIHGSGSVLAGAQGSPSDVAAAMLAKLQGGEEGASGEQHASASSSAFRTTRRRDRRSGRDAPHPTNSTLAKETSGEVTSPSMTIDSSPALSQQTSSTTHTPSASISVSSPGMRGLNDTTVGDVTLVPSYSSTSNQVDAAGGSLLGPSEQGGHETSTDHASRTAENEAEQDEDAAQDDKRVFQDALAAPRKPDVGGAASSDLEWFDPDLSGFSAAAQSVKSDNGGG

SEQ ID NO: 3948 - protein, 830 aa, Arabidopsis thaliana
MDLKENSFEHMGIHLGEIGIVLFPWFLWLSLFLSCGYAAITISSPLTLGQTLSSPGGFYELGFFSPNNSQNQYVGIWFKKITPRVVVWVANREKPITTPVANLTISRNGSLILLDSSKNVVWSTRRPSISNKCHAKLLDTGNLVIVDDVSENLLWQSFENPGDTMLPYSSLMYNLATGEKRVLSSWKSHTDPSPGDFVVRLTPQVPAQIVTMRGSSVYKRSGPWAKTGFTGVPLMDESYTSPFSLSQDVGNGTGLFSYLQRSSELTRVIITSEGYLKTFRYNGTGWVLDFITPANLCDLYGACGPFGLCVTSNPTKCKCMKGFVPKYKEEWKRGNMTSGCMRRTELSCQANLSTKTQGKGVDVFYRLANVKPPDLYEYASFVDADQCHQGCLSNCSCSAFAYITGIGCLLWNHELIDTIRYSVGGEFLSIRLASSELAGSRRTKIIVGSISLSIFVILAFGSYKYWRYRAKQNVGPTWAFFNNSQDSWKNGLEPQEISGLTFFEMNTIRAATNNFNVSNKLGQGGFGPVYKGTLSDKKDIAVKRLSSSSGQGTEEFMNEIKLISKLQHRNLVRLLGCCIDGEEKLLIYEFLVNKSLDTFLFDLALKLQIDWPKRFNIIQGVSRGLLYLHRDSCMRVIHRDLKVSNILLDDKMNPKISDFGLARMFQGTQHQDNTRKVVGTLGYMSPEYAWTGMFSEKSDIYAFGVLLLEIISGKKISSFCCGEEGKTLLGHAWECWLETGGVDLLDEDISSSCSPVEVEVARCVQIGLLCIQQQAVDRPNIAQVVTMMTSATDLPRPKQPLFALQIQDQESVVSVSKSVNHVTQTEIYGR

SEQ ID NO: 3949 - protein, 259 aa, Streptococcus pyogenes M1 GAS
  misc_feature (4)..(4): Xaa can be any naturally occurring amino acid
  misc_feature (14)..(14): Xaa can be any naturally occurring amino acid
  misc_feature (52)..(52): Xaa can be any naturally occurring amino acid
  misc_feature (89)..(89): Xaa can be any naturally occurring amino acid
  misc_feature (112)..(112): Xaa can be any naturally occurring amino acid
  misc_feature (115)..(115): Xaa can be any naturally occurring amino acid
  misc_feature (234)..(234): Xaa can be any naturally occurring amino acid
  unsure (1)..(259): unsure at all Xaa locations
SNAXKIGIIGVGKXASAIIKGLKQTPHELIISGSSLERSKEIAEQLALPYAXSHQDLIDQVDLVILGIKPQLFETVLKPLHFKQPIISXAAGISLQRLATFVGQDLPLLRIXPNXNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLXELERLGLTATVSSAIDKTIDKAKSL

SEQ ID NO: 3950 - protein, 436 aa, Photorhabdus temperata
MHLQNTWREEYIKCQTLYARHPLFTKIKVRLSMLAVKKSSKLDNVCYDIRGPVLKEAKRLEEEGNKVLKLNIGNPAPFGFEAPDEILVDVIRNLPTAQGYSDSKGLYSARKAIMQHYQARNMLDVSVEDIYIGNGVSELIVQAMQALLNTGDEMLVPAPDYPLWTAAVSLSSGKAVHYMCDEGSDWFPDLDDIRNKITPRTRGIVIINPNNPTGAVYSKALLLEIVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHFRIVTLPRLDELEMAIQKFARFIGKYHQ

SEQ ID NO: 3951 - protein, 987 aa, Streptomyces avermitilis MA-4680
MTEGEAVGVPAQGCPSKVASDQEASAMTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 3952 - protein, 498 aa, Cryptococcus neoformans var. neoformans B-3501A
MGQGQSSKKLGRISSKQLPPPDLADSFARTSIADRDPNPPPPDAAKRRSSARDPLPPAHASPPSHAPAHSSGPARQNTPPSPAAVPTTQNIIAAPSQPSKSFLASSPPPPSAMPVSPAGTTRARSSSPPPSSSPAAASHLSRDSASSLSPGFALTQTVSRGSLGAGGAGFQILDVDNMIQRLLEAGYSGKVTKSPPLKNAEITSVCAAAREVFLSQPTLIELSPPVKIVGDVHGQYADLLRMFEMCGFPPAANYLFLGDYVDRGKQSLETILLLLCYKIKYPENFFLLRGNHECANVTRVYGFYDECKRRTNIKIWKTFIDVFNTLPIASIVASKIFCVHGGLSPSLKSMDDIRRIQRPTDVPDYGLLNDLVWSDPSDTALDWEDNERGVSFCYGKSVINAFLATHDMDLICRAHMVVEDGYEFYNDRTLVTVFSAPNYCGEFDNFGAVMSVSEDLLCSFELLKPLDGAALKKEMTKSKRKSLQAHQSPPNNPMAQSF

SEQ ID NO: 3953 - protein, 164 aa, Vicia faba
VEDRKVGVGIDFSKNSKNALKWAIVNMADKGDTFYLIHINSNSSDESRNKLFAKTGSPLIPLEELKEAGVMKQYGVQTDVEVIDLLEIAATQKEVSVVAKLYWGDARQKLMDSIEDLKLDALVLGSRGLSTIKRILLGSVSNFVMVHSPCPVTIVKDYSSSSSD

SEQ ID NO: 3954 - protein, 250 aa, Candida glabrata CBS 138
MSPSREDSVYLAKLAEQAERYEEMVESMKEVASSGQELSVEERNLLSVAYKNVIGARRASWRIISSIEQKEESKEKAEHQVELIRTYRGKIETELTKISDDILSVLDSHLIPSATSGESKVFYYKMKGDYHRYLAEFSSGDVRDKATEASLEAYKTASEIATTELPPTHPIRLGLALNFSVFYYEIQNSPDKACHLAKQAFDDAIAELDTLSEESYKDSTLIMQLLRDNLTLWTSDMSEAQDEQNDEPPK

SEQ ID NO: 3955 - protein, 419 aa, Thermococcus kodakarensis KOD1
MSDGHDGYKIIHDGIHGSMKVSGVILDLVKTPEFQRLRQIKQLGLAYLVYPGANHSRFEHSLGAWHLAKRLSEEVGLPKEESELLQVGALLHDIGHGPLSHTFEGIYKHYVKERDHMRLGQDIILGNINITGDEDGGRIPEILEKHGIDPKAVADIILGRSEKPYLGQMLHGGVDVDQLDYLVRDAHYTGVAHGIIDLERLLKVMKIHDGQLVVDEKGIEAVEGMMVARALMYSRVYFHHTVKIAEGMLTRALEFALDEGHLWDFWRMTDCRVLVELEDLEGLPAELTKRVLHRKLYKAAVLITAEELSTEEKRELLNAYRNVKKRQEIERNLADAVGASEGEVILEFSIADLMLSEPRLKETGINVLLDNGEIQPLTKVTPLANALKRRQTPRWAVMIASPEKYVDRLREVWRRVIFS

SEQ ID NO: 3956 - protein, 267 aa, Bacillus halodurans C-125
MKQHHMLIIGAGRMAEAIFSGILKREENPFQITVSNDKDVARLEKLKKTYPVKTTTDWTAVVETADVILLACPPAAHENVLKKLSPICNGQLVITVAAGIGPTDLETHLPKGTPTAWIMPNTAASVGESMSIYCFGQHVKERDKQLISFILDAIGMSEQLTESQIHHLTAITGSAPAFLYFLAEALEQSAQSYGVAPEKARELVIGMITGSAKMLEEYKDPTQLREQVTTPGGATAAGLQSLLHDDFQGALQRAVQATNGRAQERAN

SEQ ID NO: 3957 - protein, 412 aa, Pyrococcus furiosus DSM 3638
MSDGKIIHDPVHGSMKIPEELIKLVDTPEIQRLRYIRQLGLANLVYPGANHSRFEHSLGVWYLAKKLSSELDIPRDEALLVQISALLHDIGHGPFSHTFERVYKERLKIGDHMEISRKIIEGKIDIVENGGEIPDIISDLGYSPKEVGELICGVHKKKYLSMIINGDIDVDQLDYLARDAHYTGVAHGIIDLERLLNVMKIHDNELVVDEKGLEAVEGMLVARSLMYSRVYFHRTVKIAEAMLIKGVEFALDSGELFDFWKMTDDRLIVELEDIGGFPSEIIQKIRRRELYKPAVIVGPQDLTGDERRIIASLYKNTKKIRELENELADRVGASEGEVIIELSVPELIISEPRLKQIEISILLGDGKKEPLTKVTPLASAIKRRQTPRWILIIATPPNYVEKVKSVWRKVIF

SEQ ID NO: 3958 - protein, 433 aa, Oryza sativa (japonica cultivar-group)
MEDYGFEYSDDEPEEQDVDIENQYYNSKGMVETDPEGALAGFDQVVRMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYTKALSIKSAIPHPRIMGIIRECGGKMHMAERQWADAATDFFEAFKNYDEAGNPRRIQCLKYLVLANMLMESEVNPFDGQEAKPYKNDPEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGDRSKGMRKYQAIDKWNTQLKNIYQTVSNRVG

SEQ ID NO: 3959 - protein, 533 aa, Mesorhizobium ciceri
MAPRVLVSDKLSPTAVQIFKDRGVEVDYLPDLGKDKDKLAEVIGQYDGLAIRSATKVTEKLINAATNLKVIGRAGIGVDNVDIPAASRKGIIVMNTPFGNSITTAEHAVAMIFALARQIPEANASTHAGKWEKNRFMGVEITGKTLGVIGCGNIGSIVATRGVGLKMHVIAFDPFLSDSRAEELGVDKVELDELFARADFITLHTPLTDKTRNIIDAAAIAKMKKGVRIINCARGGLIVEADLVAALKSGKVAGAGVDVFEVEPAENNELFGMENVVATPHLGASTTEAQENVALQVAEQMADYLIKGAVSNAINMPSITAEEAPRLKPFVKLAEVLGAFVGQVTEDPIKEVEILFDGSTATMNTRALISAALAGLIRPQVSDVNMVSAPIMVKERGIIVAEVKRDKSGVFDGYIKLTVKTEHMTRSIAGTCFSDGKPRFIQIKGINLDAEVGQHMLYTTNADAPGIIGLLGTVCGENGVNIANFQLGRNRPGGDAIALLYLDAPFPEAVLEKVKAHKSIDSAKRLQFDVNAM

SEQ ID NO: 3960 - protein, 467 aa, Gibberella zeae PH-1
MSSLINPTMRSCTSFLSRMPVSSYRPAIRSLGSSVRPLIIRGVAQSRYSSHSPMGAPPAAQRKKVTVGTLRSMHRKGDPITVMTAHDFPSGHVADHAGMDIILVGDSLAMVALGMEDTSEVIMEEMLLHCRSVARATKSAFTVGDLPMGTYEISPDQALATAIRFIKEGRVQGVKLEGGKEMAPTIKKITTAGIPVLGHIGLTPQRQNALGGFRVQGKTSSGAMSILEDALALQEAGCFAMVVEAVPAEVAALITEKLSVPTIGIGAGNGTSGQVLVQVDMIGNFPPGRFLPKFVKKYGDVWGESLRAIEAYRDDVKSRQYPGPEHTYPISAEELESFTKAIEEIDLVGLIQKQVLESKQQQVDRTLSVSLHLNFFLKYLTTSSKRLVALILHTSWANNGADPTGLNRTTILSVLKLPAASSAAVASLGRSASTTDADMIQGFSVFQFGGNMFVGESYVFIMTPQAF

SEQ ID NO: 3961 - protein, 235 aa, Leuconostoc mesenteroides subsp. mesenteroides ATCC 8293
MRLIMNEKNFQKKQAALAALNYIQTDMIIGLGTGSTVSYFLDALAASQYNVIGVTTSTITSQRCAELNIPIVDIDAIDHIDVTVDGADEVDSYLNGIKGGGAALLMEKIVAKNSKKNIWIVDRSKVHNTLGSFPLPVEVIPYGSGQLLRQFANKGLFPKLRRHPGNNQPVITDAGHYIIDCHMTTINNPYALAEYLESQVGVVEHGLFLNICDRIIIGDNTVEIKERQQAHVEIN

SEQ ID NO: 3962 - protein, 542 aa, Streptococcus pyogenes MGAS10394
MTIDKKKVVYQIYPKSYKDTTGNGVGDLRGIIAKLPYLQELGIDMIWLNPFYPSPQRDNGYDVSDYTAVNPDFGTMADFEDLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAEEAFAIIKDKSRDNARTPMQWDASEHAGFTTGKPWLEVSKSYRDINVETEKEGRIFPFYQRLIALRKELPIIAEGDYRAAFKDSQSVYAFERHLGDQCLLVLNHFYADEVELELPPRYQHGQVLISNYEKVSICEKVILKPYQTLAILAEN

SEQ ID NO: 3963 - protein, 342 aa, Geobacillus kaustophilus HTA426
MKAKVAINGFGRIGRMVFRRAINSPDLDIVAVNASYPPETLAHLVKYDSNHGKFDGEVIALEDGLLVNGKKVRLLNSRDPKQLPWKELDIDIVIEATGKFNDREKASLHLEAGAKRVILTAPGKNEDVTIVVGVNEHMLDIDRHFIISNASCTTNCLAPVVKVLDEAFGIENGLMTTVHAYTNDQKNIDNPHKDLRRARSCAQSIIPTTTGAAKALGLVLPHLKGKLHGMALRVPTPNVSLVDLVVDLKRDVTVDEVNEALIRAANGPLKGILDFTMEPLVSIDFNTNPHSAIIDGLSTMVMEGRKVKVLAWYDNEWGYSCRVVDLAHLVAAKMNERLSVNA

SEQ ID NO: 3964 - protein, 252 aa, Lactobacillus delbrueckii subsp. lactis
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGLTSEQVSKLVIAYEPIWAIGTGKTASSDQAEEMCKTIRETVKDLYNEETAENVRIQYGGSVKPANIKELMAKPNIDGGLVGGASLVPDSYLALVNYQD

SEQ ID NO: 3965 - protein, 435 aa, Xanthomonas campestris pv. campestris str. ATCC 33913
MSEYRQATDAFASNPVESKQEIRNYTMNFGPQHPAAHGVLRLILEMDGETVVRADPHIGLLHRGTEKLAESKPFNQSVPYMDRLDYVSMMCNEHAYVRAIESLMGIEAPERAQYIRTMFDEITRIKNHLMWVGSNALDLGAMAVMLYAFREREELMDVYEAVSGARMHAAYYRPGGVYRDLPDRMPKYKESRWHKGGALTKLNAAREGSMLDFLENFTDTFPSRVDEYETLLTENRIWKQRTVDVGIISPDLARAWGMTGPMLRGSGIEWDLRKKQPYAKYDAVDFDVPVGTNGDCYDRYLVRVAEMRESNRIIKQCVKWLKANPGPVMVTNFKVAPPSREGMKDDMEALIHHFKLFSEGYCVPAGETYCAVEAPKGEFGCYLMSDGANKPFRVHLRAPGFAHLSSMDAVVRGYLLADVVAMIGTYDLVFGEVDR

SEQ ID NO: 3966 - protein, 473 aa, Sulfolobus tokodaii str. 7
MPSLPKTAEEALKFLKDNKIKWVDLQFTDLPGRLHHITVPASEFTEDSFKTGFGKLDGSSIKGFTMIYESDMVLMPIPQTMAVIPWNEGIARVITQVFWGGGKGRFERDPRHIAEEAEKKQSEEGYISYFGPELEFFIFDKVDLDVATPQSGTGYKIHAREAPWARNGGFLIRYKEGYYPAPPVDQLMDIRVEAINILTDYFGFNIEATHHEVATAGQGEIDFRFSTLADTADKVQTLKYVVKNVAAKHGMIATFMPKPMFGDNGTGMHTHFSLWTKDGKNLMYDPNDEYAELSQIGRYIVGGILEHGRALSAIVSPTTNSYRRLIPGYEAPVYLVWSKSNRSAAIRIPSYYRGMEKAKRLEYRPPDPSCNPYLAFAAILMAALDGIKKKIEPGDPVDENVYHMSEERKKQLKIKELPRSLDEALDELESDNEFLKPVFNSSILNTYIDLKRDEAKTMQQYPHPMELYYYLDA

SEQ ID NO: 3967 - protein, 804 aa, Arabidopsis thaliana
MMTRFACLHLFTMFLFTLLSGSSSAVITTESPLSMGQTLSSANEVYELGFFSPNNTQDQYVGIWFKDTIPRVVVWVANREKPVTDSTAYLAISSSGSLLLLNGKHGTVWSSGVTFSSSGCRAELSDSGNLKVIDNVSERALWQSFDHLGDTLLHTSSLTYNLATAEKRVLTSWKSYTDPSPGDFLGQITPQVPSQGFVMRGSTPYWRSGPWAKTRFTGIPFMDESYTGPFTLHQDVNGSGYLTYFQRDYKLSRITLTSEGSIKMFRDNGMGWELYYEAPKKLCDFYGACGPFGLCVMSPSPMCKCFRGFVPKSVEEWKRGNWTGGCVRHTELDCLGNSTGEDADDFHQIANIKPPDFYEFASSVNAEECHQRCVHNCSCLAFAYIKGIGCLVWNQDLMDAVQFSATGELLSIRLARSELDGNKRKKTIVASIVSLTLFMILGFTAFGVWRCRVEHIAHISKDAWKNDLKPQDVPGLDFFDMHTIQNATNNFSLSNKLGQGGFGSVYKGKLQDGKEIAVKRLSSSSGQGKEEFMNEIVLISKLQHRNLVRVLGCCIEEEEKLLIYEFMVNKSLDTFLFDSRKRLEIDWPKRFDIIQGIARGLLYLHHDSRLRVIHRDLKVSNILLDEKMNPKISDFGLARMYQGTEYQDNTRRVVGTLGYMSPEYAWTGMFSEKSDIYSFGVLMLEIISGEKISRFSYGVEGKTLIAYAWESWSEYRGIDLLDQDLADSCHPLEVGRCIQIGLLCVQHQPADRPNTLELLAMLTTTSDLPSPKQPTFAFHTRDDESLSNDLITVNGMTQSVILGR

SEQ ID NO: 3968 - protein, 92 aa, Aspergillus nidulans FGSC A4
MADTLPGAVTPDLLKSKLVEQLQAQHVEIEDLSGGCGQAFQAVIVSPQFEKKTMLARHRLVNSVLKAEIAAIHAWTPKCYTPEQWEQQQGSA

SEQ ID NO: 3969 - protein, 141 aa, Candidatus Protochlamydia amoebophila UWE25
MASEQTLSIIKPDAVQNNYIGEIISRFEQAGLKIAAIKMTTLTKDQASKFYAIHKDRPFYNDLVNFMSSGPVVVMVLEGNQAIAKNRELMGATDPKKAEKGTLRADFAESMSRNAVHGSDSSETAEEEVLFFFKPDEITHR

SEQ ID NO: 3970 - protein, 597 aa, Oryza sativa (japonica cultivar-group)
MASSNETYRVELRAAARQLGERGLYSAAKWAAELLVGIEPDATPAPSSVMDTPSSSGSAASGGRLLHLHRSGGSSFRRRLRPGAAEAGTPLGGVSYVSTPIPDDDAFDVGGDRYLLAKTYFDCREYRRAAHVLRGQTGRKAVFLRCYALYTAGEKRKEEETVELEGSLGKSNAVNQELVALERELATHRRTGAIDSFCLYLYGIVLRDKGSEALARTVLVESVNSYPWNWSAWLELQSLCTSSDILNNLNIKNHWMKDFFLASAHLELKMHEEALKRYERLMGVFRCSDYIQAQIATVQYSMRDLDEADMIFEELLRTDPFRVDSMDVYSNLLYAKESSTALSFLAHRVFLTDKYRPESCCIIANYYSLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRAQSVLPLMDIDHFAM

SEQ ID NO: 3971 - protein, 259 aa, Magnaporthe grisea 70-15
MSPSTIILITGANQGIGYASTKVIASSSDKYHVIVTGRTLEKAEKAVEQLKAEGGLKGSISALQLDQTDVASVERAAAAVDKEFGRLDVLVNNGAMGWQWHGDIQSQMYEYFVDIMATNVAGPFSVSRTFRPLLKKSSDPRSIYVSSGMGSHEFIQQNPMAAKSYGESGIPYPVTKAALNMVAELEAIVHGDEVKTKVFLFCPGLVVSNLRGPSEEMRQMGGNAGDPAVSGQTLLTIIEGKRDADLGRGTVHKDGVYAW

SEQ ID NO: 3972 - protein, 207 aa, Triticum aestivum
MLKKLISKTKSKKKKEAASSSLPTLDRLHETLEMLEKKERLLQKKSSAEIEKAKDYTKAKNKNAAIQCLKKKKLYETQIEQLSNFQLRVHDQIIMLENAKATTDTVDALRSGSSAVKAIQQSLSIDDIENAIEEANEHTENMKQIQDALATPFGASAEFDEDELEAELEDLEEEELDLELPEPPRGTRVAPSALAASSSRLAASDFA

SEQ ID NO: 3973 - protein, 396 aa, Brassica oleracea
MNCLFMFKSKKPKSRRDLKKENKDKRGRELLQKSAPDLSTTRKNQTSSTSLSLPTPRSLPSPTSIRELYTERQQNRNLRVFSYKELSEATCGFDRKFQIGEGGFGNVYKATINNPTGGDSYSVPHTVAVKRLKKQSQQGHKQWLAEVQLLGVVNHPNVVKLLGYCSEDTERLLVYELMSNLSLEDHLFTRRTPTLPWKQRLEIMLGAAQGLAYLHEIQVIYRDFKSSNVLLDDDFNPKLSDFGLAREGPEGDNTHVTTVRVGTDGYAAPEYVETGHLRKHSDVYSFGVVLYEIITGRRTIERMKPSAEKILLDWVKLYPVNSKSFRVIVDSKLQSKYPVALVSRVAKLADLCLKKNDTERPTMAFVVESLSKIIEESNTGDMRSSIRESTRGVMRA

SEQ ID NO: 3974 - protein, 276 aa, Thermobifida fusca YX
MIDDVEQATVHRVARRPLGPQESARASRLWWERAADEYQAEHGSFLGDAEFVWGPEGLTEREAQLLGNPADLVGRRVLEIGCGAGQCGRWLRAQGVAEVVGIDMSARQLQHSHRLDKATGHRLPVVQADAQWLPFADASFDVVCSSFGAFPFIPDIRTALAEAARVLRPGGRLAFSVSHPIRWCFPDSPGEDGLQARDSYFDRRPYVEEDEYGRALYVEAHHTIGDWVRALADAGLVIRDIVEPEWPEDNDQVWGGWSPLRGRIIPGTAIFVADRP

SEQ ID NO: 3975 - protein, 395 aa, Helicobacter hepaticus ATCC 51449
MKKTTYAKRVELLGESTTIAISTLARELKAAGQDILSFSAGEPDFDTPEIIKDEAIRALKSGFTKYTAVAGIPELLEAIKDKLLRENTLAYERNEILVSNGAKHSLFNVFQALVDKDDEVIIPSPYWVTYPELVTFSGGKSVIVQTTQANNFKITPKQLREAITPKTKVFVLNTPSNPTGMVYTKEELESLAEVLKDTNIWVVSDEMYEKLVYGVKFFSVAAVNEDMMQRTITINGLSKSVAMTGWRIGYLACKDKKLVKLMNNLQSQCTSNINSITQKAAIVALKGEANNDIEDMRKAFEERMRFACDAINNIQNLNVCEPQGAFYLFINISTLPRYGTDSMGFCQALLKEQGVALVPGVAFGMEGFVRLSFACSLEQLKEGITRISQFVKTLF

SEQ ID NO: 3976 - protein, 1100 aa, Rhodospirillum rubrum ATCC 11170
MSDFLWYKDAIVYQLHVKAFFDSNGDGFGDFKGLTEKLDYLSDLGVTAVWILPFYPSPLRDDGYDIADYKAIHRAYGTMGDFRRFVREAHERGLKVITELVINHTSDQHAWFQRAREAKPGSKARDMYVWSDTDQRYLDTRIIFTDTETSNWAWDPLAKAYYWHRFFAHQPDLNWDNPRIFEEITRVMKFWLDCGVDGMRLDAIPYLVERDGTNNENLPETHVVLKRLRAWLDAHYEDRMFLAEANQWPEDVREYFGEAGDECHMAFHFPVMPRIYMAVAQEDRHPITDIMRQTPEIPAACQWAIFLRNHDELTLEMVTDRERDYMNTFYANDSRARINVGIRRRLAPLLDNDRRKIELLNSLLMSMPGTPIIYYGDEIGMGDNIFLGDRDGVRTPMQWSPDRNGGFSRADPASLYLPTIMDAVYGFFAVNVEAQSRSPSSLLNWMRRLIAVRKRHPSFGRGTLRFLYPGNRKILAYLREFEGEVILCVANLSRAPQPAELGLAEFSGRVPVEMLGNSVFPPIGELHYFITLPAYGFYWFRLSKGEGPSWHEPPVEPLPDLSTLVLPRIWDSLGSDGPLRQIQGDILPAFLPKQRWFSGKEHSLRGVEMTDHAVISAPGAASGWMLALWRADYKDGAPGQTFQLPLDIAWESREDDPLSRLLPFTLARVRRVNRVGALYDAMAGPAFPLALVQAMAEGANVTTAKGGGLRFTRTQAFPAGPLPGPEAVARLGREQSNTSIKLGEDMVLKLYRRVEAGIHPEIEIGRFLTDVAGFANAPPLLGALEHIDAKGAISALAVLQGFVRNQGDGWDYMLAYLDRFLDDRAQAPAEVGEGGGPAGSPHGIIHAQADILGQRVAELHHAFATPTEDPAFSAEAVGPEDLASWREQVRTQAAQARQALDTALPGLSAEVAGLVTRLLDCWERIDARVDAPISLAEGLVKTRIHGDLHLGQVVVVRDDFHILDFEGEPVKGLSERRDKHCPLKDVAGMLRSFDYAAWSAALSFRQTHAEVRIDVLPALGVWQEEIREAFLAGYDRAIAGCPSVPALEEGRRDLLSLFMLEKALYEVSYEAANRPDWLRIPIGGVLRLLGEGPSDEIKPR

SEQ ID NO: 3977 - protein, 364 aa, Dichodontium pellucidum
HGVLRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLIFDVPVGIRGDCYDRYCIRIEEMRQSIRIIMQCLNQMPSGMIKADDRKLCPPSRSQMKQSMESLIHHFKLYTEGFYVPASSTYTAVEAPKGEFGVFLVSNGTNRPYRCKIRAPGFAHLQGLDFMSKHHMLSDVVTIIGTQD

SEQ ID NO: 3978 - protein, 398 aa, Thiobacillus denitrificans ATCC 25259
MELSRRVQAIKPSPTLAVTARAAALKATGRDIIGLGAGEPDFDTPQHIKDAAIKAIDGGFTKYTAVDGTPSLKAAIIAKFKRDNGLDYTPKQILVSCGGKQSFFNLVQAVIDPDDEVIIPAPYWVSYPDIVILADGKPVIVEAGIEQGFKITPAQLEAAITPKTRLFVINSPSNPTGAVYSKDELAALGDVLRRHPRVLIASDDMYEHIRLDGAPFVNILNACPDLYDRTLVLNGVSKAYSMTGWRIGYAAGPEAILRAMTNVQSQSTSNPTSISQVAAEAALNGDQGCITPMLDAFKARHRFVVDALNAIPGFKCVDSGGAFYAFPDVRPAIQALLARDVIEQGTDIAFSEYLLESADVAVVPGSAFGAEGYIRLSFATSQANLDKALKRIAQAIAG

SEQ ID NO: 3979 - protein, 364 aa, Leucobryum glaucum
HGVSRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLIFDVPVGTRGDCYDRYCIRIEEMRQSIRIIMQCLNQMPSGMIKADNRKLCPPSRSQMKQSMESLIHHFKLYTEGFSVPASSTYTAVEAPKGEFGVFLVSNGTNRPYRCKIRAPGFAHLQGLDFMSKHHMLSDVVTIIGTQD

SEQ ID NO: 3980 - protein, 473 aa, Frankia sp. EAN1pec
MTVSNATTTTPRPGDPPRTGHAGRVTDLLEREERALQARTPASEAMHTRALRTMTGGVPSSYQLRDPWPIYLTHGRGSLVWDVDGNEYSDFHNGYGSMVQGHAHPAIVRAVTERMALGSHFAMPTEDSVLVSEELARRFGLPQWRYVNSGSEATMDAIRIARGVTGRDTIVKIFGSYHGHHDYVMVSIGTPYGDIGPADHMNSLAYGAGIPQAVVDLTVPVPFNDAAAMERRIAALEAEGRKPACVIMEAAMMNLGVVLPEPGYLEAVREITRRHGIVLIFDEVKTGLCVAAGGAVERFGVLPDMVTLAKALGGGLPAGAIGATAELMAAVAEDRVKQVGTFNGNPLVMAAARASLTEVLTPDAYAHLDRLNDRLVDGCTAILARHGIAGYAVGISSKGCVHFTDAPIRDYTSFMAHQNAVLPELAWLYNANRQVLMAPGREEEWTLSVQHTDADVDRYLASLDAMAADLARG

SEQ ID NO: 3981 - protein, 364 aa, Ulota crispa
HGVLRLVLEMNGEVVERAEPHIGLLHRGTEKLIEYKTYLQALPYFDRLDYVSMMAQEHAYSLAAEKLCNCEVPLRAQYIRVLFCEITRILNHLLALTTHAMDVGALTPFLWAFEEREKLLEFYERVSGARMHASYIRPGGVAQDMPLGLSEDIFLFTQQFASRIDEIEEMLTNNRIWKQRLVDIGTVTAQQALDWGFSGVMLRGSGVCWDLRKSAPYDVYNQLIFDVPVGTRGDCYDRYCIRIEEMRQSIRIIMQCLNQMPSGMIKADDRKLCPPSRSQMKQSMESLIHHFKLYTEGFSVPASSTYTAVEAPKGEFGVFLVSNGTNRPYRCKIRAPGFAHLQGLDFMSKHHMLSDVVTIIGTQD

SEQ ID NO: 3982 - protein, 463 aa, Bacillus halodurans C-125
MTKQATNAVLKKGQRFPLTIKRLGINGEGVGYFKRHVVFVPGALPGEEVVVEVTDVKPRFAEASIRKIRKSSPDRISPPCPVYDQCGGCQLQHLSYEATLKEKREIVKQAFERHTTLRADTLTILPTIGMEDPWAYRNKSQLQLKTEKGQVKAGLYVMNTHKLVDLSSCLVQHDATNEASEVVKQIVQDLQIPTYNERKRTGILRSVVSRVGFETGELQVILVTTKKDFPKKDLLVEEIKSRLPHVKSLQQNINPKKTSLIMGDETISLFGEETIEETLGDISFSLSARAFFQLNPKQTVKLYNEVKRAAALTGKEKVIDAYCGVGTIGLWLADQAREVRGMDVIAEAIEDAKENAKRQGITNVQYEVGKAEKIIPSWVRSSWIPDVIVVDPPRTGCDDQLLKTIKQTKPKRIVYVSCNPSTLAKDVEQLQRSGYKVKNIQPVDMFPWTAQVESCTLLVYEGK

SEQ ID NO: 3983 - protein, 475 aa, Bacillus cereus ATCC 14579
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 3984 - protein, 527 aa, Zea mays
  misc_feature (392)..(392): Xaa can be any naturally occurring amino acid
  unsure (1)..(527): unsure at all Xaa locations
MQGASHMLLEEPFRLASVLSPAKPKVFPSLTKIVGTLGPNSHSVEIIQECLTAGMSVARFDFSWMDAAYHQETLDNLRKAAQNVKKLCPVMLDTLGPEIQVHNSTGEPIELKAGNHVIITPDISKALSAEILPIKFGDLAKAVKKGDTLFMGQYLFTGSETTSVWLEVVETSGENVNCLVKNAATLAGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAVSTVGRICAEAETVYNQPLQFKKVMWHVGDPMXHEESVASAAVGSAIKVKAAAIVVFTFSGRAARLVAKYRPTMPILAVIFPREGSDPSKWRSYGTTQARQCFAVRGVYPLMGSTDEAETGGLTKEEYGIKLAMSYGRSVGIVKPFDRLIIFEKIGDSSVVKIIECEG

SEQ ID NO: 3985 - protein, 404 aa, Bacillus halodurans C-125
MDKKLFDPIEEAIYELMQGRVVIVCDDEDRENEGDFVALAEKATPEVINFMITHGRGLVCTPITEERAKELDLVPMVDHNTDPHGTAFTVSIDHQMTTTGISAHERAMTIQALIDKKTKKHHFKRPGHIFPLIAKNGGVLRRAGHTEAAVDLARLSGAEPAGVICEIIKEDGSMARVPDLRKIADQFELKMITIKDLIEYRHRKDKLVKREVDISLPTDFGSFRAIGYTDVIDGKESVALVKGQIVEGEPTLVRVHSECLTGDVFGSHRCDCGPQLQAALTQIEQQGKGILLYMRQEGRGIGLMNKLKAYKLQEEGYDTVEANEKLGFPADLRDYGMGAQILRDLGVSKMRLLTNNPRKITGLKGYGLEVVERVPLQLPHNKDNERYLKTKHEKLGHLLNFTHS

SEQ ID NO: 3986 - protein, 251 aa, Xanthomonas campestris pv. campestris str. ATCC 33913
MRRKIVAGNWKLHGTRAFATELVAQVAAHMPLAGVDVVILPPLPYLGDLIEDFEAHHLAFGAQDVSSNEKGAYTGEVSASMLVDVGAEYGLVGHSERRQYHQESSELVARKFAAAMHAGLIPVLCVGESLEQREAGQTEAILRAQLEPVLSLVGSAGFARAVVAYEPIWAIGTGRTATPDQAQAVHAFIRGEVAKADARIADSLPILYGGSVKPDNASELFSQPDVDGGLVGGASLVAEDFLAIARAAAAC

SEQ ID NO: 3987 - protein, 169 aa, Arabidopsis thaliana
  misc_feature (77)..(77): Xaa can be any naturally occurring amino acid
  misc_feature (159)..(159): Xaa can be any naturally occurring amino acid
  unsure (1)..(169): unsure at all Xaa locations
STATMLKASPAKHDWFYGQTILLRQPSSVSAIRNHVGPSALTVQAVTSYTNDLDAAANAISIPEHGLMAMDESNPTXGQRSSSIVLENSAATRQAYRTMLVTAQGLGQYISGAILSEETMYQCTTVGRIMVDVLVELNIAPVIKVNMVVQPLVRSYDEXWRQGLDCIAY

SEQ ID NO: 3988 - protein, 510 aa, Zea mays
  misc_feature (152)..(152): Xaa can be any naturally occurring amino acid
  unsure (1)..(510): unsure at all Xaa locations
MGDFNVALVIVAAVVSVLVLLVSVYLLVNYQHPDDVNQAYFPKLVVVLGLTVAVLSILMLPADVANRQACRKAVYNGACSLTLPMRTLWLVVYIVDAVLVFLVIPFAMFYYEGDQDKSVGKRLRTALIWVVASAVVCGLVLGILYGLVGKVXFTVRHLSSSVQTFPNSFSGFSSGQPCISPLTRQCAASTAPANSQTTWTMRATFPEYVVALTTIVGSVLFTIFGGVGIACLPLGLIFSFVRRPKAVITRSQYIKEATELGKKARELKKAAEALHQEERSGNKGRKWRKNVKAVEKELLLLEDDMKALEEMYPQGEQAEATWAFTVLGYIGKLIFGVVGLIVSIAWVAHIVIYLLIDPPLSSFLNEVFIKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKKKPTGRFQLSK

SEQ ID NO: 3989 - protein, 537 aa, Aspergillus nidulans FGSC A4
MAAEKPTPAPYGNRDPEAVPETETKAGTLQALVEAELLDSRYQNTQRGLKTRHVQLMALGGTIGTGLFVGSGQALNIGGPLSLFLGYVFISTLVYCIVTGIAEVGAYLPVHGGTMSYHGFRLGILVPYEIVAASLVIDYWPNGVPLAAWITIMLVVIVVLNYMPVGIYGETEFWFAGIKIITLIGLLLLSFILFWGGGPNRQRLGFHYWKDPGAMNTYLVTSNENTGRFIGLLQCIVKSAIAFIFAPELIIVTAGEMESPRRNVPKAGRRYIYRLVIFYLLGALAIGVICSSQDQALLTGDTNNASASPFVAAIQNAGIPVLRHIVNAAILTSAWSAGNSFLYMSSRSLYGLAVSGNAPSIFKSCNRFGVPWLAVTVSALFSLLSYLAVSSGSYTVFNWLINFTNTSGFISWICCCIVYFRFNAAIKAQGVEKPYSSRLQPYGIWVGLSFAIFLLLINGFTCFFPQNWSAANFFTAYIGIPAFALLYVGHRIWFWSDPWAWKSTEVDLQTGLQEILAAEKPARPRDTIGRKLMALVE

SEQ ID NO: 3990 - protein, 259 aa, Streptococcus pyogenes
SNAMKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 3991 - protein, 587 aa, Geobacillus kaustophilus HTA426
MKRKTKIVCTIGPASESVDKLVQLIEAGMNVARLNFSHGDHEEHGRRIANIREAARRTGQTVAILLDTKGPEIRTHNMENGAVELKEGAKLIISMSEVLGTPEKISVTYPGLIDDVSVGSKILLDDGLIGLEVNAVDKQAGEIATTVLNTGVLKNKKGVNVPGVRVNLPGITEKDRADILFGIRQGIDFIAASFVRRASDVLEIRELLEANDALHIQIIAKIENEEGVANIDEILEAADGLMVARGDLGVEIPAEEVPLIQKMLIKKCNMLGKPVITATQMLDSMQRNPRPTRAEASDVANAIFDGTDAVMLSGETAAGQYPVEAVRTMHQIALRTEQALEHRDILSQRTKESRTTITDAIGQSVAHTALNLDVAAIVTPTVSGKTPQMVAKYRPKAPIIAVTSNEAVSRRLALIWGVYTKEAPHVNTTDEMLDVAVDAAVRSGLVKHGDLVVITAGVPVGETGSTNLMKVHVISDLLAKGQGIGRKSAFGKAVVAKTAEEACRKMVEGGILVTISTDADMMPAIEKAAAIITEEGGLTSHAAVVGLSLGIPVVVGVENATSLFKDGQEITVDGGFGAVYRGHASVL

SEQ ID NO: 3992 - protein, 167 aa, Borrelia burgdorferi
MLLQKTLCIVKPDGVRRGLIGDVVSRFERVGLKMVAAKMLIVDESLAKKHYLYDDIVFRHSEAVWNSLIKFISNSPVFTFVVEGVESIEVVRKLCGATEPKLAIPGTIRGDFSYHSFKYSNEKGFSIYNVIHASANEADAMREIPIWFKDNEILNYKRDDECEHYYC

SEQ ID NO: 3993 - protein, 360 aa, Nicotiana plumbaginifolia
FSAKSSIFKFESYTCTEVTKDIMQAMNQYDPTSSHDDFLDQILSSVPSSSPCWPDLSKSWDPHHHHLSPPLPPNPSSGDDHQPPPSNPLQHFQYDDQSSSFLAAKLRQHQITGGGGGGGGAVAAAKALLLQQQLLLSRTLAGNGLRSPTGASGDNGFLNMLGNGDQNDGVGNPANDSSVQALFNGFTGSLGQNSSQPQHFHHPQGGTMQAQSFGAPATAPAMNQTPAASGSAGGGTTPAAQPKQQRVRARRGQATDPHSIAERLRRERIAERMKALQELVPNANKTDKASMLDEIIDYVKFLQLQVKVLSMSRLGGAAAVAPLVADMSSEGRGEGNGGRGGNGTASSSNNDSMTVTEHQV

SEQ ID NO: 3994 - protein, 219 aa, Buchnera aphidicola str. Sg (Schizaphis graminum)
MNLNELKKKAAWAALDYIYPGTVIGVGTGSTVFYFIQALSTVKHLISGAVSSSNSSTVLLKKNGIRVLDLNTFDFLEIYVDSADEINNDMQMIKGGGAALTKEKIIAAMSKKFVCIIDESKKVNILGTFPLPIEIIPIAFSYISKEILKIGGQPKLRENIITDNGNVIIDVYNLFINDPISVEKKINSLPGVVSVGLFASRVADVVLIGTQKGVEIIKN

SEQ ID NO: 3995 - protein, 142 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 3996 - protein, 582 aa, Candida albicans SC5314
MTIEYTWWKDATIYQIWPASYKDSNGDGIGDIPGIISTLDYLKNLGIDIIWLSPMYKSPMEDMGYDISDYESINPDFGTMEDMQNLIDGCHERGMKIICDLVVNHTSSEHEWFKQSRSSKSNPKRDWYIWKPPRIDAKTGEKLPPNNWGSFFSGSAWEYDELTDEYYLRLFAKGQPDLNWENEECRQAIYNSAMKSWFDKGVDGFRIDVAGLYSKDQSFKDAPIVFPDQIYQPSGELISNGPRIHEFHQEMYRQVTSKYDVMTVGEIGHCDRNEALKYVSAQRKELNMMFLFDLVEVGSNNQDRFRYNGWNLIDFKKAIQNQSDFIKGTDAWSTVFIENHDQPRCISRFGNTKSLDLINKTGKLLAMLQASLTGTLFIYQGQEIGMTNLPRSWSIDEYKDINTINYYKDFKEKYGNEPDFKQREEKLLDVINLVARDHARSPVQWNDDDTASYGGFSTHKPWTRINDNYKQINVANELKDPNSILKFYQSVLKLRKEYKDLFIYGSFDILDFNNEKLFTYVKSHKEGNESPKAYVTLNFSNESIPFKPLIEGEFKLMTTNVQQSDYDESVLSPYEGRIYIVD

SEQ ID NO: 3997 - protein, 220 aa, Bacillus thuringiensis serovar konkukian str. 97-27
MDLKQIAGEYAATFVKDGMKVGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIVDCIFPNHIPTPSDLHKRLKMITGVVETGLFVNMTSKAIIGTKNGIQEL

SEQ ID NO: 3998 - protein, 332 aa, Aspergillus oryzae
MSLGKKVTLNSGAEIPTLGFGTWQSAPGEVGEAVYQALKAGYRHLDLATIYQNQKEIAVGIKRAFEEFNIKREDVFITSKLWNSQHHPDVVEKALDDCLAECGLDYLDLYLVHWPVAFKTGNEYFPLVEGSTVPGGDCIIDDSISIVDTWKAMTKLPKSKARAIGVSNHMVEHLEAIINATGVVPAANQIERHPVLQSPKLIQYCKEKGIHVTAYSAFGNNMIGEPLLITRPEIKAVAEEAGKRLGKEVSPAQVILAWSQVGGHSVIPKSVTPARIAANFQEIELTPEEIAKVTALGTERRYNVPYVANKPRWNINVFGEPEEAPADHKVIL

SEQ ID NO: 3999 - protein, 364 aa, Takakia lepidozioides
HGVLRSVSEMNGEVVERAEPHIGLLHRGTEKLIEYKTYLQAIPHFDRLDYVSMMAQEHAYSSAVERLCNCEVPLRAQYIRVLFREITRILNHLLALTTHAMDVGALTPFLWAFEEREKLLEFYERVSGARMHASYIRPGGVAQDMPLGLSEDIFLFTQQFASRIDEIEEMLTNNRIRKQRLVDIGTVTAQQALDWGFSGVMLRGSGVCWDSRKSAPYDVYNQLDFDVPVGTRGDRYDRYCIRIGEMRQSIRIIMQRPNQMPSGMIKADDRKLCPPSRSQMKQSMESSIHHFKLYTEGVSVPASSTYTAAEAPKGEFGVFLVSNGTNRPYRCKIRAPGFAHLQGPDFMSKHHMPADVVTIIGTQD

SEQ ID NO: 4000 - protein, 429 aa, Silicibacter pomeroyi DSS-3
MMNQDLSTRARASLPGGVSHELRYRDPYPVFIDRAQGGEKWDVEGRRYIDFKMGSASQMLGHCHPAIVEAIQKQAERSVFSADCHTREIEWAEWVNRLYPSADRTRFTASGTESTMLALRLGRAYSGKDHVLRVEGHFHGWHDHALKGAKPGSDQVPSLGIPDAINDLIHICAADPQAMESALQDDRIGTVIIEASGANYGCVPLATDTLRALHDVVRAAGVVLIFDEIITGFRWSPGGRQARDGIVPDLTTLAKVVTGGLPGGAICGRADIMELLNNATVRNGFGPAVSHKGTFNGSPLIAAAACAAMPLLANGEAQAQADAMAERMRDGMNAAMKRQGVAGIAYGDSSIFHVFFGRDRLDGLGPAEIRGLPKPLVKAYRDGMLSRGVDMMAYTSGLTSSAHTPELIDEALLAFDDTLSEMIRDGALT

SEQ ID NO: 4001 - protein, 153 aa, Arabidopsis thaliana
SMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 4002 - protein, 508 aa, Mycoplasma gallisepticum R
MNKKHKDFDLNFLKKTKIVATCGPSITYKLFSLADLEDPSKQEIVQKAKENLRQLFLNGVSTVRLNFSHGNQEEQAVRMILARSVANELNLPISIMLDTNGPEIRLNQISETDNTVKKDQIVKIYTNREIVGNATEFSVSDSSKKYNMAKDVSLGSIVLVDDGKLTLQVIEVAEDFSYIRAIAKNEHKIITKKRINLPNAKYSIPFLSQKDYNDITFGLKNKVDYIAASFVNSADDIYEIKAILKQYGMEHVQVIAKVETRHAIKNLDEIIDVSDGVMVARGDLGLEIPYYEVPYWEKYIIKACRFKNKRVIVATQMLDSLEKNVQPTRAEVTDVFFAVERGCDATMLSGETANGMYPIIAVETMKKINKQSELLFDYKRAITHYFPMTDVCKTAFGERVLDIAKKICPNREIENEDFSTHFLVHFTNNREEIFALSNAKLAASVIIVTDDQNVYTGHGVDYGVFTYKVDDLTKALSNYQLVAKKAILHYSELFEIKPDNKTNFVLLK

SEQ ID NO: 4003 - protein, 448 aa, Leuconostoc mesenteroides subsp. mesenteroides ATCC 8293
MLKEKLPKEKVLRDPIHNFIHVEDPIILDLINTPEFQRLRRVKQLGITSSVFHGAEHSRFGHSVGVYELARRITERFEQYYSDVWEPKERLLTLVAALLHDIGHGAFSHTFEHLFHTDHEAMTREIITGDTEIHRVLAQVSPDFPNKVASVIAKTYENPQVVQLISSQIDVDRMDYLLRDAYFTGTKYGEFDIDRILRTMQPTPDGIAFDIAGMHAVEDYIVSRYQMYLQVYFHPVSRGMEVLLEHLLQRAQELYRSNTTSEFAENDFVGPLLAPLFSDKKLTLSEYLKLDDNVFMTYINIWQSHSDPILSDLSQRFMGRRPLKSMEITDETAPLLEELEQLVDNAGFNPRFYTARNNAYDLPYDDYKPNVAKPRTQIDFLLADGSHRELSDMSTLVAAIKGKASIDQRFFFPKEMLNIEPDELFADTFKKFRSFIRNNALTTPNPES

SEQ ID NO: 4004 - protein, 95 aa, Zea mays
  misc_feature (77)..(77): Xaa can be any naturally occurring amino acid
  unsure (1)..(95): unsure at all Xaa locations
PPPTSCCAPPRSRSAEAQYGWLCLCPNDEKECHYRDAPSPGYVLKSQRKGLLEEESEKIAIEDEIEDQRKKTKTTTXPMARELFMEWKREKGQER

SEQ ID NO: 4005 - protein, 506 aa, Arabidopsis thaliana
  misc_feature (28)..(28): Xaa can be any naturally occurring amino acid
  unsure (1)..(506): unsure at all Xaa locations
MASISLLQVSVAILCFLILHYFLFKKPXGRFPRNWPVLGMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILITGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 4006 - protein, 558 aa, Listeria monocytogenes str. 4b H7858
MNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEMLPAFEKSAAVVVEEGGLTSHAAVVGINLGIPVIVGAKDATSLVKDGEIITVDSRQGVVYNGKTATH

SEQ ID NO: 4007 - protein, 549 aa, Leuconostoc mesenteroides subsp. mesenteroides ATCC 8293
MTELGKHVVYQVYPKSFQDSNGDGVGDLPGIIQRLPYLAKLGVTMIWLNPVFPSPQNDNGYDISNYTAIDPLFGTMTDFENLVKEAKTYHMGIMLDMVFNHTSTDHTWFQKALAGDQKYQDYYYLRPYRDDGHEPTNWVSKFGGSAWAKFGDTNLAYLHLYDPTQADLNWHNPAVRQELYDVLNFWLAKGVRGFRFDVINVIGKSEVLVDDETDNGGKFLYTDTPIVQDYIQEMNAATFGKYPDVITVGELSSTTVQNTAAYTNPDNKALSMGFNFHHLKVDYDHGNKWTKVPYEFESLRHIWHEWSQGLMENHGWPAWFWNNHDQPRAINRFIKTPKYYRVGAKMLAMLVHLNRGTPYVYMGEEIGMIDPTYHKIETYVDVESKNAYQMLLKQGLTKQQAFEIVQTKSRDNSRVPMQWRNEDYAGFSTHEPWLQNANYEQINVAQDEKSADSLYAFYQNLIRLRQENEVIADGDYTPKYEESEEIIAFERQLAGKHILVVTHFGETPVSISISDEIVKNGQVLVTNYPAQPVSGTMLLKPYESFAIAY

SEQ ID NO: 4008 - protein, 256 aa, Sinorhizobium meliloti
MTPDIRPLVAGNWKMNGTRASLDQIKAMAEGVKGDLSARVDALICPPATLLYVATALCDDSPLMIGAQDCHQKQSGAHTGEVSAEMVADCFGTHVIVGHSERRTDHGEGDALVRAKTEAAHGADLVAIVCVGETEEERKAGRTLDILKRQLSESLPDQATAENTVIAYEPVWAIGTGLTPTVSDVEEAHAFMRRELVSRFGAEGGKMRILYGGSVKPSNAKELMGVANVDGALIGGASLKADDFLAIYRAYEELTA

SEQ ID NO: 4009 - protein, 837 aa, delta proteobacterium MLMS-1
MSKAKTPPSPPPPATGQQVTAPYCNFGGSLDDEKLASTINHHLLSFLGRDPMRAGNRELYKAVAYTVRDLLIERWIRTQKESYARNRKRVYYLSLEFLIGRSLDNSLVNLGLYDKFAMVLKKMGYSLEEISEQEEDAGLGNGGLGRLAACFLDSMATQGIPAYGYGIRYEYGLFYQRLLDGFQVEHPDNWLRYGTPWEYNRPWNLYSVKFHGRVHHYRDAAGKLRCEWVDTDEVMAMANDILVPGFNNESVINMRLWSAQASRDLDLVSFNRGDYVQAVQDVVESETLSKVLYPSDDIREGQELRFKQQYFFVAATFQDILRRYKKQNGKDFGKFTDEIAVQLNDTHPAVAIPELMRLLLDDEGLDWEQAWDICVATFGYTNHTLMPEALETWAVDLFERLLPRHLEIIYEINRRFLGEVAARYPGDQERQQRMSLIDEGEVRKVRMAHLAVVGSHSINGVAELHSKLQKEWIFKDFNDLYPHRFNNKTNGITQRRWLLKSNPGLAQLITEHIGGQWVTDLDVLRQLEPLVDHEKFQHRWRAVKYDNKLRLTRLIKESCALKIDPDSLFDVQIKRIHEYKRQLLNVMHVIVHYQRLVQGRRSEAPPRTVIFAGKAAPSYARAKLIIKLINEVAMVVNHDRRVNDQLKVVFLPNYGVSLAEKIIPAADLSEQISTAGTEASGTGNMKLALNGALTCGTMDGANIEMSQEIGQENMFIFGLDAEEVARARLDPEWVPVKVYRNNPEVREAVDAVASGYFSRGDSALFKPLVEALLDPADPYLTLLDLEDYLRCQEEVDRQFADQTLWTRKSILNVARMGKFSSDRTIRQYAEEIWGITP

SEQ ID NO: 4010 - protein, 670 aa, Pseudomonas aeruginosa PAO1
MSRSAFTALLLSCVLLALSMPARADDLPYRFGLGKADITGEAAEVGMMGYSSLEQKTAGIHMRQWARAFVIEEAASGRRLVYVNTDLGMIFQAVHLKVLARLKAKYPGVYDENNVMLAATHTHSGPGGFSHYAMYNLSVLGFQEKTFNAIVDGIVRSIERAQARLQPGRLFYGSGELRNANRNRSLLSHLKNPDIVGYEDGIDPQMSVLSFVDANGELAGAISWFPVHSTSMTNANHLISPDNKGYASYHWEHDVSRKSGFVAAFAQTNAGNLSPNLNLKPGSGPFDNEFDNTREIGLRQFAKAYEIAGQAQEEVLGELDSRFRFVDFTRLPIRPEFTDGQPRQLCTAAIGTSLAAGSTEDGPGPLGLEEGNNPFLSALGGLLTGVPPQELVQCQAEKTILADTGNKKPYPWTPTVLPIQMFRIGQLELLGAPAEFTVMAGVRIRRAVQAASEAAGIRHVVFNGYANAYASYVTTREEYAAQEYEGGSTLYGPWTQAAYQQLFVDMAVALRERLPVETSAIAPDLSCCQMNFQTGVVADDPYIGKSFGDVLQQPRESYRIGDKVTVAFVTGHPKNDLRTEKTFLEVVNIGKDGKQTPETVATDNDWDTQYRWERVGISASKATISWSIPPGTEPGHYYIRHYGNAKNFWTQKISEIGGSTRSFEVLGTTP

SEQ ID NO: 4011 - protein, 215 aa, Arabidopsis thaliana
  misc_feature (10)..(10): Xaa can be any naturally occurring amino acid
  misc_feature (16)..(16): Xaa can be any naturally occurring amino acid
  misc_feature (23)..(23): Xaa can be any naturally occurring amino acid
  misc_feature (32)..(32): Xaa can be any naturally occurring amino acid
  misc_feature (203)..(203): Xaa can be any naturally occurring amino acid
  unsure (1)..(215): unsure at all Xaa locations
SCVSPPYVFXPVKSTXRSDFFVXAQNCWVRKXGAFTGEVSPEMLVNLDIPWVILGHSERGRILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIXDIIKAAEVKKSA

SEQ ID NO: 4012 - protein, 314 aa, Leuconostoc mesenteroides subsp. mesenteroides ATCC 8293
MTKQVFLPDDIPAVGKKILEEAGLEVVVGSGRDHEKMKAEGVEASAVLIGTQKFDADIMDAMPNLKVIARNGVGYDAVDVDAATQRGIYVVNTPKALSGSVAETAVSELLAISKNLYQDSKAIHDDNWNYRKAHPGRDIEGKTVGILGFGRIGQQVAKKLSGFDVKVIAFDPFAKDVPGVELVDRETIFKTADYVMVHLPALPETQHSIGADEFKLMKNDAFLINMARGSILVESDLVLALKSGEIAGAALDVFEEEPLPVTNPLVALENVLLTPHIASNTVETKARMAVDATNDIVRVLSGKNPESAVNKIGK

SEQ ID NO: 4013 - protein, 157 aa, Oryza sativa (japonica cultivar-group)
MAKLYVQAVPPPDLNRNTEWFMYPGVWTTYICILFFSWLLVLSVFGCTPGMAWTVVNLFHFAITYHFFHWKKGTPFADDQGMYNTLTWWEQMDNGKQLTRNRKFLVVVPVVLYLIASHTTDYQHPMLFLNTLAVAVLVVAKLPNMHKVRIFGINAGN

SEQ ID NO: 4014 - protein, 406 aa, Oryza sativa
MSCLGWFKKRRSSKSKESSGRRGSTTTTVSAVSTSRSDDSGAVRPASKSTGSTSSHRSISSLYEERGHGQLRDFDYDELQAATNGFSRAQKLGEGGFGSVYKGFVRSSPADGKAADRLAVAVKCLNQRGLQGHKQWLAEVQFLGVLEHPNLVKLLGYCAVDGERGPQRLLVYEYMPNKSLEDHLFVRAYPPLSWNRRLQIILGAAEGLAYLHEGQVQVIYRDFKASNILLDKDFRAKLSDFGLAREGPTGANTHVSTAVVGTHGYAAPDYIETGHLTVKSDVWSFGVVLYEILTGRRTLDRHRPQGEQKLLEWVAQFAPDSRNFRMIMDPRLRGEYSVKAARDIAKLAESCLLKNAKERPTMSEVVDVLRRAVQSQPDPPPPPAAAAAASGKGKRVDVAPQPARRR

SEQ ID NO: 4015 - protein, 111 aa, Zea mays
MGTASTSPDTMEAARLPGLSITVEKNPPEARLLQLGVKSWPKWGCPPGRFPLKFDAALTCYLVKGRVRAAVKGSRECVEFGAGDLVVFPKGLSCTWDVVVGVDKHYNFDPS

SEQ ID NO: 4016 - protein, 691 aa, Oryza sativa
MMPAGSASLLLECYGGDPPLSSMEGTSSGEEVEDGTGPSPEAEEDDDPAPYVGQRFPTHDAAHELYSGFARRRGFSIRRHRTEGKDGVGRGLTRRYFVCHRAGNPPAKPFAAGAGDRPQRNRRSSRCGCKAYMRIGRSAIAAAAAGEAEGEWRVTGFSNHHNHELLGQDQVRLLPAYRVVSGDDRDRILMLARSGISVQQMMRIMELGTRVEPGNLPFTEKDVRNLIQSCRKSDQEESVDLIKMCRRFQEKDPDFKYEFTKGASNRVENVAWSFASSVQSYEMFGDAVVFNTTHRLPALDMLLGIWVGLNNHGMPCFFGCAFLREESLQSYAWALKVFLNFMNRKAPLTILTDENMYLKEAIEKELPGTKQALCIWLIAARFPSWFDAVLGERYNSWKDEFDRLYNMESTMEFDLGWSDMMNSYGLHGNGHIASLFASRTLWALPYLRGQFFAGLLASPETSKSISVFIQRFSSAQTRLAHFIEQVAVVAEYKDQAGRQQMMQHNLQSITLKTATPMERHAAAVLTPYAISKLQDELVVACQYASFHLEGNVFLVRHHTKTEDGGCNVTWSQREELISCSSNMFESAGILCRHGLRVLSTLNYFQIPDHYLPPRWRRTWPSPSKALNGAYFHESPEIGRVKALQSMVSALVSEASKSTERMDIATREVSALLSRMRQQPVVMHVSGDGVHK

SEQ ID NO: 4017 - protein, 427 aa, Zea mays
  misc_feature (206)..(206): Xaa can be any naturally occurring amino acid
  unsure (1)..(427): unsure at all Xaa locations
MSSSMESSYLPATTESLAQAQEAKDASESISILYRVIQDPSSSADALRTKEVAITNLTNYLTKENRAEELRNLLTQLRPFFAVIPKAKTAKIVRGIIDAVAKIPGTSDLQISLCKEMVEWTRAEKRTFLRQRVEARLAALLLENQEYTEALTLLTSLIKEVRRLDDKLLLVDIDLLESKLHFSLRNLPKAKASLTAARTAANAIYXVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPIDHVEKKLSQMILDKKFAGTLDQGAGCLIIFEDSKTEEIFPATLETISNVGKVVDSLYVRSAKIMA

SEQ ID NO: 4018 - protein, 144 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 4019 - protein, 213 aa, Candida tropicalis
ISLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 4020 - protein, 143 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4021 - protein, 394 aa, Coxiella burnetii RSA 493
MNDVLSVRAQQLEPSVTLAVSDLARELLNKGHDVISLSAGEPDFDTPDFIKQSAIKAIQEGFTKYTNVDGTPALKAAIVHKLKRDNHLNYEPSEILVSGGAKQSIYNVLMGTLNAGDEAIIPAPYWVSYPPMVQLAEAKPIIISATIDQNFKLTPGQLSQAITPQSRLLILNSPNNPSGVAYTESELKALADVLMEHPQILILSDEIYEYILWGQNRFVNILNVCPELRDRTIIINGASKAYAMTGWRIGYAAGPKSIIQAMKKIQSQSTSSPNSIAQVAATTALGAQRGDFAYMYEAYKTRHDLVLKALNQMKGVHCIPADGAFYLFPDVSAAIQQLGLEDDIKLGTYLLDKTKVAVVPGSAFGSPGHVRLSCATSTEKLQEALERLASVLDY

SEQ ID NO: 4022 - protein, 154 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLAAKNLYDLPP

SEQ ID NO: 4023 - protein, 526 aa, Emericella nidulans
MAASSSLDHLSNRMKLEWHSKLNTEMVPAKNFRRTSIICTIGPKTNSVEKINALRRAGLNVVRMNFSHGSYEYHQSVIDHAREAEKQAAGRPVAIALDTKGPEIRTGNTVGDKDIPIKAGHEMNISTDEQYATASDDQNMYVDYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTSGNTARMISKYRPVCPIIMVSRNPAATRYSHLYRGVWPFYFPEKKPDFNVKIWQEDVDRRLKWGINHGLKLGIINKGDNIVCVQGWRGGMGHTNTVRVVPAEENLGLSE

SEQ ID NO: 4024 - protein, 564 aa, Oceanobacter sp. RED65
MPHEIGLITILAAGFGLALVLGFIVQRLGLPTLVGYLLAGIVIGPHTPGFTADIGLAGQLAEIGVMLLMFGVGLHFSLNDLLSVKRIAVPGAIVQILVALSMGMGLAIAWGWSIGEAIVFGFCLSVASTVVLLRALESGGILNSMNGRIAVGWLVVEDLVMVLLLVLLPAFAAPVAEGESLNLVSVSQVVGITLLKVAAFIIFMLVVGKRLFPKILWMVASSGSRELFTLCVVAAAVAFAYGASILFDVSFALGAFFAGMMMRESEFAHRAADESLPLRDAFAVLFFVSVGMLFDPMVLIEHPVHVLLTTLVVILGKTLAAVALVLLFRYPLSTALTVGVSLAQIGEFSFILAGLGMSLGLVSDEAMSLVLAAAMLSIALNPALFVVIKPLREWVLKRSFWARKLDARDDPLAQLPLSVDQSLLKGQAVLVGYGTIGRPIAKAFDEHDVKVVIAEAQRERVDALREKGRLAVTGDAGEPVVLVQAHIMHASLLIITIKDLIKVRQMIDTARTLNPEIKILLCAQSDEEAELMRKQYDVETFLAENELANAISNRALQHWKSISH

SEQ ID NO: 4025 - protein, 286 aa, Ustilago maydis 521
MASSNATNSTSAASAANTNSSAFKSAELAALSGVEAAKRAAAYAAVDNHVKPQHEIIGIGSGSTVPYVVERIAQQGPAVNAKRWFVPTGFQSRELIINAGLRLGDVDSFPSIDVTIDGADEVDNALNCIKGGGACHLREKVLAEAANEFVVVADYRKNGSQLGTKWLQGVPIEVAPFAYAKVLQNLKKMGSDKAVLRMGKAKAGPVVTDNGNFCIDAPFPEAQMKDPSDLLKRIKLLTGVLEVGLFCNICKSAYFGNDDGTITIKTAAGDVQEGVHFDVSKAPATA

SEQ ID NO: 4026 - protein, 350 aa, Bacillus cereus ATCC 14579
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSPK

SEQ ID NO: 4027 - protein, 470 aa, Escherichia coli O157:H7 EDL933
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 4028 - protein, 496 aa, Glycine max
MIMMMMMCSMWMWVVLVAIAGALLVLRSILKNVNWWLYESKLGVKQYSLPPGDMGWPFIGNMWSFLSAFKSKDPDSFISSFVSRFGRTGMYKTMMFGNPSIIVTTPEICKRVLTDDDKFTPGWPQSTIELIGKRSFISMSYEEHKRLRRLTSSSINGMEALSLYLTYIEKNVKSSLEKWANMGQIEFLTEIRKLTFKIIMHIFLSSESEHVMEALEREYTALNHGVRAMCINIPGFAYHKAFKARKNLVAIFQSIVDERRNLRKGYLPGKAKDMMDALIDLEDDERKLSDEDIIDIMLMYLNAGHESSGHITMWATFFLQKHPEYLQKAKAEQEEIIRRRPPTQKGLTLKEVREMDFLYKVIDETLRVITFSLVVFREAKSDVNINGYTIPKGWKALVWFRSVHLDPEIYPNPKEFNPYRWNKEHKAGEFLPFGGGSRLCPGNDLAKMEIAVFLHHFLLNYRFEQHNPNCPVRYLPHTRPMDNCLGRVRKCSSTTT

SEQ ID NO: 4029 - protein, 402 aa, Synechococcus sp. PCC 7002
MYGITSTANSTGNQSYANRLFIYEVVGLGGDGRNENSLVRKSGTTFITVPYARMNQEMQRITKLGGKIVSIRPAEDAAQIVSEGQSSAQASAQSPMASSTKIVHPKTTDTSVPVNIYRPKTPFLGKCIENYELVDEGGSGTVRHVTFDISEGDLRYLEGQSIGIIPPGEDKNGKPHKLRLYSIASTRHGDMEDNKTVSLCVRQLEYQDPESGETVYGVCSTYLCNLPVGTDDVKITGPVGKEMLLPDDEDATVVMLATGTGIAPFRAFLWRMFKEQHEDYKFKGKAWLIFGVPYTANILYKDDFEKMAAENPDNFRLTYAISREQKTADGGKVYVQSRVSEYADELFEMIQKPNTHVYMCGLKGMQPPIDETFTAEAEKRGLNWEEMRRSMKKEHRWHVEVY

SEQ ID NO: 4030 - protein, 358 aa, Nakaseomyces delphensis
MSEWKVDPDNRRRLLQLQKVGANKRCVDCNAPNPQWASPKFGIFICLECAGTHRSLGVHISFVRSITMDQFKQEELVRMEKGGNEPFIEYMTSHGIDMTLPHKIKYDNPIAEDYKEKLSCEVEDKEFVEPKHPDFDPKALGKTSTPSVATKAGAGSITSNATSRQDTPIESRRTGTPQQKEKNEQYFAQLGQKNQERPDHLPPSQGGKFQGFGNTPVNNSKQANTNTMSLENLQTDPVGTLSRGWGLFSSALQKSFDDVNETYIKPNVQQWNTGELSEETKRAAAQFGQKFQETSTYGVQAFSSFTKQYITGEEDTMSNFNRTSPMPGTANSTNSTDNLLKKEKMRPPKAGEDEWEEF

SEQ ID NO: 4031 - protein, 371 aa, Oryza sativa
MQGGSSGIVYGGLKYQARCIADVRAAAGSTTFLAGTLSLKEENEVHLIRFSPAESELVCDGLFYHPNEIWDLKSCPFDHRVFSTVYTSGEGYGASVWKIPELHGQSNSPPLEQLFTLDEHTGKIRCVLWWPLGKHDKLISIDDRNIFLWNIDASNKSAKVMQKGSADMLPNLRGGSWDPHDHNSIAAITDSSLHCWDLRSMKKSNAIEHAHFRDVDYNPKKQHLITTAEDEFGIRLWDLRMLKYPLKNLPGHSHWTWAVRHNPEHDQLILSAGTDSTVNLWFAKVGTDDSGPESPPGSPTREEEPLLNSYTDYEDSIYEKMKLHVLSVVRAHNSTSLLDFLLAILYTVLWYMELMRWPDSTACDPRTIASQ

SEQ ID NO: 4032 - protein, 486 aa, Crocosphaera watsonii WH 8501
MVIKTPEWVKNAIFYQIYPDTFARKVPDRQKWLLDVPLEDWEAPPTSQGYKGGNLWGVIDKLDYLQDLGVDALYLTPIFRSACNHRYHTQDYYAIDPLLGDREAFDHLLKTAHDKGFKVVLDGVFNHASRGFFFFNDILENGPNSPWLDWFKIEGWPLSAYDGSRPANYVSWIDYRALPQFNHDNPAVREYIMQVGEYWLQQGIDGWRLDVPNCVEAEGFWEEFRERVKAVNPEAYIVGEIVSDATQWLDGKQFDGVMNYPFARLTACFVIGDRLDKETIPSFYKPYETLDAAEYAKGLEELLARHPWEIQLTQLNLLDSHDTSRFLTMAGGDRTSLQLATLLLFTFPGTPNIFYGDEIGIEGGKDPDGRKGFPTEEKWEQETLTYHKQLIQIRKKYTALRTGEYRVITAQENVYVFARILGEEGLIIAVNNGEDKTEIQIDKFDKVSSILQTKPSQIIYGEGSINWHDNQLKITMHPRSGLVIAP

SEQ ID NO: 4033 - protein, 573 aa, Hypocrea lixii
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 4034 - protein, 397 aa, Streptomyces virginiae
MSARIGAISESATLAVDAKAKALKAAGRPVIGFGAGEPDFPTPDYIVEAAVEACRNPKYHRYTPAGGLPELKAAIAAKTLRDSGYEVEASQVLVTNGGKQAIYEAFAAILDPGDEVIVPAPYWTTYPESIRLAGGVPVDVVADETTGYRVSVEQLEAARTERTKVVLFVSPSNPTGSVYSEADAKAIGEWAAEHGLWVLTDEIYEHLVYGEAKFTSLPVLVPALRDKCIIVNGVAKTYAMTGWRVGWVIAPQDVIKAATNLQSHATSNVSNVAQVAALAAVSGNLDAVAEMRKAFDRRRQTMVKMLNEIDGVFCPTPEGAFYAYPSVKELLGKEIRGKRPQSSVELAALILDEVEVAVVPGEAFGTPGYLRLSYALGDEDLVEGVSRIQKLLAEAKA

SEQ ID NO: 4035 - protein, 256 aa, Bruguiera sexangula
MALSSSALRTVSSSVKVVGPARSKSATVPTQTVLPFKFTNPSLLTRSLSFSSKGSSFDSFSVPKRSFSCRSQATPSDDASRPTKVQELCVYEMNERDRGSPAVLRLSQKPVNSLGDLVPFSNKVYSGDLQKRIGVTAGICILIQNKPEKKGDRFEAIYSFYFGGYGHIAVQGAYLTYEDTHLAVTGGSGIFEGVSGQVKLQQLVYPFKLFYTFYLRGIKDLPEELTKKPVEPHPSVEPMPAAKACEPHAVVANFTD

SEQ ID NO: 4036 - protein, 231 aa, Gluconobacter oxydans 621H
MSGTDMNVHKRTAAREAADMVKSGMVVGLGTGSTAAYMIERLGERVAEGLEIFGIPTSDDSEDKALKAGIPLTDFSAHRRIDIAIDGADEVQRGSLNLIKGLGGALLREKIVAQAAKRFVVIVDGTKPVDLLGERAPVPVEVISFGWECTAERLAACGARGVKPRTDRAGSLFVTDTGNMILDCHFGPIEKPEELAEKIDRIVGVVEHGMFLNMASEVLVATPDGVEHWEP

SEQ ID NO: 4037 - protein, 395 aa, Sulfolobus tokodaii str. 7
MKKIFDEIHGYITLNDIETKLVDTPIFQRLRRVKQTSLAYIVYPGAMHTRFSHSIGALHLANRLGLRLYNEGIINQEEIQYLRLAALLNDLGQFPFSHSIEPLFLSKNISNKYLRDLIITKSQEINEIFEEYSISSKKILDIYHGQSFLSAIIDSDVDVDRMDYLIRDSKHTGVQLGNLDLDRLIDTINYGENKTIIILDKGLTSLENFYISRLHMYQSVYYHKTILGYEIQLRNIFSQLSEFCCPGIFDESFLKDSVTTNYFAYWDDEWLFSKLYESLFDPSVPDSIKVKIKNFLDRNGPKVVYEEISFQNIESRIEENVLKLTRYGIPETAIYPFEEAIKIIDKSKIKIKTKNKEKDLKEYSSTLLNVIPSVIYIRRIYVEGMYSKKARDLLS

SEQ ID NO: 4038 - protein, 450 aa, Oryza sativa
MEAAAKLKRSISRQLSSGAARVWRQLSLEPVYTPRRAGAVGGGGGGGGGGGGGGGGARPTRFGLARQSSLDPTPREGGGAAEDGSGAAAMLAVPENLDATMRLLFAACQGDVAGVEELLRDGVDVDSIDLDGRTAMHIAACEGQGEVVRLLLSWKANMNARDRWGSTPAADAKHYGHFEVYNLLRARGAKTPGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIEGKQIMKYMRNIP

SEQ ID NO: 4039 - protein, 118 aa, Glycine max
KKSWKRMITKPTFVGPGFTRRPVKYERFIRPMGLRYKKANVTHPELSVTVQLPIISVKKNPQNPLYTQLGVLTKGPIIEVNVSELGLVTAGGKVVWGRYAQITNNPENDGCLNAVLLV

SEQ ID NO: 4040 - protein, 480 aa, Gluconobacter oxydans 621H
MTEKNNLFINGSWVAPKGGEWIKVENPATKAVVAEVAKGGQADVDAAVSAAKSAFIGWSRRTATERADYIHALKDLVKRDKEKLAAIITSEMGKPLKEARIEVDFAIGLLRFSAENVLRLQGEIIPGSSPEEKILIDRVPLGVIGAITAWNFPLALCARKIGPAVAAGNTIVVKPHELTPLACLHLAKLVEEAKIPHGVINVVTGDGKDVGVPLVAHKDIKLITMTGSTPAGKKIMAAASETLKEVRLELGGKAPFMVMEDADIDRAADAAVTARFNNAGQVCTCNERTYIHEAVYDRFVQKVREKIEALKVGLPTDPSTDMGPKVSEDELNKVHEMVEHAVRQGARLAIGGKRLTGGVYDKGYFYAPTLLTDVTQDMDIVHNEVFGPVMSLIRVKDFDQAIAWANDCRYGLSAYLFTNDLSRILRMTRDLEFGEVYVNRPGGEAPQGFHHGYKESGLGGEDGQHGMEAYVQTKTIYLNA

SEQ ID NO: 4041 - protein, 446 aa, Lactobacillus plantarum WCFS1
MENQQLARKLKRRHVQMIALGGAIGTGLFLGSGLAIKQAGPSILLAYAIGGFFCYLMMRALGELLLSDTRLHSFLEFINRYLGKRFEFAIGWTYWLCWISLAMADLTASGIYIRYWFPWIPQWVTPLIIILILLVFNMLSVSAFGELEYWFSMIKVVAIIALIVTGAILIGSSAHVGGQTVSVTNLVSHGGFFPTGVQGFLMSFSLVIFAFTGIEMVGITAGEAENPEKELPRAINSLPIRISFFYVGALFVIMAIYPWNQITTSQSPFVQVFSDVGIKAAASIINFVVLTAALSACNSAIFSTSRTLFTLAHGDNAPKWMGKVNRYNVPARSLLFSSLILLVIVALNYVIPSTVFTLISNVATTNFIIVWCALLVCHYVYKRTTDSTHNPFKLPLFPVTNIATLAFFIAVTVVLCFDQVNRWAVIGSVVWFVILLVIERSMHRTV

SEQ ID NO: 4042 - protein, 510 aa, Paenibacillus sp. KCTC8848P
MLTMFASGAMAEQEMNGHKPPNSVGSGVFYEIYINSFYDSNGDGHGDLKGITQKLDYLNDGNPRSGKDLQVSGLWLMPMNPSPSYHKYDVTDYYQVDPQYGNLNDFRTLTKEAKRKGVKVIIDLVINHSSSEHPWFKEASTNPQSKYHDYYVWANEKTNLDEKGSWGQQVWHKNPNGEGYFYGTFWSGMPDLNFDNPEVRKEMIKVGKYWLQQGADGFRLDAAMHIFKGQTKDGADKNIAWWNEFRSEMEKINPNVYLAGEVWDKPETIAPYYESLHSLFNFDLGGKILNSVKNGRDQGIATFAEKTLKLYKSHNKAALDAPFLSNHDQTRVMSELGGDVRKAKLPASILLTLPGQPFLYYGEEIGMKGEKPDEYLREPMRWYKGEGRGQTTWEVPKYNRGEVSVEAQMRDNDSLLQSYRTLIRLREEHEALRSHNLEPIQAGSANVAAYQRSSGKETLYVYHNLSGKPVTLQMKDADKQKRKVVFSSSKGVKIKKNAVTIPAYSSLITK

SEQ ID NO: 4043 - protein, 395 aa, Burkholderia xenovorans LB400
MRALCWHGKKDVRIDNVPDPMIEHPRDAIIKVSSCAICGSDLHLFDGFMPTMKSGDVLGHEFMGEVVEVGAENQKLKIGDRVVVPFTIACGECDRCRRGFFSVCERSNRNKEMADKVFGHSTAGLFGYSHLTGGYPGGQAEYVRVPFADFTPVRIPDGLTDEQVLFLGDIFPTGWQAAAQCEIEPTDTVSIWGAGPVGQFAIRSAILLGARQVISIDRVPERLAMARAAGAITINFDTESVLDRLNELTQGKGPEKCIDAVGMESHATRSFDALYDRAKQALMLETDRPHVLREMIYVCRPAGILSIPGVYGGLIDKIPFGAAMNKGLTFRMGQTHVNRWTDDLLRRIQEGQIDPSFVITHTVPLEQGPEMYRVFREKEDGCVKVVLKPSPSMGQ

SEQ ID NO: 4044 - protein, 324 aa, Neisseria gonorrhoeae FA 1090
MDTLTRFLPEHLQQNQLPEALGGVLLSVVSACTEINAKVRLGALAGVLGMAGTGNIQGEDQKKLDVIANNIMIDTLKANPAVAGLASEEEDTFVSAGENGRYLVLFDPLDGSSNIDVNISVGTIFSILAKPEGALATESFLQTGRQQLAAGYVLYGPQTQLVFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 4045 - protein, 475 aa, Ralstonia metallidurans CH34
MYQDLALYIDGEFIKGGDRREQDVINPATQELLGKLPHATTADLDRALSAAQRAFETWKKTSPLERSQILRRVAELTRTRAKEIGRDITLDQGKPLAEAVGEVMICAEHAEWHAEECRRIYGRVIPPRNPAVRQIVVREPIGVCAAFTPWNFPFNQAIRKIVAALGAGCTLILKGPEDSPSAVVALARLFHDAGLPPGVLNIVWGVPSEVSTYLIESPIVRKISFTGSVPVGKQLAAMAGAHMKRVTMELGGHSPVLVFGDADIEPAAEMLARFKLRNAGQVCVSPTRFYVQEKAYDKFLARFTEVIGSIKVGNGLDDGTQMGPLAHERRIASMEQFLDDASHRGGKIVAGGSRIGDKGFFFAPTVVTDLPDDAKLMVDEPFGPVAPVTRFKDAEEVLRRANSLPFGLASYVFTNSLKTANLVSNGLEAGMVNINHFGMALAETPFGGIKDSGIGSEGGQETFDGYLVTKFITQV

SEQ ID NO: 4046 - protein, 184 aa, Amaranthus hypochondriacus
MASSMMSNAATAVAVAATSGGAQANMVAPFNGLKSIASFPVTRKSNDITSIASNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPTAFIRIIGFDNKRQVQCVSFIAYKPADSY

SEQ ID NO: 4047 - protein, 492 aa, Oceanicola granulosus HTCC2516
MLDDTTDFTALLSDPSLVCSQAFVGGKWVDAASGETFDVTNPARGDVIARIPDLSREEVAEAIAVADRARHAWAAKTGKERAAVLRKWFDLMMANQEDLAIIMTAEQGKPLAESRAEIAYGAGFIEWFGEEAKRIYGETIPGHQPDKRITVLRQPIGVAAGITPWNFPNAMITRKVAPALAAGCSFVIRPASQTPLSALAMAKIAEEAGVPAGVFSVVTSTSASEIGREFCENPKVRKLTFTGSTEVGRILLRQAADQVMKCSMELGGNAPFIVFDDAEIDAAVQGAIMCKFRNNGQTCVCANRIYVQDAVYDTFAEKLKAEVEKLSVGDGLDDGTQLGPLIEPAAIKKVREHLQDALDKGAKILTGGEAHPLGEQFFQPTVVTEANQQMKVATEETFGPFAPLFRFKDEDEVIELANDTIFGLASYFYAKDLSRVVKVQEALEYGIVGVNTGIISTEVAPFGGVKQSGLGREGSRHGIEDYLELKYICTSV

SEQ ID NO: 4048 - protein, 273 aa, Pyrococcus furiosus DSM 3638
MRDKLFYFLSKYNFSPRDKIGQNFLIMRDVIIKAVETSEIKKSDVVLEVGPGFGFLTDELSKRAGKVYAIELDKRIIEILENEYNWENVEIIQGDAVKIEWPEFNKVVSNIPYQISSPFTFKLLKHDFEKAVVMYQLEFAKRMVAKPGDRNYSRLSLMVNALANAKIVMKIGRGAFYPKPKVDSALVLIVPKPKDERIELNENLVKALFQHRRKLVSKALKESCHMLGINKKELKTLKNILENVPHAKKRVFELTPEEVKEIEEFLKIQGIIN

SEQ ID NO: 4049 - protein, 180 aa, Amaranthus hypochondriacus
MASSLMSNAITAVVGASGAQANMVAPFNGLKSIASFPVTRKSNDITSIASNGGRVQCMQVWPPVGKKKFETLSYLPPLSDAQLLAQVQYLLNNGWIPCIEFELEHPFVYRENHRSPGYQDGRYWTMWKLPMYGCTDPAQVLNEVEEAKKAYPSAFIRIIGFDNKRQVQCVSFIAFKPPGY

SEQ ID NO: 4050 - protein, 529 aa, Streptomyces coelicolor A3(2)
MSSKPVVLIAEELSPATVDALGPDFEIRHCNGADRAELLPAIADVDAILVRSATKVDAEAVAAAKKLKVVARAGVGLDNVDVSAATKAGVMVVNAPTSNIVTAAELACGLIVATARNIPQANAALKNGEWKRSKYTGVELAEKTLGVVGLGRIGALVAQRMSAFGMKVVAYDPYVQPARAAQMGVKVLSLDELLEVSDFITVHLPKTPETLGLIGDEALRKVKPSVRIVNAARGGIVDEEALYSALKEGRVAGAGLDVYAKEPCTDSPLFEFDQVVATPHLGASTDEAQEKAGIAVAKSVRLALAGELVPDAVNVQGGVIAEDVKPGLPLAERLGRIFTALAGEVAVRLDVEVYGEITQHDVKVLELSALKGVFEDVVDETVSYVNAPLFAQERGVEVRLTTSSESPEHRNVVIVRGTLSDGEEVSVSGTLAGPKHLQKIVAIGEYDVDLALADHMVVLRYEDRPGVVGTVGRIIGEAGLNIAGMQVARATVGGEALAVLTVDDTVPSGVLAEVAAEIGATSARSVNLV

SEQ ID NO: 4051 - protein, 744 aa, Oryza sativa
  misc_feature (334)..(334): Xaa can be any naturally occurring amino acid
  misc_feature (472)..(472): Xaa can be any naturally occurring amino acid
  unsure (1)..(744): unsure at all Xaa locations
MELLCIGTADTKLDELLFLAARLRSTLAATSSAQVQVSLVDVSTTKKVTSQDFKGTTFISRDAVLSCHLGVDQHELPSDRGEAITLMSEALQSFLKRRYESGTLLGAVGLGGSGGTALIAPALRSLPLGVPKLIVSTVASGQTAPYVGTSDLVLFPSVVDICGINSVSRVILSNAAAAVAGMVHGILMESNESDETATKPTIGITMFGVTTTCVNMVKERLSKEGYETLVFHATGVGGKAMEELVKGGFIQGVLDITTTEVADHIVGGVMACDDTRFDAIIDNKIPLVLSVGALDMVNFGARDTIPPDFTGRKIHVHNEQVSLMRTTVEENKKXIAEFIADKINKSSSKVIVCLPQKGISAIDAPKMPFYDLEATSTLLDELCSRIEKTDNREVKMLPYHINDPEFANVLVDAFLSMDVKASNTISPENSMVQTNQDVNTKEYCSTQRTSDSSIIWRSPVDFPDARPETLQXTKSVLHKLKQQIVEGTPVIGAGAGTGISAKFEEAGGVDLIVLYNSGRFRMAGRGSLAGLLPFADANAIVLEMANEVLPVVKGVPVLAGVCATDPFRRMEYFLKQLEAIGFCGVQNFPTVGLFDGNFRQNLEETGMGYSLEVEMISRAHSMGFLTTPYAFNPEEAAAMAKAGAHIIVAHMGLTTAGSIGAKTAVTLDDSVKRVQAIADAALGINPDIIVLCHGGPISGPQEAEFILKRTNRVHGFYGASSMERLPVEQAITNTMREYKRISIK

SEQ ID NO: 4052 - protein, 449 aa, Deinococcus radiodurans R1
MTSVSPTPDGILRQLQDAEVSFLRLQFTDILGHTKNVEVPRTQFAKALSGDVTFDGSAVQGFTRVEESDMLLSPDLSTFLVYPQFARDDRERGRVARLICDVTLPDGTPFEGDPRRVLRAQVERAQALGLEMYVGTEPEFFLFERGPNGAATTVTHDRAGYFDLAPIDRGERIRREIASRLVEMGFEIEASHHEVAPGQHEIDFRYAPALETADRIATFKFVVKRIALEHGLLASFLPKPIAGVSGSGMHCHLSLFKDGQNVFDDPGGEHGLSDTAHQFVAGLLDHAEGMTAITNPLVNSYKRLVPGFEAPVNIAWSTSNRSALVRIPAKRGPSTRAELRMPDPSCNPYLALAAMLAAGLDGIERQLEPPPAIQRNIFRMTVREKRHHRVKELPGDLREAVDELAKDEVIAAALGEHVMEHYVTAKRAEWREYSSAVHAWELERYLDLV

SEQ ID NO: 4053 - protein, 434 aa, Saccharomyces cerevisiae
MLLKNLHSLLQLPIFSNGADKGIEPNCPINIPLSCSNKTDIDNSCCFEYPGGIFLQTQFWNYFPSKNDLNETELVKELGPLDSFTIHGLWPDNCHGGYQQFCNRSLQIDDVYYLLHDKKFNNNDTSLQISGEKLLEYLDLYWKSNNGNHESLWIHEFNKHGTCISTIRPECYTEWGANSVDRKRAVYDYFRITYNLFKKLDTFSTLEKNNIVPSVDNSYSLEQIEAALSKEFEGKKVFIGCDRHNSLNEVWYYNHLKGSLLSEMFVPMDSLAIRTNCKKDGIKFFPKGYVPTFRRRPNKGARYRGVVRLSNINNGDQMQGFLIKNGHWMSQGTPANYELIKSPYGNYYLRTNQGFCDIISSSSNELVCKFRNIKDAGQFDFDPTKGGDGYIGYSGNYNWGGDTYPRRRNQSPIFSVDDEQNSKKYKFKLKFIKN

SEQ ID NO: 4054 - protein, 610 aa, Sinorhizobium meliloti
METTTIIYSQALMLLAGAVVAAPLFKRLGLGTILGYLAAGILIGPVAQQITEGEEILHVSELGVVFLLFIIGLELKPSRLWQMRRDIFGLGTAQVVITGAVLSFLIAFSGLLEGAGSIVAGFGLALSSTAFAMQILEENNDTNTRYGQRAFSILLLQDLAIVPLLAIIPLMAAQAPEDTTTPLEDFAIAIAAVAALFAAGRYLLNPLFQVIARTGARDVMIAAALLVVMGAATMMQLAGLSMAMGAFLAGVLLAESSYRHELEADIEPFRGILQALFFMAVGLSLELQVVAENLLSIIIAVPVLMLVKSLVLYGLCRATGSRHNDAVRIGLLLPQGGEFGFVLFTAAAAAGVFSQATSSLLVAIVTLSMALTPVAAMLSRRLMHKQDELAEEIEEDFEGAGAGADVLMIGFSRFAQIASQILLAGGRDVTIIDHSAARVRQAATFGFRIYFGDGTRLDVLRAAGIEKAKIVAVCTQKKEVTDKIIDLVHAEYPNARIFARSYDRLHTLELRARGVDYELRETFESGLLFGRKTLEALGVNGDEAIGIMDDIRRRDEARLVLQEAEGITAGRDMLHSRPVRPEPLVKPKREVTQPDDALADLADETLEKAE

SEQ ID NO: 4055 - protein, 472 aa, Pseudomonas aeruginosa PAO1
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 4056 - protein, 152 aa, Zea mays
NGGDEESKDEGGGKHGEQKKKKKKYTTGRLSFCSFSFPSASGRRRFAAVRASAETMATEKLGIKVERNPPESRLSELGVRQWPKWGCEKSKFPWTYSAKETCYLLQGKVKVYPEGHGEEFVEIGAGDLVVFPKGMSCTWDVAEAVDKHYNFE

SEQ ID NO: 4057 - protein, 138 aa, Brassica napus
MKTESPRHLRNPLLVLLFLAAAAAAPVAQIAMAAEPEQAPAAQEAAVHIVYVDRPEDADPEEFHIRTLAPVLGSEEKARGAVLYHYKHAASGFSAKLTTEQVEDLKKQPGVLQVVPSQTVQLHGNEGGHAKTTRTMLM

SEQ ID NO: 4058 - protein, 101 aa, Aspergillus fumigatus
LHPATGQVRAFHPADGSALQEGQCHAPELGVTVQLPILGVKKNPQNPLYTQLGVLTKGTIIEVNVSELGLVTTSGKVVWGKYAQITNTPENDGTVNAVLLV

SEQ ID NO: 4059 - protein, 359 aa, Xanthobacter autotrophicus Py2
MCGLILAGLILAARKERRGGPPPERSAPLPASRPKILITTRLFDDAATRFLEAQGFEVVPSGLPGDALDSNIPDADLNALLEGAAGWIVGQRAVTRDVLAAHPQLKVIARRGVGYDRVDVDAARDLGRVVTIAAGANDPAVADHTIALMLAVLRRLKASQAAIARGDWRVLVGADLTGKTVGLIGFGRIGRQVARRLSGFDVTVLVTSRTPDPEAAGVTFVALDELIARSDVVSLHAPLVPETRHVINAATLKAMKRSAVVVNTSRGGLIDDATLLAALEAGEIAGAGLDVFEAEADEALHPLAEALAARENVVATAHAAGSSEEALARGNLISAQCVAAALAGAPFPPGCLIADGRVK

SEQ ID NO: 4060 - protein, 142 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4061 - protein, 522 aa, Burkholderia xenovorans LB400
MRINAFGFPGLVRLSAFAGKSSAFRARVDAHTWTRTAGTVRDAGGRLISVWGTEEAADRFVISAAYALEDGILWLQLPADDRHESGGYGYPDLSAVFPCATRMQRAVYDLLGLRAIGAEDTRPWLNHGNWAADYHPLRKRSSGTERFEPSQDADYPFVPVAGDGVHEIAVGPIHAGVIEPGHFRFSVVGEKVLRLEERLGYAHRGIEKLFQRTPWLLGQRLAARIAGDSTVAFSWAYCMAVERAFEVRIPPRAQWLRALLLERERIANHLGDLGALGNDAGFAYGLAAFSRLKEDWLRVNDQCFGHRYLMDRIAPGGMATDLDPRCIPAMLTQCEQIDAEVRAMQAIYDDQSGLQDRFAGAGIVSAKVAEHFGVCGLVGRASGRKIDVRVDHPYAPYHEVQVRAVSDDRGDVAARVAVRFNEIYESLRLLRALLSDLPGGHVVTPVEHAGAPSCGVGWIEGWRGDVFIAVETGADGTLLRCHCHDPSWHNWPALEHAIIGNIVADFPLINKSFNLNYAGHDL

SEQ ID NO: 4062 - protein, 391 aa, Thiobacillus denitrificans ATCC 25259
MAEARKILTLNAISARGLARLPEHYVVGGDLADPDAILVRSANMHEMEIPTSVCAIGRAGAGTNNIPVKKMSERGLPVFNAPGANANAVKELVIAGMLMGARNLVPALKFVESLDGTDEAMHKATEAGKKQFAGMELPGRTLGVIGLGAIGSHIAEAAIRLGMNVVGYDPAITVDAAWRLPSQVKRAENVDDVLRTADFVTLHVPLLDATRNLINAQRLSLMRSGAVLLNFAREGVVDNAAVIEALDAGKLHAYICDFPANALKGHPKVVALPHLGASTEEAEENCAVMVAEQLTDYLENGNILNSVNFPSVAMPRESAFRLAIANANVPNMVGQISSVLAAAGLNIHNMVNKSKGDMAYTLVDVDSAVAGSVIAQLNAIGGVLGVRYLPA

SEQ ID NO: 4063 - protein, 118 aa, Arabidopsis thaliana
MYVGSALDDAGKLLVLLRDGRKLMGTLRSFDQFANAVLEGACERVIVGEQYCDIPLGLYVIRGENVVLIGELDTEREELPPHMIRVSEAEIKRAQKVEREASELRGTMRKRMEFLDFD

SEQ ID NO: 4064 - protein, 211 aa, Triticum aestivum
  misc_feature (176)..(176): Xaa can be any naturally occurring amino acid
  unsure (1)..(211): unsure at all Xaa locations
MAAPPSSVSVRAGASVSAKLTPSRAARVGFGGRVSVGSGRKCGGPVRASLFSPKPAVAMDARPTKVQELHVYELNEHDRESPAYLRLSAKQSQNALGDLVPFTNKVYNGSLDKRIGITAGICILIQHVPERNGDRYEAIYSIYFGDYGHITVQGPYLTYEESYLTVTGGFGVFEGXYAQVKLNQIVFPFKILLNLLTPRGFPEPGLGKLFL

SEQ ID NO: 4065 - protein, 312 aa, Nicotiana tabacum
MDPVPSSASHGNLDEQIAQLMQCKPLSEQEVRGLCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGAMCDLLWSDPDDRCGWGISPRGAGYTFGQDISEQFNHTNNLKLIARAHQLVMEGFNWAHDQKVVTIFSAPNYCYRCGNMASILEVDDSRERTFIQFEPAPRRGEPDVTRRTPDYFL

SEQ ID NO: 4066 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 4067 - protein, 368 aa, Geobacillus kaustophilus HTA426
MAKAAVLHRYGEPLSIEELDLASPKRGEVKVKMKAAGLCHSDWHVVQGQLPLPLPIVLGHEGAGIVEEVGEGVTSVKQGDHVVLNWVPSCGTCSYCRTGRPDLCEEAARLMATGTLPDGTTRFSLHGKPVYQFLTAGAFSEYTIVPEQAAIPIRRDVPFELAALISCSVMTGVGAAIHTAQVRPGSTVAVIGAGGVGFNIIQGAALAGAKQIIAVDIVEEKLAMTKTFGATHTVNAREDDAVSAVLDLTDGIGVDYAFEAIGRPETMADAYNMTRKAGTTVIVGIAAPHEAVEINAFSLPSQSKALTGSWLGQGNPPIDYPKLLDLYAAGKLKLEPLISAVYSLDQINDGFAALKSGQNIRGIIRFEE

SEQ ID NO: 4068 - protein, 437 aa, Bacillus halodurans C-125
MNRSRSESLFQKAQSLIVGGVNSPSRSFKAVGGGAPVFMEKAKGAYFWDVDGNQYIDYLAAYGPIITGHAHPHITNAIQRAAENGVLYGTPTKLENQFASMLQQAIPSLEKVRFVNSGTEAVMTTIRVARAYTGRDKIIKFAGCYHGHSDLVLVAAGSGPSTLGTPDSAGVTKNIAEEVITVPFNQLDSLKEALDHWGEEVAAVLVEPIVGNFGIVEPHEGFLEGVNELAHNAGALVIYDEVITAFRFMYEGAQNYVGVEPDMTALGKIIGGGLPIGAYGGRIDIMEKVAPLGPAYQAGTMAGNPASMSAGIACLEVLQEEGLYDELDRKGAILEKGIKAHAEAHGITISINRLKGALTVYFTDETVTCYEQAERSDGEKFSLFFKEMLNQGINLAPSKYEAWFLTIAHTDEDIEKTLQAVDHAFSVMAAKGYHLKR

SEQ ID NO: 4069 - protein, 388 aa, Synechococcus sp. WH 5701
MKLSARAEALHPSLTLAIAARAKQLRAQGQDICSLSAGEPDFDTPAFIRQAASEALEAGATRYGPAAGEPALREAIAVKLSEENGVPTKAEQVLVTNGGKQALFNLFQVLLGPGDEVLLPAPYWLSYPEMVQLAGASVRLLPSDAEHGFRLDPQQLEAAITPASRLLVLNSPSNPTGMVLSRQELEAIAAVLRRHPHVAVVCDEIYEFLLAPGHVHHSFAAVAPDLSDRVFIVNGFAKGWAMTGWRLGFLAGPSAVVSAAIALQSQSTSNVCSFAQFGALAAVSGPRDCVVEMARQFSERRALLHQGLASLPGLTLQPPEGAFYAFPDVSAYGLDSMTFCNRLLNEVGLALVPGVAFGDDRCVRLSCAASPATLRDGLARLGHFISSL

SEQ ID NO: 4070 - protein, 159 aa, Magnetococcus sp. MC-1
MLPCLFMLAVFFHQEFTMTIERTFSIIKPDAVAKNVVGEIQSRFEKAGLRIIASKMIRLTPEIAGKFYEVHKARPFYNDLCSYMSSGPVVVQVLEGDGAVLKNRDIMGATNPKDAAPGTIRADFAESIDANAVHGSDAPETAAQEIAFFFSGTELCDRP

SEQ ID NO: 4071 - protein, 540 aa, Oryza sativa
SSSPIIPHLQHTPWSLESCSYVLPLLTCCLFLLYSITCYALAAAAGGGGSCGGSDDHAAPRSYPLVGCLLDFYRNRRRLLAWYTGLLAASPSQTIVVDRLGARRTVVTANPANVEHVLRANFGNYPKGKAFTDVLGDLLGGGIFNADGERWFAQRKLVSHEFSARVMREAVGVALEREARARLLPALDAAAEGGGGVVVVDVQELLRQFAFNVICRVALGGGGGEVALALPLSRLAAAFDAAAAISARRGAAPVAAAWKVKRALGVGSERRLREEVKVIRDAIMEFVRDSSSRRRREQLLAAARGRDDLVSRMAAAGYPDEAICDMVVSFIMAGRDTTSSALTWFFWLMTRHRDVEREVLDEVDACMGDGGDGGGLAGVDLEGSRRARVLHAALCETMRLYPPVAWDSKHAAEDDVLPDGTRVGRGDRVTYFPYGMGRMEAIWGADAGEFRPGRWLAAAAAGGGVSPFKYPVFQGGPRTCLGKDMAFVQMKFVASAVLRRFELRPVAPEGSPEFVPLLTAHMAGGLKVTVRRRQRQNGTC

SEQ ID NO: 4072 - protein, 249 aa, Xanthomonas campestris pv. vesicatoria str. 85-10
MTRKLVLLRHGQSQWNLDNRFTGWVDVELTDQGRQEAVAAGKLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDNLQVRSFRYLGDPEAAKRAAEAVANQGKAK

SEQ ID NO: 4073 - protein, 323 aa, Gluconobacter oxydans 621H
MTQTAAPAWSTDSLERLDGKTALITGSTGGLGFEVACGLAKQGAAILLSGRNHNKGQAALARLHERVPFVKARFELLDLASLAGIEAFASAMRSRGEPIHLLANNAGVMGPATRLTTKDGFELQFGTNHLGHFALTGRLLPLLAAGNATVMTVASLAALKGEIPFGDLNARHSYNPMVRYRQSKLCNLLFALELNRRALKAPWPIHSRAAHPGWAASDIVANNGSLDQSANKAARFMRGLARRVAGPVFHAMGQTVEEGAWPLLYALASPEARDGGYYGPQGPGERRGVPGIAGLPALAHVPELAERLWTVSEQMTGVKYGLV

SEQ ID NO: 4074 - protein, 525 aa, Neurospora crassa
MVTLDEVLGSGLLQKPSGDAPEALQRQITNYKPLHTFKLEKTRPYQQQYADIYFLRLTKIRPAVEAAASAAWEGTVLGGEKVKRVERVLDVRQGELCWVAGTVYMDMPLKPSILEDVSKDRWISAPTSVGHYYSGNGEDSVMLEDDSGRIRLVGNALQNHFMVTGCIVAVMGTENANGEFEVIDLLFAELPPQPERWSLSKGKKEADSSEDVEMMDASFSRQSHKPSSKKIALVSGLEFSNADTSYAMELNLLLEYLLGEALDPSVQRDELSHITRLIIAGNSISTTAAEQAKPAAAFDTTTVTNKFQPQIKKYGYDSSSYNPVPSQLLDSFLSDLLPTMPVTLLPGALDPANASYPQQPIHPAMFPQSRTYMPPPKAGAGKDRDVPGEEEPGWFDNVTNPWEGEIEGWRVLGTGGQNLDDVFKYVESEDRLGMMEAMCRWRCVAPTAPDTLWSYPFQEDEPFVIKECPHLFFVGCQPEFGTKVIHGPDGQAVRLIAVPSFSETREVVLVDTETLDVERVKIVAE

SEQ ID NO: 4075 - protein, 484 aa, Francisella tularensis subsp. holarctica
MSQKLKRGLHTRHMSMIALGGCIGTGLFVALGGAIADAGPGGTVLAYVIIAIMVYFLMASLGEMAAHSPVSGTFCEYATRYVDSALGFSTGWSYWFNWAITVATEVIAAALIMQYWFPGSSILLWSGFFFVLVFALNIFSVKIYGEVEYWLSFIKVSTVIIFIIVGFLSILGLVGNHQSVGFQNWHIGDAPFHNGWWGFISVFMIAGFSFQGSELIGVTAGEAKDPNTSIPKAIKQTFWRLFIFYILAVVIISFLIPYNNPSLIKVGASNDVSVSPFTIVFENVGLNSAATIMNVIILTAIISACNASMYSATRVLWHLGNIKQAPQFFATTNSKGTPMIALLVTAVIGSSFFFVSFVGSGYIFTWLVNVSSLAGFIAWFTIALSHYRFRRAYIKQGKSLEDLPYVAKFFPWAPIIALTMVSIVIVGQGVTMLTMDGRTWFSVIIEFLSTYIGFFAFVILYFVYKFIKKTKLIRLEDCDLTRES

SEQ ID NO: 4076 - protein, 196 aa, Zea mays
MMQCSDKLGLSLELGSFAAGVMISTTDLAQHTLEQIEPIRNFFAALFLASIGMLINVHFLWNHVDILLAAVILVITVKTFIVAIVVKGFGYSNKTSLLVGMSLAQIGEFAFVLLSRASSIHLIEGKLYLLLLGTTALSLVTTPLLFKMIPAMVHLGVLLRWFSVDTNQVELGLKNDVLRIDSGKRINLIVQGSHDS

SEQ ID NO: 4077 - protein, 337 aa, Cryphonectria parasitica
MVVKVGINGFGRIGRIVFRNAHEHSDVEIVAVNDPFIEPHYAAYMLKYDSQHGNFKGDVTVEGSDLVVGGKKVRFYTERDPAAIPWSETGADYIVESTGVFTTTEKAKAHLKGGAKKVIISAPSADAPMYVMGVNEKTYDGSGMVISNASCTTNCLAPLAKVINDEFKIIEGLMTTVHSYTATQKTVDGPSAKDWRGGRTAAQNIIPSSTGAAKAVGKVIPELNGKLTGMSMRVPTSNVSVVDLTVRIEKGATYEQIKTAVKKAADGPLKGVLAYTEDDVVSTDMNGNPNSSIFDAKAGISLNDHFVKLVSWYDNEWGYSRRVLDLISHVAKVDGNA

SEQ ID NO: 4078 - protein, 142 aa, Yersinia pseudotuberculosis IP 32953
MALERTFSIIKPNAVANNNIGAIYARFESAGFKIIAAKMLHLTKEQAEGFYAEHKGRPFFDGLVEFMTSGPIIVQVLEGENAVQRHRDIMGATNPDNALAGTLRADFADSFTANAVHGSDAVESAQREIAYFFAADEIFPRS

SEQ ID NO: 4079 - protein, 260 aa, Brassica napus
MPQGDYIELHQKRHGRRLDYEERKRKKEARAVHKRSKQAQNSIGIKGKMIAKKNYAEKAQMKKTLKMHEESSSRRKADEDVQEGAVPAYLLDRENTSRAKVLSNTIKQKRKEKAGKWEVPLPKVRPVAEDEMFRVIRSGKRKTKQWKRMVTKATFVGPGFTRKPPKYERFIRPFGLRFTKAHVTHPELRCTFCLEIIGIKKNPNGPMYTSLGVMTRGTIIEVNVSELGLVTPAGKVVWGKYAQVTNNPENDGCINAVLLV

SEQ ID NO: 4080 - protein, 478 aa, Escherichia coli K12
MAQSKLYPVVMAGGSGSRLWPLSRVLYPKQFLCLKGDLTMLQTTICRLNGVECESPVVICNEQHRFIVAEQLRQLNKLTENIILEPAGRNTAPAIALAALAAKRHSPESDPLMLVLAADHVIADEDAFRAAVRNAMPYAEAGKLVTFGIVPDLPETGYGYIRRGEVSAGEQDMVAFEVAQFVEKPNLETAQAYVASGEYYWNSGMFLFRAGRYLEELKKYRPDILDACEKAMSAVDPDLNFIRVDEEAFLACPEESVDYAVMERTADAVVVPMDAGWSDVGSWSSLWEISAHTAEGNVCHGDVINHKTENSYVYAESGLVTTVGVKDLVVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGATHCLENPGKIPLDLIEVRSGSYLEEDDVVRFADRYGRV

SEQ ID NO: 4081 - protein, 796 aa, Pyrococcus furiosus DSM 3638
MSEKKKEVKLKVASAYQRDVGRGIVRIDRETMRELGISPGDVVEIIGTKNTAAIAWPAYPEDEGLGIIRMDGTIRKNAGVGLGDEVIVRKADVKEARKVVLAPTEPIRFGRDFIEWLHERLIGRPVVRGDYIKVGVLGQELTFVVTTTQPAGVVQITEFTDFDVSERPVKEVEKRITTGVTYEDIGGLKDVIEKIREMIELPLKHPELFEKLGIEPPKGVLLYGPPGTGKTLLAKAVANEANAYFIAINGPEIMSKYYGESEERLREVFREAEENAPAIIFIDEIDAIAPKREEVTGEVEKRVVAQLLTLMDGLKSRGKVIVIGATNRPDAIDPALRRPGRFDREIEIGIPDKQGRKEILQIHTRGMPIEPDFRKDDVLKILEELRGEEKFKDVIDRAIDQVSKAKEEEIQQVLKRISQDLYEEVKARLIDKLLEELAEVTYGFVGADLAALAREAAMAALRRLIREGKIDFEAETIPREVLEELKVTRRDFYEALKMVEPSALREVLIEIPNVHWDDIGGLEEVKQQLREAVEWPLKYPEAFRAFGITPPKGILLYGPPGTGKTLLAKAVATESQANFIAIRGPEVLSKWVGESEKRIREIFRKARQAAPAIIFIDEIDAIAPTRGTDVNRVTDRIINQLLTEMDGIVENSGVVVIGATNRPDIIDPALLRPGRFDRLILVPAPDEKARLEIFKVHTRGMPLADDVDLKELARRTEGYTGADIAAVCREAALNAMRRALEQGIIKEGMKADEIRKVAKVTMKDFEEALKKIGPSVSKETMEYYLKVQEKFKQARG

SEQ ID NO: 4082 - protein, 1079 aa, Ustilago maydis 521
MAPSLLVRSRVVASRSIRSTPLAATLRLTLGSNARLYTVAAAPAAVRAQRRGLATLSSTENAPELGARHVAKSIFAPLDTFESRHIGPRDHDSAKMLEALGYSEMEQLIADTVSPSVRLAQDASFYDQIKPLSESELAQRAETIAKMNRPFKSLIGMGYQNTLVPPVILRNVLENPAWYTSYTPYQPEISQGRLESLINFQTMVKSLTGLDLANASLLDEGTAAAEAMILAYGQTKSKRKTFLVDRGVLPQTLAVLRQRAKGFGINVVATDLRTPEGHRLPPADQIPRDDIIGALVQYPDVDGRITDWEALANEIKGFGGMVIAATDLLALTMIKPPGEWGADIALGNAARFGVPPGFGGPHAAFFAVRDSIKRKIPGRLVGLSKDARGGPAYRLALQTREQHIRREKATSNICTAQALLANMSAMYAVYHGPDGLRKIAAKTHALTRLLKHELTELGVRVVNRDGAFFDTLTIDLSKAGIGAVRIHEEAKKAEINLRRISDTRIGITLDETVSIEELTDVLNVFAYALKPAKTGEVPYKPADLIEIASRIGLDAASTETLTISTPVKVRPNNATAESSDLPPVPDFARTSKFLQQPVFSAHRSETQMLRYIHSLQAKDLSLVHAMIPLGSCTMKLNSTSSMMLISKPEFSQLHPFAPEDQAQGYDVLIRELERDLCLITGFPAVSLQPNSGAQGEFAGLSVIRAYHESKGQGKRDVCLIPTSAHGTNPASAIMAGMRVVPVKTKPDGSIDLEDLRAKAELHKNELAATMITEPATTGCYFKDIQEAFKVVHDNGGQVYLDGANLQAQVALTNPAIMGADVTHLNLHKTFSIPHGGGGPGVGPICVAEHLAPFLPGHPLASTGGEMAINPISAAPWGSASILTIAWAYIKMLGWGGLKKSTETALLAANYVAHRLKDHYKLKYTGDRGRVAHELLIDVAEFEDVGLKVMDFAKRLIDYGFHPPTCSWPISTGLLIEITESESLQEIDRLIEAFISIRHEVEEIRAGKQPKDNNLLKNAPHTMQAVTEDKWERPYSRERAVFPVNELRQNKFWPPVARIDDAFGDRVLVCECGGVEDYVN

SEQ ID NO: 4083 - protein, 129 aa, Arabidopsis thaliana
  misc_feature (27)..(27): Xaa can be any naturally occurring amino acid
  misc_feature (95)..(95): Xaa can be any naturally occurring amino acid
  misc_feature (112)..(112): Xaa can be any naturally occurring amino acid
  unsure (1)..(129): unsure at all Xaa locations
RNIRGDPRVRAQATMVAPFTEHEVFLXFPATPKAGDDITFITSNGGRVSCMKVGTPVVKHKAETLSYLPDLRDVELANEADYLPRNNSPRWVRFXLEHGFVFREHGNTSGYXDGRYWTMWKLPLFGCTD

SEQ ID NO: 4084 - protein, 267 aa, Mesoplasma florum L1
MKVEAKKKFGQNFISDQNLINKIVSILGNDKDQLIIEIGPGTGALTKLLAQKYNKVVAIEIDTDMEPILKKEITNDNFELFLSDVLLVDFEKLIKEKRQHENQKVSIISNMPYYITSEILFRTLNVSDKLTKAVFMMQKEVAIRVCSYKGENNYNNLSVACEFYADKKYEFTVPKHMFYPVPKVDSAIISLTFNNKYTEQIKDKDKFLTFLRKIFNNRRKTILNNLSNVTNDKTKANEILDNLNIDKSLRPEVVGLEDFIRIYNKTR

SEQ ID NO: 4085 - protein, 469 aa, Salmonella typhimurium LT2
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLLIGKKRMAGMR

SEQ ID NO: 4086 - protein, 494 aa, Gluconobacter oxydans 621H
MENDTKTVRTGRDHIDPASIEVSSNAKLMLILAAVVAAICGGLYGYDTGIISGTLPLIGDDFRLGATMKEWVASAILLGAIFGAFAAGGLSEKFGRRNTTCMVSGLFVVGATACSLAPDVWSLIGARFVLGLAVGGSTQVVPMYISELAPQERRGTLVTMFNVAIGLGILIANIIGFTERVNWGWRPMVGVAAIPAAIVFISMFFMPKSPRWTAENEGMKSAIIQLGRIRTTKRAIRREVQTIRENAEGIDPKNRGWRGLFQPWVRPALVAALGVAFFTQCGGLEMMIYYTPTFLNDAGFGTSSALLASLGVAVIYCIMTFLGCMFVDRIGRRRLMLIMGPGAALSLVGLGVMFLSHPAPGSVGAYMIVVFLLLFMMFNSGGIQVCGWLLGAEMFPLSMRGQATSLHAATLWGADLLVTSTALSMAEAIGLSWTMWFYAFVNLASVVFVFFFVPETAGASLEDIEEALLEKRFRPTPGNTRIVQSDDGDAEAAA

SEQ ID NO: 4087 - protein, 216 aa, Arabidopsis thaliana
MAEKEKKTKKKKKKEKHQSSDISFKPSSDVKGLKFGGQIIVKSFTIRRARTFELLKLLSLPSSSSPPLLSTAAYLPTNFTILAHHAWHTLTLGLGTRKSKVVVFVFETEAMKSSVVAAEGGIWPSEIPLGDVNKKMIRKLKNWEMARFKFRKGCITFYVYAVRNAGNEGFAAAEDLKVILQAVVALKDFMDHTAMLVMPHQKSINYSSCPPFAMAH

SEQ ID NO: 4088 - protein, 478 aa, Haemophilus influenzae 86-028NP
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLTSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 4089 - protein, 459 aa, Bacillus cereus ATCC 10987
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFQKYMNNGLEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLVRK

SEQ ID NO: 4090 - protein, 536 aa, Glycine max
  misc_feature (416)..(416): Xaa can be any naturally occurring amino acid
  unsure (1)..(536): unsure at all Xaa locations
MASNTNTNNSNKKEKDLEFFFEEDINELGAQQMDAETAKLESESSSSDDEGNDTTRRHSFTSQQWPQSYKETTDSYTLAATPNFESILRVPSIIYSSFESRSKNNLDIVRKTPFLSGHEGITQSTSWKEGLVQKHLSGELPIGRECSFLQTVFNATNVMAGVGILSTPYTLKEAGWMSMVLMILFAVICCYTATLMRYCFESREGITSYPDIGEAAFGKYGRIIVSIILYTELYSCCVEFITLEGDNLTGLFPGTSLDLGSFRLDSVHLFGILAALIIIPTVWLKDLRIISILSAGGVFATLLIVVCVFCVGTINGVGFHHTGQLVNWSGIPLAIGIHGFCFAGHSVFPNIYQSMADKRQFTKALIICFVLSITIYGGVAIMGFLMFGGETLSQITLNMPRDAFASKVALWTTARXINPFTKYALLMNPLARSLEELLPDRISSTYRCFILLRTALVVSTVCAAFLIPFFGFVMALIGSLFSVLVSVVMPSLCFMKIVGKKATGTQVALSVVITTFGVICGILGTYSSVQNIVNSY

SEQ ID NO: 4091 - protein, 460 aa, Bacillus cereus ATCC 10987
MSTKMTPPVEKNEFIDVVFEDLTHDGAGVAKVKGYPIFVKNGLPGEEAQIKIIKVKKNFAFGRLMKLHTESPYRKDAECPVYNQCGGCQLQHLTYEGQLQAKEKQVRDVMQRIGGLSDVPVHPVLGMKNPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIATKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVVLMSRVEK

SEQ ID NO: 4092 - protein, 267 aa, Arabidopsis thaliana
MGSAFDPLVTATEDLAAVNSAPPLSNLTQEELKKIAAYKAVEFVESGMVIGLGTGSTAKHAVARISELLREGKLKDIIGIPTSTTTHEQAVSLGIPLSDLDSHPVVDLSIDGADEVDPALNLVKGRGGSLLREKMIEGASKKFVVIVDESKLVKYIGGSGLAVPVEVVPFCCDFTRGKLEELFRDSGCVAKLRMKIGSNGEEAAPAVTDNGNYVVDLYLERDIGDLEVASEAILRFPGVVEHGMFLGMATTLIVAGKFGVTVKDRFG

SEQ ID NO: 4093 - protein, 223 aa, Zea mays
MLKRLLTKTKSKKKKEAASSAIPTLDRLHETLEMLEKKERFLQKKCSAEIEKAKDYTKAKNKNAAIQCLKKKKLYETQIEQLSNFQLRVHDQIIMLESAKATTDTVDALRSGSSAVKAMQQSVNVDDIEKAIEEANEQTESMREMQQALATPIGASADFDEDELEAELEELEEEEEEEGEIEDELPEPPARRSVEPSAKAAAASSRQGSDVSELTRLQAEMAL

SEQ ID NO: 4094 - protein, 332 aa, Brassica napus
KQPPLAPSSLISLPRHKVSSLRSPSLLLQSQRPSSALMTTTTASSRGSVAVTAAATSSVEALREGIAEFYNETSGLWEEIWGDHMHHGFYDPDSSVQLSDSGHREAQIRMIEESLRFAGVTEEEKKIKRVVDVGCGIGGSSRYIASKFGAECIGITLSPVQAKRANDLALDQSFSDGIFDLVWSMESGEHMPDKAKFVKELVRVAAPGGRIIIVTWCHRNLSQGEEALQPWEQNLLDRICKTFYLPAWCSTSDYVDLLQSLSLQDIKCADWSENVAPFWPAVIRTALTWKGLVSLLRSGMKSIKGALTMPLMIEGYKKGVIKFGIITCQKPL

SEQ ID NO: 4095 - protein, 84 aa, Zea mays
  misc_feature (19)..(19): Xaa can be any naturally occurring amino acid
  misc_feature (24)..(26): Xaa can be any naturally occurring amino acid
  misc_feature (31)..(31): Xaa can be any naturally occurring amino acid
  misc_feature (38)..(38): Xaa can be any naturally occurring amino acid
  misc_feature (45)..(46): Xaa can be any naturally occurring amino acid
  misc_feature (49)..(49): Xaa can be any naturally occurring amino acid
  misc_feature (51)..(51): Xaa can be any naturally occurring amino acid
  misc_feature (54)..(54): Xaa can be any naturally occurring amino acid
  misc_feature (61)..(61): Xaa can be any naturally occurring amino acid
  misc_feature (64)..(64): Xaa can be any naturally occurring amino acid
  misc_feature (72)..(72): Xaa can be any naturally occurring amino acid
  misc_feature (74)..(74): Xaa can be any naturally occurring amino acid
  misc_feature (77)..(77): Xaa can be any naturally occurring amino acid
  unsure (1)..(84): unsure at all Xaa locations
NPNRDLRSSKPYLAMDGGXGGGGXXXGVGAXVMVGGGXLPGGGGXXLEXVXKTXQFEHKLXYFXLKENPRGXYXKIXEKTLGTR

SEQ ID NO: 4096 - protein, 223 aa, Pseudomonas syringae pv. tomato str. DC3000
MTQDQLKQAVAQAAVDFILPKLDDKSIVGVGTGSTANCFIDALAKHKGAFDGAVASSEATAARLKGHGIPVYELNTVSDLEFYVDGADESDEHLNLIKGGGAALTREKIVAAVAKTFICIADGSKLVPVLGAFPLPVEVVPMARSHVARQLVKLGGDPVYREGVLTDNGNIIIDVHNMSITNPVELEASINAIVGVVTNGLFAARPADLLLLGTAEGVKTLTR

SEQ ID NO: 4097 - protein, 677 aa, Arabidopsis thaliana
  misc_feature (194)..(194): Xaa can be any naturally occurring amino acid
  unsure (1)..(677): unsure at all Xaa locations
MIPLSFAALGDIVDKKLDEDYVKEEVEMMIQVSLLSTQAAPGERPTMSEVEIFRNSCLCYINWFCNIISIIYSNSLLLRIDSGSSSISVVFLVFTLSRMEQRRMLTAARPRLSSTIRTITSHVAFSASRLLKPYVAYRLGLEDANQRKTENESTGGDKEIANSLLHCLKFHYLLLHFPSFSLQIHNRSTSLSLXRFEKMAKLVMLLVLCILPAIAMAARRGNIGKNTMVVQGSTYCDICKFGFETPESSYFIPGATVKLSCKDRKTMEEVYTDKAVSDKEGKYKFIVHDDHRDQMCDVLLVKSSDKTCSKISVGREKSRVILNHYSGIASQIRHANNMGFEKEVRMATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 4098 - protein, 284 aa, Lactobacillus plantarum WCFS1
MANIQWYPGHMAKAIHQIQDNLHLVDIVFELVDARIPVASRNPEIEKTVQQKPHLLIMTKKDLADPQATADWVKYYEDQGQVAIAVDSRSRTIGKQMTQAASDMLADKLAKIAARGITNRPIRAVCVGIPNVGKSTLLNHIVNKKIAKVGDRPGVTKGQQWLKASNKLELLDTPGILWPKFEDQVVGTKLAVTGAIKENIYPNDDVALFALDFFKQHYAARLVDRYHLTAEQLTLPNPELLIAMTKNAGMRDDWERFCVAFLLDIRKGRLGRFTLDLTGDQPDA

SEQ ID NO: 4099 - protein, 474 aa, Glycine max
  misc_feature (93)..(93): Xaa can be any naturally occurring amino acid
  unsure (1)..(474): unsure at all Xaa locations
EQGQSWVARPVAGPNSVGLVSRKGSMANPSSLVDPLVTLFGSVHEKLPETGSTLFPHFGSMFSVGGNQPRNEDWDEESLAREGDDYVSDAADXDSDDNLQSPLISRQTTSLDKDIPPPAHSNLASMRQGSLLHGNAGEPTGSTGIGGGWQLAWKWSEREGPDGKKEGGFQRIYLHQDGGSGSRRGSVVSLPGGDLPTDGEVVQAAALVSRSALYNKDLMCQRPVGPAMIHPSETIAKGPSWSDLFEPGVKHALIVGVGMQILQQFSGINGVLYYTPQILEQAGVGYLLSNLGLGSTSASFLISAVTTLLMLPCIAIAMRLMDISGRRTLLLSTIPVLIVALLILVLGSLVDLGTTANASISTISVIVYFCFFVMGFGPIPNILCAEIFPTRVRGLCIAICALTFWICDIIVTYTLPVMLNSVGLAGVFGIYAVVCFIAWVFVFLKVPETKGMPLEVIIEFFSVGAKQFDDAKHN

SEQ ID NO: 4100 - protein, 409 aa, Pseudomonas syringae pv. tomato str. DC3000
MSKTSLDKSKIKFLLLEGVHQSAVDVLKAAGYTSIEYHTKSLPEAELKEKIADAHFIGIRSRTQLTEELFDSAKKLVAVGCFCIGTNQVDLNAARERGIAVFNAPYSNTRSVAELVLAEAILLLRGIPEKNASCHRGGWIKSAANSFEIRGKKLGIVGYGSIGTQLSVLAEGLGMQVYFYDTLTKLPLGNATQVSSLNELLGMSDIVTLHVPETTETQWMIGEKEIRAMKKGSILINAARGTVVELDALADAIKDKHLIGAAIDVFPVEPRSNDDIFESPLRGLDNVILTPHIGGSTAEAQANIGLEVAEKLVKYSDNGTSVSSVNFPEVALPAHPGKHRLLHIHENIPGVLSEINKVFAENGINISGQFLQTNEKVGYVVIDVDAEYSDLAQAKLQHIKGTIRSRVLF

SEQ ID NO: 4101 - protein, 144 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4102 - protein, 566 aa, Methanococcus maripaludis S2
MVPDVFIEVSLVIFIAFFISLVMRMLKQPLIIGYILTGILVSPYFLNIVRFEESISTLGHYGVTILLFMVGISLNPGYFKEIGKISLITGLGQILFTFSIGFLISVFLGYSLIESMYISIALTFSSTIIIMKLISDKGDIDKLYGKISIGFLIVQDIVAMAILVLISAFNVQSGAGELLFLIISKIVLILTAIYIFTKYALSNFISYASKNQEFLFLFSLMWCFTLASLFHLLGFSSEIGALIAGIVLAIFPERYEIASKVRPLRDFFLILFFVVLGVQMTFETSGNFIIPAIILSIFVLFGNPIIVMILMGAFGYTKKTGFLAGLTVAQISEFSLIIASLGLRNGHISQEIVSMITLIGIMTIAGSSYFITYSERIYALLSNYLSIFEKKTKISEKDFKNKNTGEIILFGADRTGKNILNVIENSKERFLIIDYNPKIIKNLSKRGYNSVYGDASNLELLNELNFKESKMLISTISDIETDILLIKTILKSNKNAIIIVIAHKIEDAIKLYEEGASYVIMPHFLGSIHASLMIQKYGLNIEEFLKEKSNHIESLKKSQELFRHTK

SEQ ID NO: 4103 - protein, 264 aa, Fusobacterium nucleatum subsp. nucleatum ATCC 25586
MEFKHKKKYGQNFLNNKDEILNKIIEVSNIDDNDEILEIGPGQGALTSLLVERVKKITCVEIDKDLENTLRKKFSSKENYTLVMEDVLEVDLRRYINQGTKVVANIPYYITSPIINKIIENKDLIDEAYIMVQKEVGERICAKSGKERGILTLAVEYYGESEYLFTIPREFFNPIPNVDSAFISIKFYKDDRYKNKISEDLFFKYVKAAFSNKRKNIVNNLVTLGYSKDKIKEILNQIEISENERAENISIDKFIELIKIFEGR

SEQ ID NO: 4104 - protein, 376 aa, Colwellia psychrerythraea 34H
MSDKFIKSKAAIAWGPNQPLSIEEVDVMLPREGEVLVKVVASGVCHTDAFTLSGDDPEGIFPVILGHEGGGIVEQIGAGVTSVKVGDHVIPLYTPECGECKFCLSGKTNLCQKIRETQGKGLMPDGTTRFYKDGQPIFHYMGCSTFSEYTVLPEISLAKVNKDAPLEEVCLLGCGVTTGMGAVMNTAKVEEGATVAIFGLGGIGLSAVIGATMAKASRIIAIDINESKFELAKKLGATDFINPKDYDKPIQDVIVEMTDGGVDYSFECIGNVNLMRSALECCHKGWGESVVIGVAGAGQEISTRPFQLVTGRVWRGSAFGGVKGRTELPDYVERYLAGEFKLSDFITHTMPLEDINESFELMHKGESIRSVIHFDK

SEQ ID NO: 4105 - protein, 460 aa, Alkalilimnicola ehrlichei MLHE-1
MPFIPHTEAEVRRMLEVIGVRHLDALFDEIPAALRAPPPQGVPEGLPEMAVRRIARRRAAQDRQPVSFLGAGCYEHHIPAAVWQIAARGEFYSAYTPYQAEASQGTLQVIYEFQSMLSALTGLAVSNASLYDGATATAEAALMAVRQRRRDAAHRVLVPHTLHPLYRRVLSTLLAPQGIELTLLDYDPDQGHLPEHALEGVSGGFDALLLPQPNFLGVLEPVDTLTRAAQARGALVIGVVNPIALARLAPPGEWGEAGADIACGEGQPLGIPMSSGGPGFGFLTCRRPLMRQLPGRLVGRTVDLDGKPGYTLTLQAREQHIRRGRATSNICTNQGLMATAATLYLALLGPDGLERVADCCLARTHALVEALTGLPGVQSALRGPHFHEAVLRLDRPVAPVLQALEDHGILGGHDLSADYPELGNALLVCATEMRDEVDIEYYRDSLAAVLNTRPDPVPSP

SEQ ID NO: 4106 - protein, 393 aa, Chara vulgaris
MAKTKQIKNLTFNFGPQHPAAHGVLRLVLEMNGEVVERAEPHIGLLHRGTEKLIEYKTYLQALPYFDRLDYVSMMAQEHAYSLAVEKLCNCEVPLRAQYIRVLFCEITRILNHLLALTTHAMDVGALTPFLWAFEEREKLLEFYERVSGARMHASYIRPGGVAQDLPLGLSEDLFLFSQQFASRIDEVEEMLTNNRIWKQRLVDIGTVTAQQAMDWGFSGVMLRGSGVSWDLRKAAPYDVYDKVEFDVPVGTRGDCYDRYCVRIEEMRQSLRIIVQCLNQMPSGMIKADDRKLCPPSRSQMKQSMESLIHHFKLYTEGVSVPASSTYTCVEAPKGEFGVYLVSNGTNRPYRCKIRAPGFAHLQGLDFMSKHHMLADVVTIIGTQDIVFGEVDR

SEQ ID NO: 4107 - protein, 188 aa, Brassica rapa
LDNPAPFVSPFQFEISYECLTSLQDDLEWKLVYVGSAEDETYDQTLESVLVGPVNVGNYRFVLQADPPDPSKIREEDIIGVTVLLLTCSYMGQEFLRVGYYVNNDYEDEQLREEPPTKVLLDKVQRNILSDKPRVTKFPINFHPEDEQTPAAADPPPPTEQSDDQQQADDNCDEAQVLPEQPPIPHES

SEQ ID NO: 4108 - protein, 947 aa, Sulfitobacter sp. EE-36
MVFKPTEYLPYDFANRRHIGPSPAEMSDMLKTVGAQSLGALIDDTMPAQIRQKEPLDFGKPMSEREVLEYMRVVAGKNKVLTSLIGQGYHGTVTPPAIQRNIFENPAWYTAYTPYQPEISQGRLEALLNFQTMVSDLTGLEVANASLLDEATACAEAMTMAMRLSKSKAKAFFVDRDCHPQNIAVIQTRAAPLDIEVIIGDPDKMDASAVFGALFQYPGTYGHVRDFTDHMAALHEAGALGVVSADPMALTLLKEPGAMGADIAVGSTQRFGVPEGYGGPHAAYMACKDAYKRAMPGRIVGVSIDAHGNRAYRLSLQTREQHIRREKATSNVCTAQALLAVMASMYAVFHGPEGLKAIAQRIHRKAVRLANGLEEAGFKVDPKSFFDTVTVDVGPLQAAVMKSAVDEGINLRRVGETRVGITLDERTVPETIEAVWRAFGIRRSDETFEAQYRFPDDMLRESAYLTHPIFHMNRAETEMMRYMRRLADRDLALDRAMIPLGSCTMKLNSAAEMMPVSWREFSMIHPFVPQDQALGYKHMIDDLSAKLCDITGYDAISMQPNSGAQGEYAGLLAIASYHRANGQGHRNICLIPMSAHGTNPASANMVGWKVVVIKTAANGDIDLDDFRAKAEKHSENLAGCMITYPSTHGVFEETVTEVTKITHDHGGQVYIDGANMNAMVGLARPGDVGGDVSHLNLHKTFCIPHGGGGPGMGPIGVKSHLIPHVPGHPNGGEGAVSAAPYGSPSLLPISWSYCLMMGGDGLTQATRVAILNANYIAKRLEGAFEVLYKGPTGRVAHECIFDVRPFEDSAGVTVDDIAKRLIDAGFHAPTMSFPVAGTLMVEPTESETKAELDRFCDAMLAIRDEIRAIENGDMPRENNALKNAPHTVEDLVGEWDRPYTREQGCFPPGAFRVDKYWPPVNRVDNVHGDRNLICTCPPMEEYAEAAE

SEQ ID NO: 4109 - protein, 470 aa, Corynebacterium diphtheriae
MTEHTAPTLTKGLKVRHLTMMGLGSTIGAGLFLGTGVGIKAAGPAVLIAYIIAGFIAVMIMRMLGEMGSVVPASGSFSEYADAGIGHWAGFIQGWVYWLATVAVLGAEITGASGFVASWLGVSPWIPALVFVAFFGLVNLMRVRAFGEFEFWFAFIKVAVLVVFLIIGSLLVLGLLPNHDFVGLSNVRAEGFAPTGLGGIAAALLAVAFGFGGIEVVAIASAESEDPQKSLVNAVRTTITRISIFYLGSVAIIVLLLPYSSLGKAKSAAESPFSQVLAMANIPGVVGVIEVVIVLALLSAFNAQIYASSRMMMSLAERRQAPNIFARVDNRGVPLPAIVLSVVLSVIMVILNYVDTGWLLTFLLNAAGASLLTVWTFIAVSQLKLRRRLEALQGNLAVRMWAFPGLTIATLAILFGLAILMLSDAGARIELLSAIAMVAILFAISLIAVKQPFDKALLPREASYPQNSPS

SEQ ID NO: 4110 - protein, 454 aa, Corynebacterium diphtheriae
MTQATTETELGTGLKTRHLTMMGLGSAIGAGLFLGTGVGIAAAGPAVLIAYVLAGIFVVFVMQMLGELAAARPASGSFSVYAEQAFGHWAGFSLGWLYWFMLTMVLGAEMTGAAAIMGQWFGIAPWIPALICVIFFAVVNLARVSGFGEFEFWFAFIKVAVIILFLVIGVLLIFGLLPNYDFVGTQHFLGDGFMPNGISGVATGLLAVAFAFGGIEIVTIAAAESEDPKTAIATAVRSVIWRISLFYLGSVLVICFLIPFSSIGGAKSAADSPFTIILGMANIPGVVGFMEAVIVLALLSAFNAQIYATSRIVHSFAERGDAPKIFAATNPSGVPMPAVLLSMFFAFVSVGLQYWNPAGLLNFLLNAVGGCLIVIWVIIAFAYLKLHPELVRNGEITTVRMWGFPWLGWVTIAGFLGLTVLMLTDDASRSQITSVTVVFLLLIVVSFFTKKKSK

SEQ ID NO: 4111 - protein, 557 aa, Triticum aestivum
  misc_feature (349)..(349): Xaa can be any naturally occurring amino acid
  unsure (1)..(557): unsure at all Xaa locations
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGXRTFACSETVKFGHVTFFWNGNRSGYFDETREEYVEIPSDSGITFNEQPKMKALEIAEKTRDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSEIQTPGLAKIAATVMNLHGFQAPADYETTLIEVVDK

SEQ ID NO: 4112 - protein, 332 aa, Salmonella typhimurium LT2
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 4113 - protein, 378 aa, Medicago sativa
MAIHHHHQQHTCSLFDALYCDEEKWEDDEGEVVDEGEQSDVTTTNYDILDSTSLLPLLLLEQNLFNEDEELNTLFSKEKIQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDHIIRRLGLKTNLHWEFLRRCENLLLSVLLDSRFVGCVPSVLATATMLHVIDQIEQSDDHGVDYKNQLLNVLKTSKEKVDECYNAILHLTNANNYGHKRKYEEIPGSPSGVIDAVFSSDGSNDSWTVGASSYSTSEPVFKKTKNQGQNMNLSPINRVIVGILATATSP

SEQ ID NO: 4114 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPNTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLFETWERSTSLLVTGRVDLSSLVSHRLPLSAAEDAFEMALNGESLKILFEPNGTCI

SEQ ID NO: 4115 - protein, 353 aa, Zea mays
ICVCCFADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 4116 - protein, 222 aa, Medicago sativa
MAIHHHHHNHQQLQQHTSSLFDALYCDEEEKWEDDEGEVVDEGEQSDVTTTNYDILDSTSLLPLLLLEQNLFNEDEELNTLFSKEITQQETYYEDLKNVINFDSLSQPRREAVEWMLKVNAHYGFSALTATLAVNYLDRFLLSFHFQKEKPWMIQLVAVTCISLAAKVEETQVPLLLDLQVQDTKYVFEAKTIQRMELLILSTLKWKMHPVTTHSFLDPGNS

SEQ ID NO: 4117 - protein, 498 aa, Rhodococcus sp. RHA1
MRSEEALTSTQTSQQALLEAVPTGLYIGGQWRPSETGNTFPVHDPATGRELAVVADATVADGATALDAAATAQKAWSRTAPRERAELLRAAFDAVIARSDDFAMLMTLEMGKPLAEARGEVTYGAEFLRWFSEEAVRVSGRYSAAPDGKTRLLVHKRPVGPCLFITPWNFPLAMATRKIAPAIAAGCTMVVKPATLTPLTTLLFAQVLEEVGLPAGVLNVIPTSRAGAVTGPLIADPRLRKLSFTGSTEVGRRLLADSAEQVLRTSMELGGNAPFLVFADADIDAAVDGAVIAKLRNMGEACTAANRFIVHESVADEFATKLAGKMARLVVGPGIDADSQLGPLIDEESRAKVHDLVQDAVAHGAAIVTGGRPVPGDGYFYSPTVLTGVTTDARILREEVFGPVAPIMTFQDEEHAIQVANDTEYGLVAYVYTRDTARTLRMSEELESGMLGINVGVVSNPAAPFGGVKQSGLGREGGFEGIDEYLDIRYVGLADPYA

SEQ ID NO: 4118 - protein, 708 aa, Glycine max
FYGKVVSGSDGKKHWIGGEDIKAVAHDVPIPGYKTKTTINLRLWSTKAASEEFDLSAFNAGRHTEASEALANAEKICYILYPGDEPIEGKILRLKQQYTLCSASLQDIIARFERRSGANVNWEEFPEKVAVQMNDTHPTLCIPELMRILIDVKGLNWKDAWNITQRTVAYTNHTVLPEALEKWSLDLMQKLLPRHIEIIEMIDEELVRTIIAEYGTENSDLLEKKLKEMRILENVELTAEFADILVKSKEAIDIPSEEQQSSEQAEAEDEKDDDEVEAVAKKNGTDESSIEDEKEELPEPVPEPPKLVRMANLCVVGGHAVNGVAEIHSEIVKDDVFNAFYKLWPEKFQNKTNGVTPRRWIRFCNPDLSKIITEWIGTEDWVLNTGKLAELRKFVDNEDLQVQWREAKRSNKVKVAAFIREKTGYSVSPDAMFDIQVKRIHEYKRQLMNIFGIVYRYKKMKEMSAAEREANFVPRVCIFGGKAFATYVQAKRIVKFITDVGATVNHDPEIGDLLKVVFVPDYNVSVAEMLIPASELSQHISTAGMEASGTSNMKFAMNGCILIGTLDGANVEIREEVGADNFFLFGAKAHEIAGLRKERAEGKFVPDPRFEEVKEFVRSGVFGSYNYDELMGSLEGNEGFGRADYFLVGKDFPSYIECQEKVDEAYRDQTKWTRMSILNTAGSYKFSSDRTIHEYAREIWNIEPVQLP

SEQ ID NO: 4119 - protein, 244 aa, Oxyrrhis marina
TFNVPAMYVQIQAVLSLYASGRTTGVVMDSGDGVSHTVPIYEGYALPHAMFRLDLAGRDLTEYMMKLLTERGYSFTTTAEREIVRDVKEKLCYVALDFDSEMKAASESSDKEKTYELPDGNIITVGNERFRCSEVLFQPSFLGKESSGIHDTVFKCVMQCDVDIRKDLYANVVLSGGTTMFPGIGERMTKELTALAPSTMKIKVVAPPERKYSVWIGGSILSSLSTFQQMWISKQEYDESGPTI

SEQ ID NO: 4120 - protein, 268 aa, Vicia faba
MEFAHLTVLSLFCLAFVGITATSSGEDYWQSIWPNTPLPKTFSDLLIPSGKTNSLPIKSEELKQYSTLFFEHDLHPGKNFILGNTNSVGSIIRPFTKSRQGVTDSIWLANKEKQSLEDFCYSPTAIAEHKHCVSSLKSMIDQVISHFGSTKIKAISSNFAPYQDQYVVEDVKKVGDNAVMCHRLNFEKVVFNCHQVRDTTAYVVSLVASDGTKTKALTVCHHDTRGMNPELLYEALEVTPGTVPVCHFIGNKAAAWVPNHTADNLCVM

SEQ ID NO: 4121 - protein, 256 aa, Bifidobacterium longum NCC2705
MGARGCRLNRMTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 4122 - protein, 303 aa, Saccharomyces cerevisiae
MTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 4123 - protein, 399 aa, Acidobacteria bacterium Ellin345
MSSATSQLTLSPAARMNRIEISATLAVVNEAEKLRSAGVDLVDFGAGEPHFGTPQHIREAAIAAIHNNFSKYTAVAGTAELRDAIAKRHATDFATDYKREEVIASVGGKHALFNAIQVLVDHGDEVIIPVPYWVSFKDMVQYSGGKPVFVEADESQNFRLTAAMVEKAVTPKTKLIILNSPSNPSGAVMAPEDMKSIARFAYERGIWVISDECYVYLNYTGEEFSLGSLTEVKERLLVVGSLSKTYAMTGWRLGYTLAPAAVVSQMQKLQSQSTSNPTSIVQKAAVAALNGPQECVAEMRADYIKLRDEIVSGLRSIPGVKCTMPQGAFYAYPDISCAFGKAGMNSAADVAKKLLHEAHVVSVPGEAFGTTKHIRLSYAASHENVARGLERMHKFFASL

SEQ ID NO: 4124 - protein, 601 aa, Salmonella enterica subsp. enterica serovar Paratyphi A str.
MEGADLLTAGVLFLFAAVAAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAVVGGIGLAMSSTAMALQLMREKGMNRSESGQLGFSVLLFQDLAVIPALALVPLLAGSADEHFDWFKVAMKVLAFAVMLIGGRYLLRPVFRFIAASGVREVFTAATLLLVLSAALFMDALGLSMALGTFIAGVLLAESEYRHELENAIDPFKGLLLGLFFISVGMSLNLGVLYTHLLWVAASVVILVVIKMLTLYLLARLYGIRSSERMQFASVLSQGGEFAFVLFSTASSQRLFQGDQMALLLVTVTLSMMTTPLLMKGIDKWLSRRLNGPEENDEKPWVEDDKPQVIVVGFGRFGQVIARLLMANKMRITVLERDIGAVNLMRKYGYKVYYGDATQVELLRSAGAEAAESIVITCNEPEDTMKLVALCQQHFPHLHILARARGRVEAHELLQAGVTQFSRETFSSALELGRKTLVSLGMHPHQAQRAQLHFRRLDMRMLRGLIPEHSDMVQISRAREARRELEEIFQREMQQERRQLDGWDEFE

SEQ ID NO: 4125 - protein, 312 aa, Bacillus halodurans C-125
MENRRIVIITGANSGIGKEAAQRFANEGDHVIMACRNIAFSRKVQHDIIAASGNDHVDLLELDVSSFASIRTFCTTFNSQYKRLDILIHNAAYFNHGEPYRLSPDGIELTFATNVFGPYLLTSLLRDRLKQSEDPRILHAGSNIIKHFFDPKQTFDLDLLQGNHGTKSYSVYKMYCQSKMALMLLTFQMAEVFADDGIKVNALQINGAKMSKRTIQKVKPWWRPIAWGQNLFFPPPSYMADKYFTICTSDKYKQTTGKLFNDKLEIMEPSPTHYPGFFKQMKLLLGSNVYPAYENTNIREKLWALCKELVGE

SEQ ID NO: 4126 - protein, 248 aa, Clostridium perfringens SM101
MRTPIIAGNWKMHYTIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAIGTGKTATSDQANETIAAIRAMVAEMFGQEVADKVRIQYGGSVKPNTIAEQMAKSDIDGALVGGASLVAADFAQIVNY

SEQ ID NO: 4127 - protein, 235 aa, Bryopsis maxima
MAVRLGVIAIIVAAILVPSYAVDFDFFYLTRQWAGGVCKHSHKQLDTEENRRTCTRYPDDDIFTIHGLWPNREDGTWPSYCDDSAKFDGDLGKDLLEELSSEWPSYYGSNYGFWKHEWEKHGTCAGPLIADERDYFDKTLELKEKYDLMDALTAAGITPSTEEIYSRQGFEDAIKAATGAKPVLLCSGKNPATLTEIWMCFSKDLKPINCTAGTSSRCRDLRFLPISRTHSTTYS

SEQ ID NO: 4128 - protein, 477 aa, Salmonella typhimurium LT2
MSTSDSCYNTGYILRICAIAALGGILFGYDTAVISGAIGSLTSYFHLSPAETGWAVSCVVVGCVIGSFSAGYLSKRFGRKKSLMVSALLFTISAVGTSLSYTFTHFVIYRIIGGLAVGLAATVSPMYMSEVSPKNMRGRALSMQQFAIVFGQILIFYVNYKIASIAADTWLIELGWRYMFAAGIIPCILFCILVFLIPESPRWMMMIGREEETLKILTKISNEEHARHLLADIKTSLQNDQLNAHQKLNYRDGNVRFILILGCMIAMLQQVTGVNVMMYYAPIVLKDVTGSAQEALFQTIWIGVIQLIGSIIGAMIMDKMGRLSLMRKGTIGSIIGLLLTSWALYSQATGYFALFGMLFFMIFYALSWGVGAWVLISEIFPNRMRSQGMSISVGFMWMANFLVSQFFPMINENPYLLSHFHGAFPMWIFAICCIFSYFFICRYLPETKGISLEKMESVVLAKRRKKLQPIQTERYSD

SEQ ID NO: 4129 - protein, 478 aa, Salmonella typhimurium LT2
MSQRSKYNSAYVYVLCCIAALAGLMFGYSTAVITGVVLPLQQYYQLTPTETGWAVSSIVIGCIIGALVGGKIADKLGRKPALLIIAIIFIASSLGAAMSESFMIFSLSRIVCGFAVGMAGTASTMYMSELAPAEIRGKALGIYNISVVSGQVIVFIVNYLIAKGMPADVLVSQGWKTMLFAQVVPSIAMLAITLFLPESPAWCARNNRSEARSIKVLTRIYSGLTATDVAAIFDSMKETVRSQDNVAGGERTNLKSSPVLRYILLVGCCIAVLQQFTGVNVMNYYAPLVLQNSSTEVVMFQTIFIAVCNVVGSFIGMILFDRYGRIPIMKIGTIGSIVGLLIASYGLYTHDTGYITIFGILFFMLLFAVSWSVGAWVLISEVFPEKIKGFGMGLAVSLMWIANFLISLLFPVINDNAWLQETFGGAFSMWIFVVFNLVCYVFISRYVPETKGVPLTEIERLAENKLREIQGKRRDVIA

SEQ ID NO: 4130 - protein, 335 aa, Brucella melitensis 16M
MAVRVAINGFGRIGRNILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLYGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 4131 - protein, 458 aa, Oryza sativa
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFWDIVTNYADILFANANEARAFCELSSTDSPMSAARYLSHSVPLVSVTDGVHGSYIGVKGEAIYIPPPPCVPIDTCGAGDAYASGILYGILRGSSDLKSIGLLASRVAAIVVAQQGTRLRVQDADRLAESFTLHLDNLEFCSDIETDHVSNF

SEQ ID NO: 4132 - protein, 1141 aa, Arabidopsis thaliana
  misc_feature (215)..(215): Xaa can be any naturally occurring amino acid
  misc_feature (278)..(278): Xaa can be any naturally occurring amino acid
  unsure (1)..(1141): unsure at all Xaa locations
MDFASSVQRQSMFHGGADFASYCLPNRMISAKLCPKGLGGTRFWDPMIDSKVRSAIRSERNVSYRSSLTLNADFNGRFYGHLLPAKPQNVPLGFRLLCQSSDSVGDLVGNDRNLEFAEGSDDREVTFSKEEKDTREQDSAPSLEELRDLLNKATKELEVASLNSTMFEEKAQRISEVAIALKDEAASAWNDVNQTLNVVQEAVDEESVAKEAVRXATMALSLAEARLQVALESLEAEGYNTSEESEVRDGVKDKEEALLSAKADIKECQENLASWGEXLRRLQVKKDELQKEVDRLNEAAERAQISALKAEEDVANIMVLAEQAVAFELEATQRAERDLVVVGVSSDVGTQSYESDNENGKPTADFAKEAEGEAEKSKNVVLTKKQEVQKDLPRESSSHNGTKTSLKKSSRFFPASFFSSNGDGTATVFESLVESAKQQWPKLILGFTLLGAGVAIYSNGVGRNNQLPQQPNIVSTSAEDVSSSTKPLIRQMQKLPKRIKKLLEMFPQQEVNEEEASLLDVLWLLLASVIFVPLFQKIPGGSPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQGIMTPQLSSLLFLVVGISMALTPWLAAGGQLIASRFELQDVRSLLPVESETDDLQGHIIICGFGRIGQIIAQLLSERLIPFVALDVSSDRVAIGRSLDLPVYFGDAGSREVLHKIGADRACAAAIALDTPGANYRCVWALSKYFPNVKTFVRAHDVDHGLNLEKAGATAVVPETLEPSLQLAAAVLAQAKLPTSEIATTINEFRSRHLSELAELCEASGSSLGYGFSRSTSKPKPPSPSETSDDNQIIEGTLAYLTLFSRFWVPHKFQLLFA

SEQ ID NO: 4133 - protein, 143 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 4134 - protein, 452 aa, Pseudomonas syringae pv. tomato str. DC3000
MSTNLDQLTDWLKEHKITEVECMVSDLTGITRGKISPTNKFIAEKGMRLPESVLLQTVTGDYVEDDIYYELLDPADIDMICRPDQNAVYLVPWAVEPTAQVIHDTYDKQGNPIELSPRNVLKKVLKLYADQGWQPIVAPEMEFYLTKRSDDPDYPLQPPIGRSGRPETGRQSFSIEAANEFDPLFEDVYDWCELQNLDLDTLIHEDGTAQMEINFRHGDALSLADQILVFKRTMREAALKHDVAATFMAKPMTGEPGSAMHLHQSIIDIETGKNIFSNEDGTMSELFLNHVGGLQKFIPELLPLFAPNVNSFRRFLPDTSAPVNVEWGEENRTVGLRVPDAVPQNRRVENRLPGADANPYLAIAASLLCGFIGMVEGINPSAPVVGRGYERRNLRLPLTIEDALERMENSKTIEKYLGKKFIIGYVAVKRAEHENFKRVISSWEREFLLFAV

SEQ ID NO: 4135 - protein, 458 aa, Pseudomonas syringae pv. tomato str. DC3000
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHEIEGDPFFADPREVLRQVVAKFDEMGLTICAAFELEFYLIDQENVNGRPQPPRSPISGKRPHSTQVYLIDDLDEYVDCLQDILEGAKEQGIPADAIVKESAPAQFEVNLHHVADAIKACDYAVLLKRLIKNIAYDHEMDTTFMAKPYPGQAGNGLHVHISILDRDGKNIFTSEDPEQNAALRHAIGGVLETLPAQMAFLCPNVNSYRRFGAQFYVPNSPTWGLDNRTVAVRVPTGSADAVRIEHRVAGADANPYLVMASVLAGVHHGLVNKIEPGAPVEGNSYEQHEQSLPNNLRDALRELDDNPVMAKYIDPKYIDIFVACKESELEEFEHSISDLEYNWYLHTV

SEQ ID NO: 4136 - protein, 398 aa, Dehalococcoides ethenogenes 195
MTSQVETDKGFISDRAKELKPSGIRKFFDLAAKMGSGAISLGVGEPDFTTPWHIRESAIYALEKGYTMYTSNAGLLELRQEIAKYLYQTYKLEYNPETEILITVGSSEALDLVMRATLNPGDEVLMTDPAYVAYPSCVFMAYGNPVQIPTFEANNFEISAADIAPRITPKTRSILLGYPSNPTGAVMPKAKLAEIAKLACEKNLLVVSDEIYDKIIYSGFEHTCFATLPGMRERSVIINGFSKTYAMTGWRIGYAAGPADIIQAMTKIHQHTMLCAPIAAQKAALEALKNGHDDVRLMVEEYDRRRRFIVKSFNDMGLSCFEPKGAFYTFPSVKKTGLSSAEFAEKLLLEETVAAVPGTAFGDSGEGYLRCCYATSMKDLEEAMKRFRHFLKHNCPGM

SEQ ID NO: 4137 - protein, 578 aa, Debaryomyces hansenii CBS767
MTVIELNKALKPSWWKETTVYQVYPSSFQDSNGDGIGDLPGITSRLDYIKSLGVDAIWLSPCFDSPQVDMGYDISDYKKIYPAYGTMEDADELIKGVHERGLKILMDLVVNHTSDQHPWFKKSRSSIENSYRDWYIWRKPRYDSEGNRQPPNNWAAAFGGSAWTFDETTQEYYLHLFAVEQPDLNWENENVRAAVHDIMRFWLDKGADGFRMDVINFISKDQRFPDAEVKHPNAKYQDGSPYFACGPRLHEYLQGIGQILIEYDAFSVGEMPACNDPEEIIKAVNIDRHELNMIFNFELVDIDHGNEGKFTAGSWKLADAYKIINKWQTFMQENGGWNAIYLENHDQPRSVSRFAEDSPEFRKISAKMVSTFLALQQGTLFVYQGQELGLKNVPETWDISNYRDLEVLNHYNELKEDGASPEILKAAMAEYQKKSRDNARYPVQWDTSANAGFSSSTPWIDVNEDYLEWNAAEEEKDPESVLNYWRSILKIRKEWKDILIYGRFEMVTSIEDEKVLAFKRTTSDKSAIVICNFSSDAVLWTIPEEFENSKVILSNYDRSKVSGPSVELKPYEAFTLLK

SEQ ID NO: 4138 - protein, 497 aa, Arabidopsis thaliana
  misc_feature (120)..(120): Xaa can be any naturally occurring amino acid
  misc_feature (150)..(150): Xaa can be any naturally occurring amino acid
  misc_feature (170)..(170): Xaa can be any naturally occurring amino acid
  misc_feature (186)..(186): Xaa can be any naturally occurring amino acid
  misc_feature (194)..(194): Xaa can be any naturally occurring amino acid
  misc_feature (213)..(213): Xaa can be any naturally occurring amino acid
  misc_feature (219)..(219): Xaa can be any naturally occurring amino acid
  unsure (1)..(497): unsure at all Xaa locations
MASCDTPDAFAWLQTLPPLSLWKGNLMSMCICSPNSSHPSLNFTLTRTPQSPNFFTFSIVANFKTPITLFISKNFRTISTNSTTFLNENVISTLLMGFVDVVLNYNVKKTTCSIQLQNLXSTTNIKKIFQLAIITFEILLCIYKAPTRLXKLDLKTVEDQLVTCRIKAGXSQLLLSALGSNLGKKXMRSLKLAXTNWVIEIKAIQPLKSPSPXKYQSFXATGLRKVHMYSPVVAMEMESVKRSQNDERLFSPPNYHQLEGETQLNHRKNVREKWLNAAENIDNVRCDIIRLVNEKQLPERGMGTEEKHSPPRISWQLTPTNQPNILMVPEQKPPENPLTESEEEKGKEATKDPPNTTFGQKVPANETTTKSMKPWKSEEWAHGYSANLTGFPHDLDDGREVSPSKPSKVSMMNPRAWFKNRDSSAFRPFTKQGGVVLAGESDGQSVLWKVEKTAIGKGMEFEVKGGVWLTDWPDKHHTVYSDTRKLEFKEMLYLNLP

SEQ ID NO: 4139 - protein, 162 aa, Glycine max
  misc_feature (145)..(145): Xaa can be any naturally occurring amino acid
  unsure (1)..(162): unsure at all Xaa locations
MQKAKGTVAARKHTSKIMKAYFSDPVNRQKRSMAMKGVKFYCQNCGREGHRRHYCPELNDSLVDRRFTCRLCGGKGHNRRTCRKLKISLSNGRTIKHHQCKICHQFGHNRRTCPQAVPFAVPSKRRNAASRRPYKCRLCKKEGHXNIRTCPSRTVVTENPQD

SEQ ID NO: 4140 - protein, 321 aa, Triticum aestivum
MSSDTERAATEKLEAEKKDAAASTGPIGGTGDRARILPARMTICSCEETINEFEMLTRDAARVQLDTLKKILEANAGAEYLRQFGLDGRTDAASYKSCIPLCVHSDVEPFIQRVADGDSAPVVTGKPITSLSLSSGTTQGKPKFLPFNDELLENTLQIFRTSYAFRNREYPISEGKALQFVYGSKQALTPGGILATTATTNLYRSQRYKEGMKDIQSQGCSPDEVIFGPDFNQSLYCHLLCGLIYSDEVHSVFSTFAHSLVHAFQTLEEVWEDLCADIRDGVLSEKITVPSIREAVSKILKPNPELADSIHKKCAGLSNWY

SEQ ID NO: 4141 - protein, 848 aa, Crocosphaera watsonii WH 8501
MSTLTPKVKNTSTSPEKTNIKIEDDRTGMNKETLKRAFLDHLFYIQGVDRSKASLRDYYMALSYTVRDRLLHRFLKTIETYKKEEVKIVSYFSAEFLMGRHLGNNLVNLGIYDTMKDIMTEMKIDFEDIIEQEPDPGLGNGGLGRLAACFLDSLASLAMPAIGYGIRYEFGIFHQTIQDGWQVEIPDNWLRFENPWEIARPDDAVEIKLGGHTEHTHDENGNPKTFWVADSTILAVPYDTPVPGYDTNTVNPLRLWKAEASENFNFEAFNAGQYDRAVQEKMDAETISKVLYPNDNTPAGRKLRLEQQYFFVSASLQDLIRIHLRNHNNLDHFADKVAVQLNDTHPAVAVAELMRLLMDKHNYQWEKAWEITTKALAYTNHTLMPEALERWPVSIFGELLPRHLEIIYELNHRFLEDQRTYFPGDDDLITNISLIEEREEKLIRMANLACLGSHAINGVAALHTELLKQDTLKHFAKLWPEKFFNKTNGVTPRRWILLSNPKLSALVTEKIGDGWLKNLDEMRKLEKFADDAAFRKQWREIKQQNKQSLADYLLKYRNIKIDPNTMFDVQVKRIHEYKRQHLMVLEIINLYNRIKENPNADYVPRTFLFGGKAAPGYFMAKLIIKLINAVADVVNNDPDVRGRLNVVFMPNFNVSLGQRVYPAADLSEQISTAGKEASGTGNMKFAMNGALTIGTLDGANIEIREEAHPENFFLFGLTAHEVYDRKAQGYSPSEYYHNNGSLKAVIDRISSGHFSHGNGELFGPIVEQLMNDDPYMLMADYQAYVDCQDAVSEAYRDQENWTRMSILNSARMGKFSSDRTIAEYCSEIWNVKPVDIKIAEYNPNGANN

SEQ ID NO: 4142 - protein, 284 aa, Xanthomonas campestris pv. vesicatoria str. 85-10
MNTPASSSPSSSAATSIAFVGGGNMARSLIAGLIRQGTPAASIRVAEPVAELRDALARDFGVQVVEDARAAVDAATTWVLAVKPQVLPMVCAQLADLAQAQQPLLVSIAAGITATQLQRWSGGDIAVVRAMPNTPALLGAGVTGLYANARVSAAQRQQATQLLDSAGVTVWIDNEAQMDAVTAVSGSGPAYVFLLAEAMEAAAQAQGLPAATARTLVLQTLLGAARMLTESGEPPEVLRRRVTSPNGTTHAAIETFQAGGFEALTAQAIAAATERGRSLSAAND

SEQ ID NO: 4143 - protein, 121 aa, Brassica napus
  misc_feature (110)..(110): Xaa can be any naturally occurring amino acid
  misc_feature (112)..(112): Xaa can be any naturally occurring amino acid
  unsure (1)..(121): unsure at all Xaa locations
GHLSEWITDLGCRDYVSILLGDPNPELADLIENVCGEKSWQVSLKYASSESYFGLNLEPLSKPQHVSYTFLPNMSYFEFIDVDGEIVDPVNVKLGHYYEPLVTNFSGLHXFXVGDVLQVTG

SEQ ID NO: 4144 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 4145 - protein, 294 aa, Klebsiella pneumoniae
IVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 4146 - protein, 482 aa, Escherichia coli
MSDVPLIAVVMAGGTGSRLWPLSREHYPKQFLQLSGESSLLQSTLLRLSTLSCETPLVITNEQHRFVVAEQLRQIDQLRDNIILEPCGRNTAPAIALSAFTALKRNEQQDPILLILAADHIISKADVFCDAIQKSKTVAEQGNIVTFGIIPEYAETGYGYIKKGDPFKILPNITHDKFYHVQQFIEKPNHSTAEEYVSTGEYLWNSGMFMFKASVYLEELKKHRPDIYEICEQTASLSYNDLDFIRLPKHIFQDCPSESIDFAVMEKTKNCIVRPVDIGWSDVGSWHSLWDISDKTQDGDVCKGDILTYNTKNNYIYSESALVAAVGVEDIVIVQTKDAILVSKKTEVQDVKKIVEMLKEQERSEYISHREEFRPWGKFDAIDQGERYKVKKIVVKPGEGVSLRMHHHRSEHWIVLSGTAKVTLNDKTVLLAANESIYIPLGATYSLENPGIIPLNLIEVSSGDYLGEDDIVRQKERYRIDD

SEQ ID NO: 4147 - protein, 285 aa, Lactobacillus johnsonii NCC 533
MKFNSVEDTYTLNNGVKIPIIGFGTWQTPDGDVAKHVVEAALNSGYRHIDTAAAYGNEESVGEGIKNSGINRHDLFITTKLWNADHGYKEAKAAIDKSLQNLGTDYLDLYLIHWPNPLALRDHWAEANAESWRAMEEAVKAGKIRAIGVSNFRKHHLEELLKTAEIKPAVNQIMLNPSDLQSDVVKVNEELGLLSEAYSPLGTGGLLGNEVVNEIANEVGKSPAQVLIRWSLEHGFLPLPKSVHDKYIAANIDVFDFELNDEQMSKLDSLHGVSDLATDPDTANF

SEQ ID NO: 4148 - protein, 1121 aa, Rubrobacter xylanophilus DSM 9941
MTQTARRGAARREEAYREDPLWYKDAIIYQLHVKAFFDSDNDGIGDFRGLTQRLEYIKDLGVNAIWLMPFYPSPMRDDGYDISEYKNVHPEYGTRRDFRNFVRRAHALGLKVITELVINHTSDAHPWFQRARKAPRNSVWRNFYVWSDTDKKYADARIIFTDTETSNWTWDPVAQQYYWHRFFSHQPDLNHDNPRVFDAIMRVMRFWLDAGVDGLRLDAIPYLIEREGTDCENLPETHEILRRMRAELDARYQNRIFLAEANQWPEDVLPYFGKGDECHMAFHFPLMPRIYMAVAQEDRHPIVEIMQQTPEIPEVCQWAIFLRNHDELTLEMVTDRERDYMYQTYAADPRARINLGIRRRLAPLMENDRARIELLNSLLMSMPGTPIIYYGDEIGMGDNVFLGDRNAVRTPMQWTSDRNAGFSRADPHSLYLPPIMDPVYGYEALNVEAQSRSPGSLLNWMKRIIAVRKAHKAFGRGTLEFLHPGNRKVLAYLREYGDETILCVANLSRSAQPVELDLSRFSGRVPVEMIGGSSFPPIGSLPYFLTLPGHSFYWFNLTTEAEAPSWHQESPRFFEPPVVVLPAGRQTARDIRRLPLRLQHRQVAQLEQEALPAFLSVRRWFAAKGSEIERVSLLARAEFGPDRLLALLRVGAGGAEHTYFLPLAAAWEDEDGERVSGLMPHALAKIRRRYRVGVLFDALADEGFCREVVAAMAGGRELEMGEGRVRFYATGALEELLAGEPVGELAVRRASVEQSNTSVILGERLVLKAYRRLQPGVNPELEIGRYLTEVRRFPNTPPLAGAVEYEDPRSGTVSLALLQGFVPSQGDGWSYVLGYLDRYLERRLLSASWSPEEEGPAEPPGQEGQEADEGFFMELMRTLGVRTGELHAALAAPTDDPSFSPEPAPPAEVSRWVEAVLDDLRLTLSLLERRRSGLPEEVRPEVDRLLRMEARAFDRLEAISARGIRAVKTRHHGDYHLGQVLVAGNDFQIIDFEGEPARTLEERRRKHSPLRDVAGMLRSFDYAAQTALMNLGADRAVGEDPEPVVRRWERSVREAFLGGYAEGVRGAGVLPGEGEEAAALVELFALEKALYEIRYELDNRPDWIGIPVRGVLDLLTREESP

SEQ ID NO: 4149 - protein, 308 aa, Klebsiella pneumoniae
INGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLVSWYDN

SEQ ID NO: 4150 - protein, 362 aa, Bradyrhizobium japonicum USDA 110
MKAAVLYEVNKPLVIEDVSLPKPGPREVLIRTSVAGLCHSDLHFMEGLYPHPLPAVLGHESAGVVEQVGSDVTYVKPGDHVVTCLSVFCGTCDNCTTGRTVLCTDTTVKLLPGVSDRMQWSRSEKLHQFLNLSSFAEQMLVHENAIVKIRKEMPLDLAALIGCGVITGYGAVVNTAKVTAGETVAVIGCGGVGMAAINGAQIAGAGRIIAIDTNPAKLQLATKLGATDIINPADGDVVKQVRDLTNGGVHHSFEVLGRKETAEQAFAMLASGGTATIVGMIPFGQKIELHGFDFLRERKIQGSSMGSNHFRVDMPRLVDFYLRGRLHLEDWISAKLKLSEINEGFANMKAGKTLRSVIVFDS

SEQ ID NO: 4151 - protein, 310 aa, Zea mays
MDGGGGGVGGGGVGAGVMVGGGVGPGGGVGVGVGGDVELVSKTLQFEHKLFYFDLKENPRGRYLKISEKTSATRSTIIVPVDGVAWFLDLFDYYIRTDERDAFSKELRLQTKVFYFDIGENKRGRFLKVSEASVNRNRSTIIVPAGSSGEEGWEAFRSVLLEINNEATRLYVLPNHPNQQHMEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVGIMKDRLEGMTGANVRTVEPSQR

SEQ ID NO: 4152 - protein, 139 aa, Francisella philomiragia
DQDVFKKLNKIIDTSVVPVVCIGESLEDRQGGRLEKVLITQLSLILENLSIEQLAKVVIAYEPVWAIGTGVVASLEQVQETHQFIRSLVAKVDQNLAKNMKIVYGGSLKAENAKDILSLPDVDGGLIGGASLKASEFNE

SEQ ID NO: 4153 - protein, 467 aa, Xanthomonas campestris pv. campestris
MSDVLPIILSGGSGTRLWPLSRETYPKQFLPLVGEHSMLQATWLRSAPVAAHAPIVVANEEHRFMAAEQLQQLGVKPSAILLEPKGRNTAPAIAVAALEATRNGGDPLLLVLPSDHVIRDEAAFQAAVTVAAAAAEQGKLVTFGIKPTAPETGYGYIKAGAGTGATAVERFVEKPDLATAQGYLASGEYYWNSGMFLFRASRYLEELRKFQPAIADACQKAWEGGKRDADFTRLDKDAFASSPSDSIDYAVMEKTADAVVVPLDAGWNDVGSWSSLLDVSEQDGQGNAHHGDVIQLDCKNTYAYGSRLIAMVGLENVVVVETDDAVLVGHRDRIQEVKEVVSQIKSAGRSEATWHRKVYRPWGAYDSIDMGQRFQVKRITVKPGATLSLQMHHHRAEHWIVVSGTAEVTRGDEVLLLTENQSTYIPLGVTHRLKNPGKLPLELIEVQSGSYLGEDDIVRFEDTYGRT

SEQ ID NO: 4154 - protein, 419 aa, Oryza sativa
  misc_feature (254)..(254): Xaa can be any naturally occurring amino acid
  unsure (1)..(419): unsure at all Xaa locations
GLREEGKEDCHKAVKRVARKFARTCMNGLNALSGAYICRYIFSDRPGVGLLTVPYALSEGGWVSLALLAAVAAACWYTGILLCRCMDADDAIRTYPDIGERAFGRTGRLLVSAFTYVELYLVATGFLILEGDNLDKLFPGARVTLGTVSLAGKRLFVVLVALVVAPTTWLRSLGVLAYVSATGVFASVVIVLSVLWAAAVDGVGFSGRGTTTPLRIAGLPTALGLYIFCYGGHPMFPTLYTSMKRKSQFPKMLXDMLPAMAVLGYLMYGDGVLSQVTLNLPSARLSSKVAIYTTLLNPVTKYALVVTPIAAAVEERIRGAAGKGARAVSVAVRTLLVLSTVAVALALPFFADLMALVGSMLNVAVCMLLPCACYVRIFGAPSMSSVEAVAIGGILVLGSLVAVTGTYYSLMKIIQRTIK

SEQ ID NO: 4155 - protein, 255 aa, Zea mays
MKTVSLGASRPSTVNFRMPTRDNLVPIRVDVEVDGQRYRDAFTWNPRDPDSEIISFAKRTAKDLKLPANFVPQMLQSIQGQLAEFRSYEGQEMQIKEKIVPLKIDLRVNNTVIRDQFLWDIGNLDSDPEEFARTLCDDLNITDPEVGPAIAVSIREQLYEIASQSVSVMREKQMSKKGRRAPEFSSNSKAVNNAVDLFKYFGSKGSVIRKRKEWYLYEPVVDVVANDEDGKEEANNSSRPKKRADEEKAASLQSL

SEQ ID NO: 4156 - protein, 182 aa, Glycine max
MAASGGCSSSFLTLSCAGAAQNQHASHPRTFFGVPHKNQRKRKTPHRLVVVAVTQGSAESSKSDEKIPSWAKPDSDEPPPWVRDEPNNKNSNNSQQEEEFEIPFYAYLLASAITAIAAIGSIFEYVNQRPVFGVLSSDSVFYAPLLGFFVFTGIPSSAFLWFKSVQAANKEAEEQDKKDGYL

SEQ ID NO: 4157 - protein, 319 aa, Fragaria x ananassa
MAKVPSVTLSSCGDDIQTMPVIGMGTSSYPRADPETAKAAILEAIRAGYRHFDTAAAYGSEKDLGEAIAEALRLQLIKSRDELFITTKLWASFAEKDLVLPSIKASLSNLQVEYIDMYIIHWPFKLGKEVRTMPVERDLVQPLDIKSVWEAMEECKKLGLARGIGVSNFTSSMLEELLSFAEIPPAVNQLEMNPAWQLKKLRDFCKAKGIHVTAYSPLGAARTKWGDDRVLGSDIIEEIAQAKGKSTAQISLRWVYEQGVSIVTKSYNKERMRQNLDIFDFCLTEEELEKMSHLPQRKGVTFASILGPHDIVLEVDEEL

SEQ ID NO: 4158 - protein, 510 aa, Pseudomonas syringae pv. tomato str. DC3000
MTATPKPLVLIILDGFGHSESHEGNAILAAKMPVMDRLYKTMPNGLISGSGMDVGLPDGQMGNSEVGHMNLGAGRVVYQDFTRVTKAIRDGEFFENPTICAAVDKAVSAGKAVHIMGLLSDGGVHSHQDHLVAMAELAVRRGADKIYLHAFLDGRDTPPRSAKKSLELMDETFARLGKGRIATIIGRYFAMDRDNRWDRVSTAYNLIVDSSAEFHAATGVAGLEAAYARDENDEFVKATRIGEPANVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIIVNYANGDMVGHSGIMEAAIKAVEYLDVCVGRITDALEKVGGEALITADHGNVEQMTDDATGQAHTAHTSEPVPFVYVGKRQLKVREGGVLADVAPTMLQLLGMEKPQEMTGHSILVEE

SEQ ID NO: 4159 - protein, 302 aa, Haemophilus influenzae
MMNFTLLTYLADCQPKVRSELEKFSKNLEEDIQQLREIGLDILVDGQDYRLVPMLPLLNPQQISTALFPYSIHYQPIISSTNEWILQNILSLKKGDLCVAEYQTAGRGRRGRQWLSPFAGQIMFSFYWAFDPKKSIEGLSLVIGLAIAEVLNVQVKWPNDILFDERKLGGILVEIANHKNGMLNLVIGIGINVSLSKQTEISQPYAEVCEIDPDVERQTLLPKLIQHLYTRLNIFEQNGIDEEFQQAWQSYNAFSNSEINVLTEQGVISGIEQGIDERGYLKVLCGNKIQMFNGGEVSLRKK

SEQ ID NO: 4160 - protein, 244 aa, Karenia brevis
TFNAPAMYVAIQAVLSLYASGRTTGIVMDSGDGVSHTVPIYEGYALPHAILRLDLAGRDLTEYLMKILTERGYSFTTTAEREIVRDVKEKLCYIALDFDTEMKSATESSDKEKTYELPDGNIITVGGERFRCPEVLFQPSFVGKEASGIHDTTFQSIMKCDVDIRKDLYSNVVLSGGTTMFAGIGERMTKELTALAPSTMKIKVVAPPERKYSVWIGGSILSSLSTFQQMWISKGEYDESGPTI

SEQ ID NO: 4161 - protein, 248 aa, Lycopersicon esculentum
TGVISGALLYIRDDFKSVGKRTWLQETIVSMAVAGAIFGAAFGGWFNDKYGRRKSILLADILFFIGAIVMAVAPAPWVIIIGRVLVGLGVGMASMTSPLYISEASPARIRGALVSTNGLLITGGQFLSYLINLAFTRTKGTWRWMLGVASIPALVQFILMLSLPESPRWLYRADKKDEARAILEKIYPAHEVEDEMKALQTSIEVEKADKEFLGDGVFSKVKSAWSNTIVRRGLYAGITVQVAQQFVG

SEQ ID NO: 4162 - protein, 475 aa, Bacillus anthracis str. 'Ames Ancestor'
MQQTTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVEMEKANETNNQTR

SEQ ID NO: 4163 - protein, 271 aa, Haemophilus influenzae R2846
MQHKLIAFIGGGNMAQAIILGLLKQGYPAEQIIVNDPNEEKRAFFANLGVATSENNVESVIKAEVVLLAVKPQMMAEVCSPLSAVDFSDKLLISIAAGISTERLNALIPSLKSIVRVMPNTPALVGEGMAGLFAPKNTSENYRTFAQDLLGAVGRTVWVNDETQMHAVTAASGSSPAYFFLMLEAMQKALIKMNIDEKTARELVQQAMLGAAKMVTENPQIALSTLRENVTSKGGTTAAALAVFDAQHFNQTIEQAMQACLSRSQEMETLF

SEQ ID NO: 4164 - protein, 315 aa, Haemophilus influenzae
MKIVFLDSTAIPKHISIPRPSFEHTWTEYEHTSAEQTIERVKDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKDLINAETLSKMKKGAFLINTGRGPLIDELALVDALKTGHLGGAALDVMVKEPPEKDNPLILAAKTMPNLIITPHIAWASDSAVTTLVGKVMQNIEEFVQQLHQK

SEQ ID NO: 4165 - protein, 483 aa, Pseudomonas aeruginosa PAO1
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 4166 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEAEPKADA

SEQ ID NO: 4167 - protein, 556 aa, Leuconostoc mesenteroides subsp. mesenteroides ATCC 8293
MEKVQWWQNTVVYQIYPRSFQDSNGDGVGDIPGIIERLPYLKALGVQVIWLSPIYQSPNDDNGYDISDYRKVLPEFGTMADVQEMLEVAHHLGLKIMMDLVVNHTSDEHQWFKESRKNKDNPYRNYYIWRDPVDGHEPNNWLSDFGGSAWEFDNNTQQYYLHLFSKKQPDLNWDNPDLRQDIYDTMKWWLDQGVDGFRMDVINLISKPSDLPNDPNVTLENHGSSMDFVANGPNIHDYLQEMNQEVLSKHDIITVGETPGVSTKDAMKYAGFDSHELQMIFQFEHTEVDNSHEGLGKWSDERFNLVDLKRILSRWQNELYGKAWNSLYWNNHDRPRVVSRFGNDSDEYRVLSAKMLAATLHFMQGTPYIYQGEEIGMTNIDLPSIKDYRDIDTLNAYDDLVVQQRRVTADKMMSYVHHSSRDNARTPMQWDNTKNAGFTESHPWLSVNPNYQTINVADSLTDQQSVFHFYQKLIALRQELSIITTGKYEVLDLEDESVYAYKRIDKDTQLLVISNFTDQKQTRHYDRTQSAQLVISNYSDDQGDTLRPYESKVYLF

SEQ ID NO: 4168 - protein, 560 aa, Leuconostoc mesenteroides subsp. mesenteroides ATCC 8293
MTEDIKWWQKAVAYQVYPRSFQDANGDGIGDLQGIEQRLDYIKKLGADVIWLNPIYASPDKDNGYDISDYEDINAKFGTMQDFDRLLQKAHDKGIKILMDLVVNHTSDQHQWFIESRSSKDNDKRDFYIWRDPVDGHEPNNWGSFFSGPAWKFDEETGQYYLHLFVEGQPDLNWVNPEVRQAVFDMMNFWVDKGIDGFRMDVISLISKPDGLPDGEVPEGGEYGNSDKAVANGPHVHEYLQEMREKVLKRADMMTVGEASGVDINNAIKYANTNESELNMVFQFEHMGLDNNPNPALGKWYDQKVSLVDLKENLSKWQNDLAGKAWNSLYWDNHDQPRAVSRYGDDRAAYRVVSAKMVATLLHFMQGTPYVYQGEEIGMTNAYNLQREDFDDVEIKNAFKYLIDKDHLIDEDTMLKYVHAKGRDNARTPMQWDSTANAGFTTGTPWLKLNDNYDTINVEQALADKSSIFYYYQKLIQLRHDLPIITTGKYQLLDPKDEQVYAYRRVGNNEQLLVINNFTDNIVTRDYSVPTNAKILVSNYADDKAETLRPYESKVYQFEK

SEQ ID NO: 4169 - protein, 279 aa, Coccidioides immitis RS
MTSERENKTFLARLCEQAERYDEMVTYMKEVASLGGELTVDERNLLSVAYKNVVGTRRASWRIISSIEQKEESKGSDKHVATIREYREKIEEELERVCQDVLEVLDNNLIPKAETGESKVFYYKMKGDYYRYLAEFASGNKRKVAATNAHEAYKNATDVAQSELTPTHPIRLGLALNLSVFYYEIVNSPDRACHLAKQAFDDAIAELDSLSEESYRDSTLIMQLLRDNLTLWTSSDGGEAEPTTTDAASEEKPAETSATTDEPAAPASTEDKKETAAES

SEQ ID NO: 4170 - protein, 209 aa, Prototheca wickerhamii
HGTHAGLRVRPSPSAGRRVATAAGTGTFFVGGNWKANGSTAVVEKLVQELNAGILPKDVEVVVAPSFLYLDQVQGSLKSSYQVAAQNCWKGKSGAFTGEVTAEMLADKQIPWVILGHSERRALMGDTDEVVGEKVAYALSKGVKVIACIGETLEERESGRMFDVLDTQAKAIAEDVTDWSSVVLAYEPVWAIGTGKWPPPSKPRSARLA

SEQ ID NO: 4171 - protein, 393 aa, Geobacillus kaustophilus HTA426
MKLAKRVASLTPSATLAITAKAKELKAAGYDVIGLGAGEPDFNTPEHIIAAAIKAMNEGHTKYTPSGGLPALKEEIIKKFARDQGLSYEPAEIIVCVGAKHALYTLFQVLLDEGDEVIIPTPYWVSYPEQVKLAGGVPVYVEGLEENDFKMTSDQLKQAITPKTKAVIINSPSNPTGMIYTAEELKALGEVCLAHGVLIVSDEIYEKLIYGGAKHVSIAELSPELKEQTIIINGVSKSHSMTGWRIGYAAGPKDIIQAMTDLASHSTSNPTSIAQYAAIAAYSGPQEPVEQMRQAFEKRLDIIYDKLVQIPGFTCIKPQGAFYLFPNARKAADMAECRTVDEFVAVLLEEAKVALVPGSGFGAPDYVRLSYATSLEALETAIERIRRFMEARA

SEQ ID NO: 4172 - protein, 231 aa, Prototheca wickerhamii
KRPGNVGSHFASQVLGTSGTCMGGRAATAPFRTVTVRRASRGMRASTLVRAAIGTNGRPTVLVAEKLGAGGVDMLKEVADVRTVLNMSKEQLLENISSVDAIVIRSATKVTREVIEASKGRLRVVGRAGVGIDNVDLTAASESGCLVVNAPTANTIAAAEHGISLLTALARNVAQADASMKAGGWDRTTYVGVSVVGKTLAIIGFGKVGGEVARRAKGLGMTVIAFDPYAS

SEQ ID NO: 4173 - protein, 256 aa, Escherichia coli
RFGQNFLNDQFVIDSIVSAINPQKGQAMVEIGPGLAALTEPVGERLDQLTVIELDRDLAARLQTHPFLGPKLTIYQQDAMTFNFGELAEKMGQPLRVFGNLPYNISTPLMFHLFSYTDAIADMHFMLQKEVVNRLVAGPNSKAYGRLSVMAQYYCNVIPVLEVPPSAFTPPPKVDSAVVRLVPHATMPHPVKDVRVLSRITTEAFNQRRKTIRNSLGNLFSVEVLTGMGIDPAMRAENISVAQYCQMANYLAENAP

SEQ ID NO: 4174 - protein, 124 aa, Zea mays
  misc_feature (20)..(20): Xaa can be any naturally occurring amino acid
  misc_feature (22)..(22): Xaa can be any naturally occurring amino acid
  misc_feature (35)..(35): Xaa can be any naturally occurring amino acid
  misc_feature (83)..(83): Xaa can be any naturally occurring amino acid
  misc_feature (105)..(105): Xaa can be any naturally occurring amino acid
  unsure (1)..(124): unsure at all Xaa locations
MSAFTSKFADELIANAAYIXTXPGRGILAADESPXNIGRRLASINGENVETNRRGLRELLFTVPAALAGGRGVILFEETLYQXSSDGKLFVDILEERGVLPGIKXDRGTGELPGTRGETPTSGF

SEQ ID NO: 4175 - protein, 271 aa, Rubrobacter xylanophilus DSM 9941
MEAGNTKTALVTGSTDGLGRGVARELARRGYAVILHGRSEARCEEAAAELPGGAAGYLVADLSSLGEVRKMAREVLAGRERLDLLVNNAGVISRERRESREGFELTFAVNYLSHFLLTLLLLPLLRRSAPARVVNVASAAQSPIDFEDPMMERSYSPMEAYARSKLAQVMFSFALAGRLSGTGVCVNALHPASLMDTKMVRESFGRPMSSVEEGVRAVVRLAASSELEGVSGRYFEGTREARAHPQAYDPAARERLWELSEGLCGALDAGR

SEQ ID NO: 4176 - protein, 328 aa, Crocosphaera watsonii WH 8501
MYLYYTLGFIAVVLVIGVVVYLVTPRSYESSDTVATSYDEWTQDGILEFYWGEHIHLGHYGSPPRSKDFLEAKADFVHEMVKWGGLDKLPRGTTVLDVGCGIGGSSRILAKAYGFETTGVTISPKQVQRATELTPEDVTAKFQVDDALNLSFPDNSFDVVWSIEAGPHMPDKAKYAQEMVRVLKPGGLLVVADWNQRDDRQKPLNFWEKPVMRQLLDQWSHPSFSSIEGFSEQIAATGLIEGEVITADWTKETLPSWLESIWQGIVRPQGLIKFGFSGFIKSLREVPTMLLMRLGFGAGLCRFGMFRAIKSPSVSQSTQTAKGETVNV

SEQ ID NO: 4177 - protein, 223 aa, Triticum aestivum
  misc_feature (212)..(212): Xaa can be any naturally occurring amino acid
  unsure (1)..(223): unsure at all Xaa locations
MEEDGPSRSGLPPVGECEWREELRQQQSQVEALRDRLVEVKVGMRRSEDDSGRELEHLCRRVKTIATLLAYLKSKARIMAIPHLAHTSCGIRNQDGVGFVDRHGVPLADWSKATDSASCGGGSDDRTAAEGSGVQKNGDAVEGDGDVDDILKSIRVVTDVMESLVKRVIVAESETANEKEKVRIGLEEIRRKTIQVESMSVKVEEMEKFAVXGTNGMLKMSKT

SEQ ID NO: 4178 - protein, 586 aa, Lactobacillus plantarum WCFS1
MKKTKIVSTLGPASTDTDTIVKLIEAGANIFRFNFSHGDHEEHLDRLNKVHEAEKITGKTVGIMLDTKGAEIRTTVQANGKSEYKIGDKVRITMDDSLDTTHDKIAVTYKNLYDDVHVGGHVLFDDGLLDMKIDEKDEANRELVTTVQNAGVLGSRKGVNAPGVSINLPGITEKDSSDIRFGLDHEINYIAASFVRKPQDVLDIRELLEEKHMEHVQIFPKIESQEGIDNADEILKVCDGLMVARGDMGVEIPAENVPLVQKSLIKKCNALGMPVITATQMLDSMQENPRPTRAEASDVANAVFDGTDATMLSGESANGLYPVESVAMMAKIDEKAENTLAENGTLQLNRFDKTSVTETIGIAIARAAKNLNIKTIVAATESGYTAKMISKYRPNADILAITFDERTQRGLMVNWGVQPIVAEKPETTDDMFDLAASKAVELGFAKEGDLILITAGVPVGERGTTNIMKIQLIGSKLADGQGVGDETVIGKAVIATSAQEAIDKAVEGGVLVTKTTDKDYLPAIEKSSALVVENGGLTSHAAVVGISMGIPVIVGVKDATSVIADGQLITVDSRRGLVYRGASNAL

SEQ ID NO: 4179 - protein, 190 aa, Platanus x acerifolia
PELPLFNFENLAMATNNFHGANKLGKGGFGEVYKGKLANGQEIAVKRLSKNSGQGIEEFLNEVIVISKLQHRNLVRLLGRCVEGVEKMLIYEYMPNKSLDAFLFDPVKATLLGWRKRFNIIEGIARGLLYLHRDSRLRIIHRDLKASNILLDEQLNPKISDFGMARIFGGTQDEADTRRVVGTYGYMSPE

SEQ ID NO: 4180 - protein, 636 aa, Methanococcoides burtonii DSM 6242
MAIEDVLADLKKKIEEKVPDNTTITSVEFEGPQLVVYTEDPKNFADNGQIVRTLAKTLRTRIVVRPDPKVLVSPEEAIGKIKDTVPKDAVLSNFHFDPDVGEVVIEAEKPGLVIGKHGETLREITKKIGWTPKVVRTPPIKSRTVKNIREFMRTNHKDRKEILKAVGRNIHRECTSKDHWVRVTSLGGCKEVGRSCFLLSTPESKIMIDCGVNVGSDDNMTPYLYLPEVQPLNQIDAVVITHAHLDHQGLVPLLYKYGYEGPIYCTSPTRDIMTLLQLDFIDVAAKEGKKPPYESTNVRDALKHTIALDYEEVTDIAPDVKLTFHNAGHIIGSAISHFHIGDGLHNVVVTGDYKYGPTRLFDPAVNKFPRVETVITESTYGAASAVQPSLKEAEKNLQQIIKNTLNNKGIVLIPAFAVGRSQEVMIVLEDAIRRGIIDDVPVYLDGMIWEATAIHATYPEYLNNNLRKLIFQKGQNPFLAECFKPVDSNDLRKKIIEDPHPCVILSTSGMMNAGPVMEYFKAFAPDPNNTLVFVGYQADGTLGRRIQKGWKEIPVSSKGGTEVVKMNMGVEVVDGFSGHSDRKQLMEYFKKMKPQPERVFTEHGDERSCIDLASSLHKKYRLETRALTNLETIRLV

SEQ ID NO: 4181 - protein, 849 aa, Trichodesmium erythraeum IMS101
MNKPVNKSVNSTTKTQIQIEDDRTGMSVKTLRRALADNLFYLQGTYESMAKKDDFYRALAYTIRDRLLQRFLSTIRTYNEKDVKVVYYLSAEFLMGRHLGNSLINLGIYEEIRQAVSESGLNLDELLEQEDDPGLGNGGLGRLAACFLDSLATLEIPAIGHGIRYEFGIFTQNIQDGWQAEIPDKWLRFGNPWEIARPGEQVEVKFGGTTEGYHDEKGNYRVTWVPAQTVVGIPYDTPVPGYKVNTVNPLRLWRAEASVDFKFEEFNSGNYDGAVAEKMSSETISKVLYPNDNTPQGKELRLKQQYFFVSCALQDILRRHLLHNQNLDNLSDKTAIQLNDTHPAVAIVEMMRLFIDEYDIDWDRAWHITQHTFAYTNHTLLPEALERWGITLFGSLLPRHLELIYEINRRFIEQVQTWYPKDKELISRISIIEESPEKAVRMANLATIGSHAVNGVAALHTELLKKGVLQDFYKLFPEKFMNKTNGVTPRRWILLCNPKLSALFSEKLGDSWLRNLDQLKELEKYVDDVEFCKRWRQIKQENKAKLAEYILKHNRIEVDTNSLFDIQVKRIHEYKRQHLDLFHIITLYNRIKQNPKINIQPRTFIFGGKAAPGYYMAKLIIKLTNVVADIVNNDPDVHGRLKVVFLANFNASLGQLIYPAADLSEQISTAGKEASGTGNMKFAMNGAMTIGTFDGANIEIREEVGAENFFLFGLTAEEVFDLKAKGYQPLDYYNTNSELKAVIDRITSSQFSKGHPNLFKPLINSILYNDQYMLLADYQAYIECQEKVSQVFQDPKKWTKMSIYNSVRMGKFSSDRTILEYAKEIWGATPVKINQGKYNQNDAGLKVDN

SEQ ID NO: 4182 - protein, 227 aa, Phleum pratense
YYEAGARFAKWRAVLKIGPNEPSQLSIDQNAQGLARYAIICQENGLVPIVEPEILVDGPHDIDRCAYVTEVVLAACYKALNDQHVLLEGSLLKPNMVTPGSDAKKVAPRESLAEYTVRTLQRTVPPAVPAIVFLSGGQSEEEATVNLNAMNKLQTKKPWFLSFSFGRALQQSTLKAWSGKEENVGKAQKAFLVRCKANSEATLGTYKGDATLGEGASESLHVKDYKY

SEQ ID NO: 4183 - protein, 482 aa, Escherichia coli K12
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 4184 - protein, 352 aa, Glycine max
QFLSVSFFTASMELDGVLLGMCNPLLDISAVVDDAFLQKYGIKLNDAILAEDKHKPMYEELANNPNVEYIAGGATQNSIRVAQWMLQAPGATSYIGCIGKDKFGEEMKKKCTLDGVKVNYYEIDNTPTGTCAVCVVGGERSLVANLSAANCYKSEHLTRPENWALVEKAKYFYISGFFLTVSPDSIQLVAEHAAANNKFFMMNLSAPFICEFFKDALNKVLPYMDYVFGNETEARTFSKAQGWETDNVEEIALKISQLPKASETHKRITVITQGADPVCVAEDGKVKIYPVIPLPKEKLVDTNGAGDAFVGGFLSQLVKHKPIEECIRAGCYAANVIIQRPGCTYPPTPDFH

SEQ ID NO: 4185 - protein, 266 aa, Clostridium perfringens SM101
MNKKIGFIGCGNMGSAMVLGILKSGIVCKENIIASCSRESSAERIKNELGINTTLDNKEVCNNSDIIFLAVKPYMYEKVIKEIRDCVDLNKTIVTIAAGINLSDVEKWFKKETKIVKTMPNTPALVGEAMSAICPNELVNEEELKEVMDIFNAFGKSEVLSEKDFHGFIALCGSSPAYVYMFIEAMADAAVREGISRDKAYKLAAQSVLGSAKMVLETGEHPAKLKDNVCSPGGTTIEAVLELEETGFRSSVMSAMKKCSKKSKKM

SEQ ID NO: 4186 - protein, 279 aa, Geobacillus kaustophilus HTA426
MKAKTDFFHMKQAGEPIVMVTAYDFPSAKLAEQAGVDMILVGDSLGMVVLGYDSTIPVTVDDMIHHTKAVRRGAPNTFIVTDMPFMSYHASKEEALQNARRIMQESGANAVKVEGADEVVDMIAALTKAGVPVVAHLGLTPQSVGVLGGYKVQGKDAESAKKLLDDAKQCEQAGAIALVLECVPKQLGAAMARELTIPVIGIGAGAEVDGQVLVYHDLLGYGVTRVPKFVKQYASIQETIVEALANYVADVKLRQFPEPAHTFTMKEEEWVALYGGKQG

SEQ ID NO: 4187 - protein, 486 aa, Azoarcus sp. EbN1
MTLALNDPDLFRSRCLVGGTWADADSGATIAIHNPATGEQLGTIPKMGAAETRRAIDAASRAWPAWRALTAGARARVLRKWFDLIVEHQEDLALLMTSEQGKPLGEARGEVLYAASFVEWFAEEAKRIYGDVIPGHQPDKRIVVTKEPVGVCAAITPWNFPLAMITRKAGPALAAGCTMVLKPATQTPYSALALAVLAERAGVPAGVFSVLTGSATEIGGELTANPIVRKLTFTGSTEVGIKLAAQCAPTIKKLSLELGGNAPFIVFDDADLDAAVDGALASKYRNTGQTCVCANRLLVQDSVYDAFAEKLTAAVAKLKVGNGVDEGVTQGPLIDMRAVEKVEEHIADALAKGARVVTGGGRHALGRTFFEPTILADVTPQMKVAREETFGPVAPLFRFKDEAEAIRMANDTEFGLAAYFYSVGMNRVWRVSGALEYGIVGINTGIISTEVAPFGGMKSSGLGREGSKYGIEDYLEIKYLCMGGVQ

SEQ ID NO: 4188 - protein, 466 aa, Escherichia coli K12
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 4189 - protein, 68 aa, Glycine max
YEDTYLAATGGSGIFEETYNQVKLHQIRFPFKLFYTLYLKNIKHLPHNLLCKPIKPSPSIKPIPSTKT

SEQ ID NO: 4190 - protein, 86 aa, Oryza sativa
MAGAAKASWMVAMSVGAVEALKDQGGLCRWNYALRSIHKAAKANAAGVSQGKKLPASAAAVAERRRAEKAEEGLRTVMYISCWSTN

SEQ ID NO: 4191 - protein, 329 aa, Geobacillus kaustophilus HTA426
MAHGAQSDTRKKLLELFAEANGEFLSGQKISEQLGCSRAAVWKHIEELRKEGFELEAVRRLGYRIISTPDKVTANEIQLGLKTEKLGHTIHFFDEVDSTQRIAARLAYEGAPEGTLVVAEEQKAGRGRLDRKWFSPKGTGIWMSLILRPAIPPQRAPQLTLLAAVAVSQAIQEVTGLVPDIKWPNDILLDGRKCVGILTELQADPDRVHSVIIGIGINVNQTIEQFPEDIRTIATSLAIEKGGPVKRAPLIQEILFRLERLYEQYLAHGFRPIKLLWEGYAVSIGKPVTARTLNGVIHGIARGITDDGLLILEDEQKDIHYIHSADIQF

SEQ ID NO: 4192 - protein, 467 aa, Clostridium perfringens SM101
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDIIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 4193 - protein, 279 aa, Mesorhizobium loti MAFF303099
MDLKDKTILITGSTDGVGRVVAQRLGADGARVLVHGRDAARGKAAVAEIEAAGGRAEFFAADLASLAEIRHLAEAVRARTNRLDILINNAGIGTAAAKRQVSADGYELRFAVNYLAGFLLTSELLPLLKASAPARIVNVASAGQQAIDFGDVMLTHGYSGVRAYCQSKLAQILFTVDLAEQLKGTGVTVNALHPASYMNTTMVRQAGVTPWSSVETGAEAIVNLAASPALEGRSGLYFDGLREARADAQAYDATARQQLRSLSRDLVGAASSKSRERHS

SEQ ID NO: 4194 - protein, 951 aa, Gluconobacter oxydans 621H
MPENLPVTTLWPAQTEDFSSRHIGPRPSEIGEMLRVVGASSLDDLIDKTIPAAILDRGDHGIGAALTEQDALARLRQIASRNQVLTSMIGQGYYDTVLPPVIQRNILENPAWYTAYTPYQPEISQGRLEALLNFQTLVADLTGLDIANASLLDEGTACAEAMALAQRVGKSKATAFFVDADTHPQTIAVIRTRAEPLGWDVVVGDPETDLDASSVFGALLSYPGSSGQVRDPRKVIAALHEKGAIAALACDPLALVLLESPGALGADIAIGSMQRYGVPMGAGGPHAAFMATRDAFKRHMPGRLVGVSRDSAGKPAYRLALQTREQHIRREKATSNICTAQALLAIIASMYAVYHGPEGLKAIAARTHRMAAILSAGLKTLGATVETDVFFDTITVQAGASAPQVLARAVASGINLRDAGDGRIGMSCDETTTPETIRAVWAAFAGEGADLSAIEQALDVADALPEGLSRTAPLLTHPVFHAHRSETDLLRYMRALADKDLALDRTMIPLGSCTMKLNATAEMIPITWPEFARIHPFAPADQVQGYTELFAYLERTLCAISGYDAVSLQPNSGAQGEYAGLLAIRGYHRARGDENRDVCLIPASAHGTNPASAQMAGMRVVVVACDENGNVDVEDLKAKIAQHDGRVAAIMITYPSTHGVFEERIVEICELVHAAGGQVYLDGANLNAQVGLARPGLYGADVSHFNLHKTFCIPHGGGGPGMGPIGVGKHLAPYLPGRHGIAVSAAPFGSASILPISAAYIMMMGDEGLRQATTMAILNANYIASRLEGHYPVLYRGTNGFTAHECIVDLRSLKDAVGVTVDDIAKRLIDHGFHAPTVSFPVAGTFMIEPTESEGKGELDRFCDAMIAIRAEIAEVEAGRVGMEDSPLRFAPHTTADLAGDWERSYSREAGCFPGGVDTAKYWSPVGRLDNAWGDRNLVCSCPDISTYVEG

SEQ ID NO: 4195 - protein, 534 aa, Haloquadratum walsbyi
MHMQVLVTDPIDDAGLERLRAAGHGVETAYDIGDEALLNTITDVNALVVRSGTDVNEAVFEAASDLIIVGRAGIGVDNIDIDAATEHGVIVANAPEGNVRAAAEHTVAMTFAGARSIPQAHARLRTGEWAKSEYLGTEVNGKTLGVVGLGRVGQEVAKRLESLGMDLVAYDPYISEDRAERLGAELVEFDTCLERAEFLTVHTPLTSETAGMISTTELELMDGGYLINCARGGVVDEDALAAAVEDGVLDGAAVDVFADEPVAPDSALLSVDNIVVTPHLGASTEAAQENVATSIADQIDAAFAGAPVMNALNAPSVDESVFPRIRPYIDLAETAGKIAAQLLDGRISSVSVSYEGDIADEDVELATASALKGVFEPLEWQVNAVNAPQIAEERGIDVTESKRLQSDDFQSLVTVEVSNGDDQLAVSGTQFTGGEPRIVKIDGYRVDAVPHGKMLVARNADKPGVIGFIGSVLGEHNINIAGMFNARRDIEGGEALTIYNLDDSVPTDVVERLLADERMIDVRYLTLNGASDTK

SEQ ID NO: 4196 - protein, 364 aa, Triticum aestivum
  misc_feature (147)..(147): Xaa can be any naturally occurring amino acid
  misc_feature (305)..(305): Xaa can be any naturally occurring amino acid
  misc_feature (313)..(313): Xaa can be any naturally occurring amino acid
  misc_feature (347)..(347): Xaa can be any naturally occurring amino acid
  unsure (1)..(364): unsure at all Xaa locations
HEYSGLSFLNKGNAFILLLLAVAVPSLLRTGEASVHEYSGLSFLYAPVSPANATAEEDDDEAAADAFIRFDKITFRRPEEANDSVKETSSSKVQIIVFEIEDREMIGGSAYGGQKAICCTSDLAKLGACVEGSVIYRPSQVNPGWPXLLFASFDGSDLIATLPSRTIPVKKTGMYNMYFIHCDPALAGLEIDGKTIWKNPTGYLPGRMAPLKNFFGLMSFAFVILGIYWFYQYMKFWREVLPLQNCITLVITLGMLEMALWYFEYAEFNETGVRAKAITFWAVTFGTIKRTVARLIILIVSMGYXGVVRPTLXGLTSKVVMLGGTFFVATEILELVENLSTVNDLSXKARLFLVYPVAILDASF

SEQ ID NO: 4197 - protein, 460 aa, Gluconobacter oxydans 621H
MIQEHAAEFVDLRFTDPKGKWHHTTQTVSTIEDDTFVEGFMFDGSSIQGWKAINESDMVLLPDPETAVMDPFSAKPQLILFCDIIDPKTGNFYNRDPRSTAKLAEAYLKDAGFGDTAFFGPEAEFFIFDNVQFGTGPNFGMYQLDSIEGPGASLKAYPEGNMGHRPVVKGGYFPVPPVDSENDLRAEMLSTMGEMGLPIEKHHHEVAQSQHELGTKFDTLVKSADFMQIYKYCVHNVAHSYGKTATFMPKPISGDNGSGMHVHQSIWKDGKPTFAGDKYADLSDEALYYIGGIIKHAKALNAFTNPSTNSYKRLIPGFEAPVLLAYSAANRSASCRIPHATNPKAKRVEVRFPDPTANPYLAFAAMLMAGLDGIRNKIHPGDAMDKDLYELPKEELAQIPTVCGSLREALEALKEDHAFLLEGGVFTKDQIESYIDIKWPEVYKFEHTPHPAEFEMYYSV

SEQ ID NO: 4198 - protein, 267 aa, Triticum aestivum
  misc_feature (76)..(76): Xaa can be any naturally occurring amino acid
  unsure (1)..(267): unsure at all Xaa locations
QKKKEEEKAREKELNDLFKVAVSQPKVPVGVDPKSILCEFFKVGQCQKGFKCKFSHDLNVQRKGEKIDIYSDKRDXVCKHFLDAVEKKQYGWFWVCPNGGKECRYRHALPPGYVLKSQMKALLEEESKKVAIEDEIEDQRRKVQTTTPMTTELFMEWKRRKAEEKEAGLAALRADRAKNDRMSGRELFMADASVFIDDAEAYEVYERREEPQDNQEQGKKSQDEGPSSSTSNGKEADEEPDDEDLDDDDDLDLDELNELEASLSRTS

SEQ ID NO: 4199 - protein, 156 aa, Triticum aestivum
MDASATGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 4200 - protein, 387 aa, Gluconobacter oxydans 621H
MKTPNQYLASLPTTIFTIMSQLAVKHGAINLGQGFPDTEGPQDIIQVAADALRDGRNQYAPLTGLPELREAVAASNRRFYGLEVDPATEVVVTSGATEALAACLMAVVEPGDEVVVIEPLYDTYLPALKLLGAVPRCVRLAPPHWSVPEAELRAAFGPKTKAIMLNSPMNPSGKVFVREELELIADLVREHDVYAICDEVYEHLTFHVKHIPLMTLPGMRERCMRIGSAGKSFSLTGWKVGYVTAPAALASVVAKAHQVLVFATAPNLQRAVAYGLNKDDGYYEGLSAQMETQRDLLRDGLHRLGFETLPADGSYFIVADISRHAAGRGDVEFARWLVEHAGVATIPVSAFYDPQGDAPPQNLIRFAFCKKPEILREALKRLEKALS

SEQ ID NO: 4201 - protein, 327 aa, Clostridium tetani E88
MKKAILKLLKLNRDTFLSGQCISDEFQVSRTAIWKCMNSLKEAGYEIESIPNRGYKLISTPDILTYEEIEPYLNTINMGRNIMYYKEVDSTNNKAKELALNSPEGTVVISELQTSGRGRLGRDWYSPFGKGIYMSTILKPDVDPVNASKITQIAAAALCKSFNEIGIKSYIKWPNDIIINNKKVCGILTEMDAELNQINYIVLGIGINVNMEKDSFPEEISTIASSLKIESGIHINRQELVSTILNNFEILYNEYLNKKNILSSIKICRENSILLGKEIKIIKGNEVLQGTAMDIDDEGLLIIKDKDDNLNKIISGEVSIRGLNSYI

SEQ ID NO: 4202 - protein, 440 aa, Staphylococcus aureus subsp. aureus COL
MSNGKELQKNIGFFSAFAIVMGTVIGSGVFFKISNVTEVTGTAGMALFVWFLGGIITICAGLTAAELAAAIPETGGLTKYIEYTYGDFWGFLSGWAQSFIYFPANVAALSIVFATQLINLFHLSIGSLIPIAIASALSIVLINFLGSKAGGILQSVTLVIKLIPIIVIVIFGIFQSGDITFSLIPTTGNSGNGFFTAIGSGLLATMFAYDGWIHVGNVAGELKNPKRDLPLAISVGIGCIMAVYLLINATFLLTLPIELLAGNLNAASDTSKILFGENGGKIITIGILISVYGTINGYTMTGMRVPYAMAERKLLPFSHLFAKLTKSGAPWFGAIIQLIIAIIMMSMGAFDTITNMLIFVIWLFYCMSFVAVIILRKREPNMERPYKVPLYPIIPLIAILAGSFVLINTLFTQFILAIIGILITALGIPVYYYKKKQKAS

SEQ ID NO: 4203 - protein, 482 aa, Escherichia fergusonii
MSDAPIIAVVMAGGTGSRLWPLSRELYPKQFLQLSGDNTLLQTTLLRLSGLSCQKPLVITNEQHRFVVAEQLREINKLNGNIILEPCGRNTAPAIAISAFHALKRNPQEDPLLLVLAADHVIAKESVFCDAIKNATPIANQGKIVTFGIIPEYAETGYGYIERGELSVPLQGHENTGFYYVNKFVEKPNRETAELYVTSGNHYWNSGIFMFKASVYLEELRKFRPDIYNVCEQVASSSYIDLDFIRLSKEQFQDCPAESIDFAVMEKTEKCVVCPVDIGWSDVGSWQSLWDISLKSKTGDVCKGDILTYDTKNNYIYSESALVAAIGIEDMVIVQTKDAVLVSKKSDVQHVKKIVEMLKLQQRTEYISHREVFRPWGKFDSIDQGERYKVKKIIVKPGEGLSLRMHHHRSEHWIVLSGTAKVTLGDKTKLVTANESIYIPLGAAYSLENPGIIPLNLIEVSSGDYLGEDDIIRQKERYKHED

SEQ ID NO: 4204 - protein, 347 aa, Streptomyces avermitilis MA-4680
MRATTIHAPYDMRVEDVPEPVVRQPTDAVVRVLRACICGSDLWAYRGEAARQPGQRIGHEFLGIVEETGSEVTGVRRGDLVVAPFMWSDGVCDYCREGLTTSCEHGGFWGSVGHDGGQGEAVRVPYADGTLVQLPKDAASDEHLLSALLTLSDVMGTGHHAALGAGARPGATVAVVGDGAVGLCAVLAAKRLGAERIIALGRHEVRTDIARRFGATDVVAERGEAAVEAVRELTRGQGAHCVVEAVGTEQSMRTAVDITRDGGAIGFVGVPHGSGTGLDLGVMFDRNIALRGGVAPVRAYIPELLPDILAGRIDPSPVFDRTVDLEGVPEGYKAMDERTALKVLVTN

SEQ ID NO: 4205 - protein, 499 aa, Leuconostoc mesenteroides subsp. mesenteroides ATCC 8293
  misc_feature (342)..(475): Xaa can be any naturally occurring amino acid
  unsure (1)..(499): unsure at all Xaa locations
MKAAVWHGVKDVRVEDVELKPTKSNEVVVRVAYAGICGSDLHEYLEGPVFIPVDQPDELTGGQAPLTMGHEFSGVIEKVGPDVANFKVGDHVSINPTVTKGISSDDLDVYDGYSFIGLSTDGGFTSYVNVPEDNLYHLPEEFSLKLAATIEPTAVAVQAIKEADLRFGEKVVIFGAGPIGVLVAAAAKAAGATKIVAVDLSEIRLRKALEMGATDVINPSQVPDTVAAIKNIIPGGADASFEVAGVQPTFEQAIDATRPRGSVVIVSIFAKPISFNPMQLMNAGVKLTTTIAYSKETFQQTVALVSSGQINVEPVITDTISLDSIVSDGFESLTSDKSQAKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEHKAIISWHNGFYRCFITDCFCW

SEQ ID NO: 4206 - protein, 520 aa, Colwellia psychrerythraea 34H
MANKKSTVLMILDGWGYREETSSNAIHQANTPVLDNLKAKYPNMLIDTSGMAVGLPEGQMGNSEVGHVNLGAGRVVYQDFTRITKAISDGDFIENPTLCHAVDTATSNNKAVHIFGLLSPGGVHSHEEHIFAMMELAKKRGAQKVYLHAFLDGRDTPPRSAQASLEKAQQKFSKLFTETDTGEGQIASVIGRYYAMDRDQRWDRVEAAYNLMVNGEGLHQYNSALDALAAAYERNENDEFVGASAITSPSGKAIKVNDGDALIFMNFRADRARQFSRCFTDTNFNGFERKRIPAISNFVMLTQYAADIDAPSAFAPTPLTNVMGEWLAKHNKTQLRISETEKYAHVTFFFSGGKEDMFTGEERILVPSPDVATYDLQPEMNSTLLTDKLVGAIESGKYDFIVCNYPNGDMVGHTGSFDAAVKACEAVDTCVGRVVKAAQDNGGECLITADHGNAEQMQDPVSGQAHTAHTCEPVPLIYVGRNASPAASGTLSDISPSVLHLMGMEQPQEMTGSVLMQLIK

SEQ ID NO: 4207 - protein, 594 aa, Zea mays
MVKRSKKSKSKRVTLRQKHKVQRKVKEHHRKKRKEAKKAGKAGQRRKVEKDPGIPNEWPFKEQELKALEARRAQALQELELKKQARKERAQKRKAGLLEDEDIASLASAASAQGSEFAAKENAPLLVAKINDHSERSFYKELVKVIEASDVIMEVLDARDPLGTRCIDMEKMVRKADPSKRIVLLLNKIDLVPKEAVEKWLTYLREELPTVAFKCNTQEQRTKLGWKSSKLDKTSNIPQSSDCLVAENLIKLLKNYSRSHELKLAITVGIVGLPNVGKSSLINSLKRSRVVNVGSTPGITRSMQEVQLDKKVKLLDCPGVVMLKSSNSGVSVALRNCKRVEKIEDPVAPVKEILSICPHEKLLSLYKVPNFGSVDDFLQKVATVRGKLKKGGVVDVEAAARIVLHDWNEGKIPYFTLPPKRDAGEDSDAVIISEDGKEFNIDEIYKAESSYIGGLKSIEEFHHIEIPPNAPLAIDEEMLEDGGKKPSEAIQESRDREEQMPDVKDSGGSKAASASTQNDKLYTADAILDPHKRKAEKKRRKASRPSALNDMDADYDFKVDYRMEDGGSEGAHADDEDGGDGSEDNEPMTGVDDA

SEQ ID NO: 4208 - protein, 142 aa, Photobacterium profundum SS9
MTIEKTFSIIKPDAVKRNLIGAIYQRFENAGLKIVASKMVHLDATKAQGFYAEHEEKPFFNELVEFMTSGPVMVQVLEGEDAIHRYRELMGTTNPENAACGTIRSDFALSMRYNSVHGSDSPESAAREIAYFFTEDEICPRD

SEQ ID NO: 4209 - protein, 280 aa, Mesorhizobium loti MAFF303099
MATVEPGIARHYDIAGLEQRILAALADTGVDVAHLRADDLEAVDEFHIGGVAATRELIGQMGLKPGAMLLDIGSGVGGPARFAANEAGADVTGIDLTQSYVDIATSLSKRAGMADRTHFVQGSALDMPFADAGFDAAMILHVGMNLPDKKKLMGEAARVLKPGGVFAVYDVMRLKDGALTYPLPWASDESMSFVATPDDYRSAATASGFSVVAERRRGAFAIEFFAAMRARMAAAQAEGKKPPPGVGLVMGEDARSKIANITAALEGGILAPVELLLRLG

SEQ ID NO: 4210 - protein, 258 aa, Triticum aestivum
RGRGRGGRGGEEMKSAAKAAGVTAHYYEDEAAPTGTCAVCVVGGERSLIANLSAANCYESEHLKKPENWALVEKAKYIYIAGFFLTVSPESIQLVAEHAAANNKVFLMNLSAPFICEFFRDAQEKVLPYADYIFGNETEARIFSKVRGWETENVEEIALKISQLPLASGKQKRIAVITQGADPVVVAENGKVKTFPVILCPKEKLVDTNGAGDAFVGGFLSQLVQGKSIEDCVKAGCYAANVIIQQSGCTYPEKPDFN

SEQ ID NO: 4211 - protein, 54 aa, Oryza sativa
APVAEKGKLRSWVGPNGQYYHELCCPSCRGRGYTPCKQCGIDRSSLDCPMCNAK

SEQ ID NO: 4212 - protein, 250 aa, Leptospira interrogans serovar Lai str. 56601
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAELF

SEQ ID NO: 4213 - protein, 1113 aa, Pseudomonas fluorescens PfO-1
MAKKPKAATFIKDPLWYKDAVIYQVHVKSFFDSNNDGIGDFPGLIAKLDYIADLGVNTIWLLPFYPSPRRDDGYDIAEYRGVHSDYGTMADAKRFIAEAHKRGLRVITELVINHTSDQHPWFQRARKAKPGSAARDFYVWSDDDQKYDGTRIIFLDTEKSNWTWDPVAGQYFWHRFYSHQPDLNFDNPQVMKAVLSVMRYWLDMGIDGLRLDAIPYLIERDGTNNENLPETHDVLKQIRAEIDANYPDRMLLAEANQWPEDTQLYFGDTDAEGVNGDECHMAFHFPLMPRMYMALAQEDRFPITDILRQTPEIPANCQWAIFLRNHDELTLEMVTDKERDYLWNYYAADRRARINLGIRRRLAPLMERDRRRIELLNSLLLSMPGTPTLYYGDEIGMGDNIYLGDRDGVRTPMQWSIDRNGGFSRADPASLVLPPIMDPQYGYQSVNVETQAGDPHSLLNWTRRLLAVRKQSKAFGRGTLKMLSPANRRVLAYTREYTGPDGKHEIILCVANVSRSAQAVELDLSAYVGMVPVEMLGGNAFPPIGQLSFLLTLPPYGFYWFGLAAENQMPSWHVEPAQSLPDFTTLVLKKRMEELLEAPSRATLEQAILPSWLQNRRWFAGKDADIEQVKLAYGVRFGDAQHPVLFSEIEVQSGGQTSRYQLPFGFISEDQVGPALPQQLALARVRRVRQVGLITDAFSLEAFIRAVLQGMQGGTVLESIEGEIRFEATPQLEKLGLGAESEVRYLSAEQSNSSVVIGNSLVLKLIRKVASGVHPELEMSAYLTAAGFANISPLLGSVIRRDGKGEDNLLMIAQGYLSNQGDAWEWTQNNLERALRDELADAVSEQAQHYNALGELKDFAGMLGQRLGEMHQVLAAPSDNQDFAPQVSSAKDAQATGKDVAAQVEHALKLLKQHQGELDAADQKLVGRLLDHKKAILAHVQELAKQSAGGLRIRVHGDLHLGQVLVIKGDAYLIDFEGEPARPLAERRGKHSPYKDVSGVLRSFDYAAAMALNVHNVDNSPEAEAARRRVTERYLREAREAFLQAYRQAAASLDHAWQDPEGADAALALFGLEKAAYEVAYEAENRPTWLPVPLHGLYGLLTGLKPFSDLGGE

SEQ ID NO: 4214 - protein, 385 aa, Mycobacterium tuberculosis CDC1551
MEVSRALLFELGVLLAVLAVLGAVARRFALSPIPVYLLAGLSLGNGGILGVAAAGEFIATGAPIGVVLLLLALGLEFSATEFASSLRHHLPSAGVDIVLNATPGAVAGWLLGLDGVAILGLAGVTYISSSGVIARLLEDLRRLGNRETPAVLSVLVLEDFAMAAYLPLFAVLATDGSWLEAVVGMTVAIAALLGAFAASYRWGHHVGRLVTHPDSEQLLLRVLGITLIVAAVAESLHASAAVGAFLVGLTLTGETADRARMVLTPLRDLFATIFFLGIGLSVDPGKLVSMLPVALALAAVTAATKVATGMFAARREGVARRGQLRAGTALVARGEFSLIIIGLAGASIPGVAALATAYVFVMAIVGPILARYTGGGLPAAAVASN

SEQ ID NO: 4215 - protein, 288 aa, Acidovorax sp. JS42
MPPDLIASPPHPMTASASPLPPIAFIGGGNMASAIIGGLLQRGLPAGQIEVVEPFEPARAALREKFGITAQPAAGDALARAALVVWAVKPQTFKEAAAATRAHTATALHLSVAAGIPTDSIARWLDTQHIVRAMPNTPALVGKGITGLFARPQVDPQGKALVERVIATTGQFVWVEAEEQLDAVTALSGSGPAYVFLFLEAMTQAGVDMGLPPAQAYQLAVATFQGASELAARSPESAEVLRQRVTSKGGTTHAAITHLQAAQVPAHFIAAMRAAEARAKELAAEFGA

SEQ ID NO: 4216 - protein, 376 aa, Pythium splendens
MADEDVQALVVDNGSGMCKAGFAGDDAPRAVFPSIVGRPKHLGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVIVIGNERFRTPEVLFQPSLIGKEASGIHDCTFQTIMKCDVDIRKDLYCNIVLSGGTTMYPGIGERMTKELTALAPSTMKIKVVAPPERKYSVWIGGSILSSLSTFQQMWISKAEYDESGPSIVHRKCF

SEQ ID NO: 4217 - protein, 538 aa, Brucella melitensis 16M
MKEASMAPRVLVSDKLSPTAVQIFKDRGVDVDYLPDLGKDKEKLLEVIGEYDGLAIRSATKVTEKLIAAAKKLKVVGRAGIGVDNVDIPAASRRGIIVMNTPFGNSITTAEHAIALMFAVARQLPEADTSTRAGKWEKNRFMGVEITGKTLGVVGCGNIGSIVATRGIGLKMHVVAFDPFLSDARAQELGVEKVELDELLARADFITLHTPLIDKTRNIINAQTLAKMKPGVRIVNCARGGLIVEKDLIAALKSGHVAGAGIDVYETEPATENELFSLPNVVCTPHLGASTSEAQENVALQVAEQMSDYLVKGAVSNAINMPSITAEEAPRLKPFVKLADVLGAFVGQVTDEPIQEVEVLFDGSTASMNTRALLSAALAGLIRSQVADVNMVSAPIMVKERGIIVSEVKRDKSGIFDGYIKLTVKTTVRERSIAGTCFSDGKPRFIQIKGINLDAEVGPHMLYVTNKDVPGMIGLLGTICGKHDVNIANFALGRDHPGGDAIAMLYVDEQIPQAALDELMAQEAIRAATPLEFNVGEV

SEQ ID NO: 4218 - protein, 475 aa, Lactobacillus plantarum WCFS1
MKASQRLLVKKSVNPANFNKGGLEKTLSAFSLTMMGVGAIVGSGIFITPGIIAAKYAGPAAMLSFVIAAVVCSLAALCYAEFSSTIPLAGSAYTYVYTVFGEFLAWILGWSLISEYLFAVSSVAVSWSSYFQNLMSGFGLKLPTFLTAAAGTAGVSGAGFNLIAFVVVLAVSLLLVGGLQESTRVNSIMVIVKILVIVLFIGVAIFFVKPANYHPFMPHGVSGLVKGASLAFYAYIGFDAVSTASEEVKNPKRNMPIGIVGSLVVASILYVAMAAVLVGVVHYSKLNVGDPVAYALAVIHQNWAAGIVSLGAVVGMTTVLIVMLYGGTRLLFAISRDGLLPKVFRTVSPHTKVPVKSTWIFGIIASVFAAVIPLDKIAELVNIGTLFAFAMVSIGVVFLRRHETLQQINSSFKVPFYPVLPVVSFLACVYLMLNLQAFTWHMFGIWLVIGIVIYFAYSYRHSRIRAGLRAKESKS

SEQ ID NO: 4219 - protein, 440 aa, Nostoc sp. PCC 7120
MSNQGAFDGAANVESGSRVFVYEVVGMRQNEETDQTNYPIRKSGSVFIRVPYNRMNQEMQRITRLGGKIVSIQTVSALQQLNGRTTIATVTDASSEIAKSEGNGKATPVKTDSGAKGFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNEKTHTYICGLRGMEEGIDAALSAAAAKEGVTWSDYQKDLKKAGRWHVETY

SEQ ID NO: 4220 - protein, 254 aa, Methanococcoides burtonii DSM 6242
MASYKLMVKDVIKQADILLEVVDARFPDETRNLEVERDVKRSGKPLIIVLSKCDLVSKETLQKAKSRLSKVAPTVFVSSKERYGTTMLRHKILEIADIQGRNILIGSLGYPNTGKSSVINGVAGKNKAGTSSISGHTKGVQIVKAGSRIVFIDTPGVIPFGDNDEYRQGLLGVKDATHLNDPIGVAMKIIAHICDNNKSVLEEFYNIEIKENNPEKVLELIGLKGNCLKKGGEVDEMRIAIKIINDWQRGKMLI

SEQ ID NO: 4221 - protein, 112 aa, Arabidopsis thaliana
MPSLQTSLPPELANNVVRLYRECLRRAKFIGKQSLSNLEQNVERFSFVSVDSLEQHNTELVVGMVRQQFKKHMNETDPEKIQKLKDDAARGLINHMLFESAKLTGGKVSQRS

SEQ ID NO: 4222 - protein, 527 aa, Zea mays
  misc_feature (338)..(338): Xaa can be any naturally occurring amino acid
  unsure (1)..(527): unsure at all Xaa locations
MGKGISGDARLAAAPYDQWVLLSPAGGSPRPPARYKHAAQVVQDKLYVVGGSRNGRSLSDVQVFDFKTSSWSALSPARGSKHPNHENDATGGSFPALAGHSMVKWKNYLLAVAGSTRSSSSLNKVSVWLIDVQANSWSAVETYGKVPTARDGQSVSILGSRLLMFGGEDNKRRLLNDLHILDLETMMWEEVKSEKGGPAPRYDHSAAVYADQYLLIFGGSSHSTCFNDLYLLDLQTLEWSQPDAQGAHITPRSGHAGAMIDENWYIVGGGDNASGSTDTVVINASKFVWSVVTSVSARDPLACEGLTLCSTTVDGEKVLIAFGGYNGKYSNEELFASXIFVLKPKPRNLVQPRLLQSAAAAAAAASVTAAYAVITATDEKTRDIVATDDFDIKRAQPASNSKKFVAEIDVLNGENGKLAARLAEVRDENSKLKDKLDMTNLSYGELAKELKSVQDQLAAEGSRCQKLESQIAAARKRLESAGSLENELEVLHQHISQVEETIATTQRRKSGGVWKWVAGSTEVSDDE

SEQ ID NO: 4223 - protein, 463 aa, Pseudomonas syringae pv. tomato str. DC3000
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPDIAIWMFTLVITLLLTATNLFSVKNYGEFEFWFALIKVVAIIAFVVLGVAAIFGLLPTSSVSGVSHLFDTGGFLPNGMGAVLAAMLTTMFSFMGTEIVTIAAAESRNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYVAPAAVFDFLLASSGAIALLVYLVIAVSQLRMRQKRIAAGETIDFKMWLFPWLTWAAIAFIVAVLTIMLIQQEHRVEIIATGVLSLLVIGAGLIVSRRRKAGPVGAAALG

SEQ ID NO: 4224 - protein, 291 aa, Debaryomyces hansenii CBS767
MGTQKKEKSRRVRQNDVRDGNLRVKGENFYRDSKKVKHLQMYKTGRAVRNAKGEIIQAAALQSTDLPTARVDPNRKWFGNTRVIAQDALSHFREAMGDKKNDSYQVLLRRNKLPMSLLDEKDQTESPTLKILETETYEQVFGPKQQRKKPRYLAVSNLEELAQLTEEDSKTYEEKQELDSTLGLMGGSILDKDDFTQEAKEAIFHKGQSKRIWNELYKVIDSSDVVIHVLDARDPLGTRCQSVEKYIREECSHKHLVYVLNKCDLVPTWVAVRIRLLCHFIMLCGFFSFSN

SEQ ID NO: 4225 - protein, 490 aa, Novosphingobium aromaticivorans
MGVTIPPLERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 4226 - protein, 221 aa, Griffithsia japonica
ARGSLGSIFSVYYRKSAPGKEGDTSDLLQRPGFEQVAAGYCVYGSTTYLTFSMGYGVHVFILDTLSGHFVLAKQHVQTPKAGPIYSVDTSVLPNVVDGVRKYVDLLEAEGSGKKFRHLNNLVANFHNVLTKGGILMLPGPQKQDLAKFLTEAAPLAFVARQAGARASVGKRNLLELSAWSLEMSVPLFVGSTADVDRLEEMVLGHAVEEKNSVDPSTMHKI

SEQ ID NO: 4227 - protein, 373 aa, Pseudomonas aeruginosa UCBPP-PA14
MALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPAAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLSRLQEAVERIARGLKNWRP

SEQ ID NO: 4228 - protein, 659 aa, Oryza sativa
MVGVLLLLSIMPLAAGELLAQLCGNGGNYTANGTYQSNLARLAAALPSNASSSPDHFATATAGQAPDAAYALALCRGDVANATACGDCVAASFQDARRTCPSDKSATIYYDDCLLRFAGDDFLAAPNITENATLFQAWNQQNITGDAAVAAANVRELLTVTARTAAAAARRFATGFMDGSSESKQTLYSLAQCTPDLAAGDCLACLQRLIAMVNSTTSVRLGGRVLLLRCNLRFEAFVFYAGEPTRRVSPPGSTPAPDSIAPTKNRKKSKSWVIAAIAAPVAAVVLCLIVCYYCRWSRRFRKDRVRLREKRSRRFRGDELICEMEGEISEFSVFEFREVIKATDNFSEENKLGEGGFGPVYKGLFSEGLEIAVKRLASHSGQGFLEFKNEVQLIAKLQHRNLVRLLGCCSQGEEKILVYEYLPNKSLDFYIFDERKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMLRCINIALLCVQENAVDRPTMSNVVAMLSSESMVLDEPKHPAYFHVRVTKNDESSTVGTCSTINDVTTNY

SEQ ID NO: 4229 - protein, 458 aa, Pseudomonas aeruginosa PAO1
MSVPQRAVQLTEPSEFLKEHPEVQFVDLLIADMNGVVRGKRIERNSLNKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLNHVNDALKACDHAVLLKRLVKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLAAVLAGVHHGLTNKVEPGAPIEGNSYEQMEPSLPNNLRDALRELDESEIMAKYIDPKYIDIFVACKESELEEFEHSISDLEYNWYLHTV

SEQ ID NO: 4230 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGGSHSSIFDASAGIQLSPKFVKLVSWYDNEYGYSTRVVDLVEHVAKA

SEQ ID NO: 4231 - protein, 148 aa, Triticum aestivum
  misc_feature (116)..(116): Xaa can be any naturally occurring amino acid
  misc_feature (131)..(131): Xaa can be any naturally occurring amino acid
  unsure (1)..(148): unsure at all Xaa locations
MSAASKKLFQAASSPALPASLRAVLAAEGRTAALATLTNFGRKALPTAYFSYHRQGSHHAASGWGAIAAAVPAAVYMLQDQEAHAAEMERTFIAISPAGVQRGLISEIMSRFERKXYKLVAIKLIVPSKEXAEKHYHDLKERLSQWVV

SEQ ID NO: 4232 - protein, 452 aa, Pseudomonas aeruginosa PAO1
MTTKLDQLTSWLKERKITEVECLISDLTGIARGKISPTNKFIAEKGMRLPESVLLQTVTGDYVEDDIYYDLLDPADIDMVCRPDENAVFLVPWAIEPTAMVIHDTFDKLGNPIELSPRNILKRVLKMYADKGWRPIVAPEMEFYLTKRSDDPDYPLQAPVGRSGRQETGRQSFSIDAANEFDPLFEDMYDWCEAQGLDLDTLIHEEGTAQMEINFRHGDALDLADQILVFKRTMREAALKHNVAATFMAKPMTGEPGSAMHLHQSIVDVKTGKNIFSNADGTMSELFLHHIGGLQKFIPEVLPLFAPNVNSFRRFLPDTSAPVNVEWGEENRTVGLRVPDSSPENRRVENRLAGADANPYLALAASLLCGYIGMVEGIKPSAQVKGRGYERRNLRLPLTIEAALERMENCKPLEQYLGSKFISGYVAVKRAEHENFKRVISSWEREFLLLSV

SEQ ID NO: 4233 - protein, 797 aa, Salmonella enterica subsp. enterica serovar Paratyphi A str.
MSQPTFNKDQFQAALTRQWQRFGLLSASDMTPRQWWQAVSGALAELLSAQPVAQPTKGQRHVNYISMEFLIGRLTGNNLLNLGWYQDVSDVLKAHDINLTDLLEEEVDPALGNGGLGRLAACFLDSMATVGQSATGYGLNYQYGLFRQSFVEGKQMEAPDDWHRGSYPWFRHNEALDVQVGIGGKVTKEGRWKPGFVITGQSWDLPVLGYRNGVAQPLRLWQATHAHPFDLTKFNDGAFLRAEQQGIDAEKLTKVLYPNDNHTAGKKLRLMQQYFQCACSVADILRRHHLAGRKLHELADYEVIQLNDTHPTIAIPELLRVLLDEHQMSWDDAWAITSKTFAYTNHTLMPEALECWDERLIKALLPRHMQIIKQINDRFKALVYNTWPGDKQVWAKLAVVHDRQVRMANMCVVSGFAVNGVAALHSDLVVKDLFPEYHQLWPNKFHNVTNGITPRRWIKQCNPQLAALLDKTLKKEWANDLDQLINLEKYADDATFRQQYRDIKRANKERLVKFIQARTGIEISSHAIFDIQIKRLHEYKRQHLNLLHILALYKEIRENPQADRVPRVFLFGAKAAPGYYLAKNIIFAINKVAEAINNDPAVGDKLKVVFLPDYCVSAAEMLIPAADISEQISTAGKEASGTGNMKLALNGALTVGTLDGANVEIAEKVGEENIFIFGHTVEEVKALKAKGYDPVKWRKKDKVLDAVLKELESGQYSDGDKHAFDQMLHSLGKQGGDPYLVMADFAAYVEAQKQVDALYRDQEAWTRAAILNTARCGMFSSDRSIRDYQARIWQAKR

SEQ ID NO: 4234 - protein, 466 aa, Amycolatopsis mediterranei
MPTTPDDIQRLIADEDVEVIDVQFCDLPGVMQHFTVPAKAFTEEAYEEGLAFDGSSVRGFQSIHESDMLLLPDAATARIDPFRKAKTLALNFFVHDPFTREAYSRDPRNIARKAEQYIAEYGVADNVYFGPEAEFYIFDSIRFDSAEHASFHEIDSVEGWWNTGADEVGGNQGYKTKFKGGYFPVPPVDHFADLRDDIVRNLQGSGFEIERAHHEVGTAGQTEINYKFNTLLHAADDLQLFKYIVKNTVFAAGKTATFMPKPLAGDNGSGMHCHQSLWKDGQPLFHDESGYAGLSDTARHYIGGLLKHAPSLLAFTNPTVNSYHRLVPGFEAPVSLVYSQRNRSACVRIPITGNNPKAKRAEFRCPDSSGNPYLAFSAMMMAGLDGIRNKIEPPEPIDKDLYELPPEEAKDVKLVPGDLGTVLNTLEGGVFTPDVIETWISYKRENEIDPLRLRPHPYEFSLYYDV

SEQ ID NO: 4235 - protein, 398 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMFLSGGQSEVEATLNLNAMNQAPNPWHVSFSYARALQNTCLKTWGGRPENVNAAQTTLLARAKANSLAQLGKYTGEGESEEAKEGMFVKGYTY

SEQ ID NO: 4236 - protein, 263 aa, Haemophilus influenzae 86-028NP
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 4237 - protein, 195 aa, Triticum aestivum
  misc_feature (92)..(92): Xaa can be any naturally occurring amino acid
  unsure (1)..(195): unsure at all Xaa locations
RVLKPRVPPPSQAIYLHISAWPPTVRALSATSVGPFQGVKSTAGLPVSRRSNGDSLGSVSNGGRIRCMQVWPIEGIKKFETLYYLPPLSTEXLLKQVDYLIRSKWVPCLEFSKVGFIFREHNASPWYYDGRYWTMWKLPMFGCTDATQVINEVEEVKKEYPDAYVRIIGFDNMRQVQCVSFIAFKPPGCEESGKA

SEQ ID NO: 4238 - protein, 264 aa, Debaryomyces hansenii CBS767
AAWVKHLSKSYPTLAFHASITNSFGKGSLIQLLRQFSSLHSDRKQVSVGFIGYPNTGKSSIINTLRRKKVCTVAPIPGETKVWQYITLMKKIFLIDCPGIVPPSLKDTESDILFRGVVRVEHVSNPEQYIPDMLTKCERKHLERTYEIKGWANFEENPELLETASTQFIELIARKGGRLLKGGEPDESGVSKQVLNDFNRGKIPWFVPPPKDEEEKSGEDKKASYKRKRAEREEKKEAKKHKAEATDATDATATDDGQWEGIKD

SEQ ID NO: 4239 - protein, 217 aa, Oryza sativa
MAGRIGAARWLEPGGKGWLHGSARLGAMTAWGWMKTTMMVASVAEAEVVAEAAPLRGERSMAKLYVQAVQPADLNKNTEWFMYPGVWTTYILILFFSWLLVLSVFGCTPGMAWTFVNLAHFAMTYHFFHWKKGTPFADDQGMYNRLTWWEQMDNGKQLTRNRKFLTVVPLVLYLIALHTTDYQHPMLFLNTIAVVVLVVAKLPNMHKVRIFGINAGN

SEQ ID NO: 4240 - protein, 241 aa, Oryza sativa
MGTTSSPDTMAAAAGPSLSITVEKNPPEARLLQLGIKSWPKWGCPPGKFPLKFDARLTCYLLKGRVRASVKGTGRCVEFGAGDLVVFPKGLSCTWDVVVGIDKHYNFDSYGLEPSFGPGGRVVTDGRAIRFLGSARRDYSLFVNIYFIFTNISNTGDKEKETPVNTNGGNTASNSSGGTFLGLSFPSSLLVYDSPSRDRTLQRSLVLESSPMNSPITAVSGGPMSGLSRDIVVEGYCRYCG

SEQ ID NO: 4241 - protein, 659 aa, Schizosaccharomyces pombe
MVKRRLSAFGNAFLIYFIIFRLCCCSPQTSHWCKYPALCLKSPDTHNENLVCDAYLSVIATKSEEKEASNPTTWDFTPTNKYQEPSFHTKTSLNGSDTISSNFLSKYEYSNGTSTSEFIDSISPPLVNETSTISSSKKLEQNYSVTEVIDTNIITSSSVTLPISEDGSSTSAAATIDSNIDEKTVAFSEEKRFNFASTDCAAAVIKTNPEAVGSSSILTENKDKYMLNKCSAENKFVVIELCEDIYVDTVQIANFEFFSSIFRDFKVSVSGKYPKYESSWMELGTFTALNLRTLQSFHIENPLIWAKYLKIEFLTHYGSEFYCPVSLLRVYGKTMIEEFEEANEDFLEQKVNDGSAIKADEIRKPQESPIFVDEEDTDVQSKPVRKNPSVELNSTDTLLSSTVISKSLSTVVIGNETGKSESYPATSTRSFNDISPSSSSSYSTAQISTFPSNQESIYKNINKRLSTLEERKKAFDEIVEKILTNYGKHNAKNMNFTQLLHELNSTLQLEISKLSKSVVKPSLFALQAKLELLSAENEYFQSQITSLYQESSFQKRLLMLQLTVLIVLTVYMAVSRLPENLPTTRSSSNNPIEASRPPFSRDEQDISKANDFRVSASSAVYTVGPELLQRKKRDPNTSIRSIHEREQDKIIHSRSHSVC

SEQ ID NO: 4242 - protein, 223 aa, Campylobacter jejuni RM1221
MIFAANLKCNHTRASFKIYAEILNKTMGAKCDDIIVFPPSVAFLENENNFIQGAQNFYPCVNGAFTGELGKEHLDEFGIKCVLIGHSERRALGDEEFIKAKFDFAKEHGYKIVFCIGENLDTKNSGKTLEFLKKQLEIIDLNYEKLIIAYEPIYSIGTGVSAQSTDIAKVLEFLASLTKVPLLYGGSVNENNIKEILSVNHCGGVLIGSAALKVENFIKLIKG

SEQ ID NO: 4243 - protein, 332 aa, Campylobacter jejuni RM1221
MAVKVAINGFGRIGRCVARIILERNDIELVAINDTTDIELTKYLFKYDTVHGEFKGSVDSEGDDLVVNDKKIKVFKSRNVKDLDFAKHGAQIVLECTGAHLTMAKSQEFIDMGVQKVIMSAPAKDDTPTYVLGVNSELYKGESIISNASCTTNCLGPVCRVLQDNFGIEKGLMTTIHAYTNGQSIIDAKAKDKRRSRAAAQNIIPTSTGAAKAMKLVMPELNGKLHGQSMRVPVIDVSSVDLTAQLSRKVSKDEINEAFRKAAATNLKGILMVDDDERVSSDFITCSYGAIVVSDLTQVIADDFIKVIAWYDNEWGYSSRLVDMAVYIANKA

SEQ ID NO: 4244 - protein, 815 aa, Salmonella enterica subsp. enterica serovar Paratyphi A str.
MNAPFTYASPTLSVEALKHSIAYKLMFTIGKDPVIANKHEWLNATLFAVRDRLVERWLRSNRAQLSQETRQVYYLSMEFLIGRTLSNALLSLGIYDDVKGALEAMGLDLEELIDEENDPGLGNGGLGRLAACFLDSLATLGLPGRGYGIRYDYGMFKQNIVDGRQKESPDYWLEYGNPWEFKRHNTRYKVLFGGRIQQEGKKARWIETEEILAVAYDQIIPGYDTDATNTLRLWNAQASSEINLGKFNQGDYFAAVEDKNHSENVSRVLYPDDSTYSGRELRLRQEYFLVSATVQDILHRHYQLHKTYENLADKIAIHLNDTHPVLSIPELMRLLIDEHKFSWDDAFEVCCQVFSYTNHTLMSEALETWPVDMLGKILPRHLQIIFEINDYFLKTLQEQYPNDTSLLGRASIIDESNGRRVRMAWLAVVVSHKVNGVSELHSNLMVQSLFADFAKIFPTRFCNVTNGVTPRRWLALANPPLSDVLDENIGRTWRTDLSQLSELKQHCDYPLVNHAVRQAKLENKKRLAVVIAQQLNVVVNPKALFDVQIKRIHEYKRQLMNVLHVITRYNRIKENPEADWVPRVNIFAGKAASAYYMAKHIIHLINDVAKVINNDPQIGDKLKVVFIPNYSVSLAQVIIPAADLSEQISLAGTEASGTSNMKFALNGALTIGTLDGANVEMQEHVGEENIFIFGNTAEEVEALRRQGYKPRDYYEKDEELHQVLTQIGSGVFNPEEPGRYRDLVDSLINFGDHYQVLADYRSYVDCQDKVDELYRRPEEWTTKAMLNIANMGYFSSDRTIKEYAENIWHIDPVRL

SEQ ID NO: 4245 - protein, 154 aa, Griffithsia japonica
HEARLHPRLYTPHTHHTSFLSRANQPPPHTMSGKVKKTSQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKSKGDASQEV

SEQ ID NO: 4246 - protein, 495 aa, Oryza sativa
MAEVALFRGPTNLASPASRSSSSSSSSSLRYLATSDGDVLPRRSSSGSGSSLGSTGSLGIQERREEEGGESEEEEEEWSFLALLLALLRKSLLGCSAEDGGGGEGMEIGWPTDVQHVAHVTFDRFHGFLGLPVEFEPEVPRRAPSASASVFGVSTESMQCSYDSRGNSVPTILLMMQRRLYEQGGLRAEGIFRISAENSQEELVRDQLNGGIVPEGIDVHCLAGLIKAWFRELPSGVLDSIPPEQVMQCQSEEDCARVAKCLPPTEAALLDWAVNLMADVVQEEQINKMNARNIAMVFAPNMTQMADPLTALMYAVQVMNFLKMLIQKTLKDREESDLDDLSLPQKDPSDENGHQTTGLSLDSHPDEGSRRPSFVSEEPLLNSPVHSTEEKPNKTNLAEGKFADSSCPENVALTSMETEGSTSCSQPALAAAAAAPRATAMNLLQGKGSRSLNSRRTRKGKVQFGTRAAPASEKSKGASIVSRINSKVERIEAWR

SEQ ID NO: 4247 - protein, 257 aa, Clostridium perfringens
MKAKSNNYRGKVDISVSQNFITSKNTIYKLIKKTNISKNDFVIEIGPGKGHITEALCEKSYWVTAIELDRSLYGNLINKFKSKNNVTLINKDFLNWKLPKKREYKVFSNIPFYITTKIIKKLLLEELNSPTDMWLVMEKGSAKRFMGIPRESKLSLLLKTKFDIKIVHYFNREDFHPMPSVDCVLVYFKRKYKYDISKDEWNEYTSFISKSINNLRDVFTKNQIHAVIKYLGINLNNISEVSYNDWIQLFRYKQKID

SEQ ID NO: 4248 - protein, 149 aa, Geobacillus kaustophilus HTA426
MAERTFIMVKPDGVQRNLIGEIVARFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAKREISLFFKEEELVSYSKQINAWLY

SEQ ID NO: 4249 - protein, 270 aa, Pyrus caucasica
AHYKSEADVGEAFAEAFKTGLIKREELFITTKIWNSDHGHVVEACKNSLEKLQLDYLDLYLVHYPMPTRHNAIGKTASLLGEDKVLDIDVTISLQQTWEGMEKTVTLGLVRSIGLSNYDLFLTRDCLAYSKIKPAVSQFETHPYFQRDSLVKFCIKHGVLPTAHTPLGGAAANKDMFGSVSPLDDPILNDVAKKYGKSVAQICLRWGIQRKTAVIPKSSKIQRLKENLVVLEFQLSDEDMQLIYSIDRKYRTSLPSKTWGLRRVCKGEFV

SEQ ID NO: 4250 - protein, 638 aa, Vibrio fischeri ES114
MTGYFLQAFIYLVAAVIAVPIAKRLGLGSVLGYLIAGVVIGPIIGLVGEETTTIQHFAEFGVVMMLFLVGLELEPKMLWNMRNRLMGLGGLQVVGTTAVVMGLAMFFGQSWTIALTIGLIFALSSTAIVLQTFNEKGLAKTEGGQNAFSVLLFQDIAVIPMLAFIPLLALPELVAKAQLAAATAAEHHEELTLVAGLPGWAYGLVITASIALVVVGGHYLSRPLFRFVASSGLREIFTATALMLVIGIAALMSLVGLSPALGTFLAGVVLANSEFRHELESNIDPFKGLLLGLFFITVGAGIDFGILFNDFFLIIGLTIGVMVLKAAVLYILALIFKIKNSNRWLFTLSLAQAGEFGFVLLSFTVQNHVLPQEVAQPLSLVVALSMFFTPGLFILFDKVILPKFEQQSNERESDTIEEKGTVIIAGGGRFGQVVNRFLVSNHVNTVVLDHQADQVDSLRKVNTKSYFGDATRPDLLHTAGIEHAAMLVVAIDNQESSIELVKYVKHTYPKVKILARAFDRGHSYMLRCAGADFIESETTRSALEMGAEAMRNLGQHPFHVEQQKIAYKKVENQSSDKLYQAWLDDSEGERFDNNYRKLFIELEGTIKHAMSKDRSDKHNQSERAWTPPPKGYADDIDE

SEQ ID NO: 4251 - protein, 253 aa, Borrelia burgdorferi
MRKTFLAGNWKMHYTSAEASIVAKKIATEVKTLKDDVVIMITPPFTALSKVSECIKGSNILLGAQNMSYMESGARTSEISPSMLLEFGVEYVILGHSECRLYLAETDEIINKKILAGLKHPFKYLILCVGETLDERDSGKTLEVVLNQVKKGLNCVSESDIQRIILAYEPVWAIGTGKTATKEEAEEVHKAIRLEITKLYTKSASDNIIIQYGGSVNSNNVKELMNEPNIDGALIGGASLKAESFLSIINNVL

SEQ ID NO: 4252 - protein, 128 aa, Arabidopsis thaliana
MSWAAPDDIFFSTSLAAYLDKKLLVLLRDGRKLMGLLRSFDQFANAVLEEAYERVIVGDLYCDIPLGLYIIRGENVVLIGELDVEKEELPAHMVQVPEAEIKRAQKAEKEEMLLKGTMRKRMEFLDLD

SEQ ID NO: 4253 - protein, 417 aa, Glycine max
AQSKDNVIAIMLDTKGPEVRSGDLPQPINLTTGQEFTFTIRRGVGTADCVSVNYDDFVNDVDVGDMLLVDGGMMSLVVKSKTEDSVKCEVVDGGELKSRRHLNVRGKSATLPSITEKDWDDIKFGVDNKVDFYAVSFVKDAQVVHELKNYLKSCDADIHVIVKIESADSIPNLHSIITASDGAMVARGDLGAELPIEEVPLLQEEIITICRSMGKAVIVATNMLESMIVHPTPTRAEVSDIAIAVREGSDAIMLSGETAHGKFPLKAVKVMHTVALRTEATIPGGQMPPNIGQVFKNHMSEMFAYHATMMSNTLGTSTVVFTRSGFMAILLSHYRPSGTIFAFTDQKRIQQRLALYQGVCPIYMEFSEDAEETFTRALDLLQKQGMVKSGEEVALVQSGTQPIWRFQSTHNIQVRTV

SEQ ID NO: 4254 - protein, 373 aa, Rhodococcus sp. RHA1
MSGSIQRVARAVADLVDGNAIVLVGCGSTDPDGYLVVAAENASTSALDFMVRHTSGFICAAVTDDACARIDLPPMAGTRPTPGDDYTVAVDAAGVGTGISAKDRAWTLRQIADPFSTPGGFTRPGHHPIRAHSDGVLGRRRSAEAVIDLMRAAGLREVGALAALVSVVDPTGIADSTESLAFADAHQLNSISVQDIVNYRRSTEVHVRQTFRTLRNTSCGTVEALGYHSDVTNADYIAYSSGDPSTLSRARVHARFETDFAPHAPSVDQAEPDITDALDDRDGLVVIARRANDADDAHDMEQSDRPDCFFHNRYGERIADIAQILRAREVLEPRLVNPPPGLFEAWSTLSNSASTAVGQTAPQCVSPASPTRG

SEQ ID NO: 4255 - protein, 354 aa, Arabidopsis thaliana
MAASLVRSCCSRASRAITTVRFMSNVPEDTVYGGPKPQNSNQRVTLTQLRQKHRKGEPITMVTAYDYPSAVHIDTAGIDVCLVGDSAAMVVHGYDTTLPISLEEMLVHCRAVARGAKRPLLVGDLPFGTYESSTNQAVDTAVRVLKEGGMDAIKLEGGSPSRITAAKSIVEAGIAVMGHVGLTPQAISVLGGFRPQGKNIASAVKVVETAMALQEAGCFSVVLECVPPPVAAAATSALNIPTIGIGAGPFCSGQVLVYHDLLGMMQHPHHAKVTPKFCKQYAQVGEVINKALLEYKEEVSKHLFPGPSHSPYKISSSDLDGFLSELQKLGLDKAASDAAASAEKMDHSDSPSSQ

SEQ ID NO: 4256 - protein, 452 aa, Dactylis glomerata
MAQEEKEKPDESTSSRRPQAKETKPNPAPEPEPEMATVAMDISKPPPAAAGDDSAKGARAGGEGLRQYYLQHIHDLQLQIRTKTHNLNRLEAQRNDLNSKVRALREELQLLQEPGSYVGEVVKVMGKSKVLVKVHPEGKYVVDIDKSIDITKITPSTRVALRNDSYMLHLILPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGTGNGDSEVQRTMLELLNQLDGFEASNKIKVLMATNRIDILDQALLRPGRIDRKIEFPNPNEDSRGDILKIHSTTMNLMRGIDLKKIAGKMNGASGAELKAVCTEAGMFALRERRVHVTQEDFEMAVAKVMKKDNEKNMSLRKLWK

SEQ ID NO: 4257 - protein, 394 aa, Arabidopsis thaliana
MTTRKRQIKNFTSNFGPQHPAAHGVSRLVLEMNGEVVERAEPHIGSLHRGTEKLIEYKTYLQALPYSDRSDYVSMMAQEHAHSSAVEKLLNCEVPLRAQYIRVLFREITRISNHSLALTTHAMDVGALTPFLWAFEEREKLLEFYERVSGARMHASFIRPGGVAQDLPLGLCRDIDSFTQQFASRIDELEEMSTGNRIWKQRLVDIGTVTAQQAKDWGFSGVMLRGPGVCWDSRRAAPYDVHDQSDLDVPVGTRGDRYDRYCIRIEEMRQSLRIIVQCLNQMPSGMIKADDRKLCPPSRCRMKLSMESSIHHFELYTEGFSVPASSTYTAVEAPKGEFGVFLVSNGSNRPYRRKIRAPGSAHSQGLDSMSKHHMPADVVTIIGTQDIVFGEVDR

SEQ ID NO: 4258 - protein, 99 aa, Triticum aestivum
NAITSGVGFAVFQGGFFMIGQRFSRPQGVSEHNYYARTSSMLQNLGLEKYEKNFRKGHLTDHTLPLLTDSALKDVKIPPGPRLIILDQIKRDPGLAKAQ

SEQ ID NO: 4259 - protein, 124 aa, Griffithsia japonica
MSAKVKKASQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKTKGDASQEV

SEQ ID NO: 4260 - protein, 249 aa, Arabidopsis thaliana
  misc_feature (32)..(32): Xaa can be any naturally occurring amino acid
  misc_feature (57)..(57): Xaa can be any naturally occurring amino acid
  misc_feature (174)..(174): Xaa can be any naturally occurring amino acid
  unsure (1)..(249): unsure at all Xaa locations
VAEFVFSGQVNVRNHISTIVPPPSRLCLLVAXVRCLGYGASSEERTLAMIKPDGVSXNYTEEIKTFVVEAGFNIVKEMLTQLDKETASPFYEEHSSRSFFPHLVTYASGGPVLVMVLEKRNAVSDWRDLIGPTDAEKAKISHPHRFDLLPNTILDFANSNVRAKMNIVVSCITXNRSLTCYESLGCSLILFTYNMAFSCFCSIRALCGKNSQKNCVHGSDSTSSAEREIKFFFKDVVSGDIATQQHDEL

SEQ ID NO: 4261 - protein, 664 aa, Leuconostoc mesenteroides subsp. mesenteroides ATCC 8293
  misc_feature (173)..(199): Xaa can be any naturally occurring amino acid
  unsure (1)..(664): unsure at all Xaa locations
MYEVKIIARTVLPVKLNQELIVVVDDIRIDGMGIVYVTAKYPLYVADALPGEKVHLLVTQVDKFSGYAKVLDWLESSDKRQNSDRQYLIDAGTAPLVNLKYEAQLELKQAQVKRLFEEQHIDVSVDRTIGMDNPTYYRNKTIVPVKWQNDHLTSGFYKRGTHDLVPMDDYFVXXXXXXXXXXXXXXXXXXXXXXXXXXXAFMYEVKIIARTVLPVKLNQELIVVVDDIRIDGMGIVYVTAKYPLYVADALPGEKVHLLVTQVDKFSGYAKVLDWLESSDKRQNSDRQYLIDAGTAPLVNLKYEAQLELKQAQVKRLFEEQHIDVSVDRTIGMDNPTYYRNKTIVPVKWQNDHLTSGFYKRGTHDLVPMDDYFVNDAEIDQAIIVVRNILEKYDITAFDPDLERGAIRYIMIRRGYYSHELMVVLVSNEEVISHETEIIADIRNQLTELKSLILNYSPKKDYVLLSPNNRILWGEKAIYDTLLGYEFIIGPNSFYQVNPQTTEVLYDLAAQKADLKPTDTVIDAYSGIGTIGISVASRVKKVLGVEVVPGAVADAQLNLQVNNISNAEYILADAPVQFKKWQEQGLKPDVVFVDPPRRGLTTSLINGTTDMSPEKIVYISCNPVTLSRDAVEIIENGYHIDGSVLPVDQFPQTSHVESITVFRKD

SEQ ID NO: 4262 - protein, 686 aa, Triticum aestivum
  misc_feature (195)..(195): Xaa can be any naturally occurring amino acid
  misc_feature (654)..(654): Xaa can be any naturally occurring amino acid
  misc_feature (658)..(658): Xaa can be any naturally occurring amino acid
  misc_feature (675)..(675): Xaa can be any naturally occurring amino acid
  unsure (1)..(686): unsure at all Xaa locations
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSXKGRMAEAKRVLQGLRGREDVSGEMALLVEGLGVGKDTHFEEYIIGPDDELADDGLAPDEEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDSLNSPLISRQATSVEGKEIAAPHGSIMGGVGRSSSMQGGEAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAALSTISVIVYFCFFVMGFGPIPNIXCAEXFPTSVRGIWIAICALTXWIGDIIVTNLP

SEQ ID NO: 4263 - protein, 384 aa, Saccharomyces cerevisiae
MSTNTSKTLELFSKKTVQEHNTANDCWVTYQNRKIYDVTRFLSEHPGGDESILDYAGKDITEIMKDSDVHEHSDSAYEILEDEYLIGYLATDEEAARLLTNKNHKVEVQLSADGTEFDSTTFVKELPAEEKLSIATDYSNDYKKHKFLDLNRPLLMQILRSDFKKDFYVDQIHRPRHYGKGSAPLFGNFLEPLTKTAWWVVPVAWLPVVVYHMGVALKNMNQLFACFLFCVGVFVWTLIEYGLHRFLFHFDDWLPESNIAFATHFLLHGCHHYLPMDKYRLVMPPTLFVILCAPFYKLVFALLPLYWAYAGFAGGLFGYVCYDECHFFLHHSKLPPFMRKLKKYHLEHHYKNYQLGFGVTSWFWDEVFGTYLGPDAPLSKMKYE

SEQ ID NO: 4264 - protein, 453 aa, Campylobacter jejuni RM1221
MSECPFFPKPYKNKASTLLTFLLKRRSWLDGLYERSYKMQTGYVKMPNFDLYVINDTKEVKRMMVDEVREFPKSAFLHELLSPLLGESIFTTNGEVWKKQRELLRPSFEMTRINKVFNLMSEAVADMMDRFSKYPNHAVIEVDEAMTFITADVIFRTIMSSKLDEEKGKKILNAFVTFQEQSVHTAMRRMFRFPKWLSYVLGDCKRAKAGDVIRQVLSDIIKPRYDMADNAEFEDILGSLLLVVDADTNKRFSFEEILDQVAMLFLAGHETTASSLTWTLYLLSLYPKEQEKAYEEITQVLQGGVIEISHLRQFKYLTNIFKESLRLYPPVGFFAREAKKDTQVRDKLIKKGSGVVIAPWLIHRHEEFWTNPHGFNPSRFEGEYKKDAYLPFGVGERICIGQGFAMQEAILILANILKTYKLELEEGFVPDVVGRLTVRSANGMRIKFSKRKL

SEQ ID NO: 4265 - protein, 433 aa, Synechococcus elongatus PCC 6301
MVTSSPFKTIKSDEIFAAAQKLMPGGVSSPVRAFKSVGGQPIVFDRVKDAIAWDVDGNRYIDYVGTWGPAICGHAHPEVIEALKVAMEKGTSFGAPCALENVLAEMVNDAVPSIEMVRFVNSGTEACMAVLRVVRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 4266 - protein, 557 aa, Prochlorococcus marinus str. MIT 9211
MNIVFDPIADGLAAIRNGECVVVVDDESRENEGDLICAAQFATPQQVNFMATEARGLICLAMDGERLDQLDLPLMVDRNTDSNQTAFTISIDAGPEYGVSTGISAEDRARTIQVAINPKTKPTNLRRPGHIFPLKANKGGVLKRAGHTEAAVDLSLLSGLSPAGVICEIQNSDGSMARLPELQQYARSWGLKIISIADLIRFRLENERFVYRKAITKLPSIFGEFKAIGYKNELDGTEHIALIKGSEAEFKEPVLVRMHSECLTGDAFGSLRCDCRPQLEAALSRISKEGEGIVVYLRQEGRGIGLINKLKAYSLQDGGLDTVEANEKLGFPADLRNYGVGAQILSDLGVHRLKLLTNNPRKIAGLGGYGLKVESREPLVICPTDHNAAYLAVKRTKLGHYISEEDINPEKYLGKSIIAFWDGDYDIEDISMLEKGAESAATSRKINLTSQNSSRVNALLDRPLFIWRVIFEENKYVSEENIQIKSIYSFVKEISEWANTKRVGILFSKTLEQAIHPSHNFKNIKLKLKDLNQIDINNAIEENKGNQTISLAISWIA

SEQ ID NO: 4267 - protein, 402 aa, Burkholderia pseudomallei K96243
MKAVVFHGIGDIRIDTVPDPGLAQTTDAVVRLTSSAICGTDLHMVRGTLGGMKPGTILGHEGVGLVEEVGRDVRNLRRGDRVLIPSTISCGHCAYCRAGYTAQCDTANPGGPLAGTAFFGGPQASGAFDGLQAEYARTPFAHASLIRLPDSLDDERAILMSDIFPTGYFGAQLAEVRMGDTVAVFGAGPVGQFAIASAKLMGAGRVIAIDRVVSRLEMACAQGAEVINFDDDDPVDTILQLTGGIGVDRVIDAVGVDAVRPTRGPAAPHDAQSRRAFDDEVRELAPRTRADGGHWVPGDAPSQVLQWAVRAVAKAGTVSIIGVYPMNDRFFPIGAAMNRNLTVKMGNCNHRAITPKLIEIVRSGAFDPITVLTQAEPLTSAIDAYRAFDTREPGWIKVKLEP

SEQ ID NO: 4268 - protein, 309 aa, Leuconostoc mesenteroides subsp. mesenteroides ATCC 8293
MKKVLVANMTSQKAVDYLESKGYQVIKNDQASDDDFLGHADVDGILIMMHPFGESLMSKMPNLKVVARHGVGYDNVDLDAASAHDIVVTNTPGANATAVAETAMMHILMAGRLFYQRRQAITDNANKRYLAAHHGQELTGKTVGIIGYGHIGQEINRMLTGFNVKVLAYARHQHEVTNGRMATLDEIYEQADFVVTALPATPETKHMINASVFRKMKKSAVLVNIGRGALVDERALVEALTNEEIAGAGVDVVEKEPITAENPLLHLPNAFVTPHVAMISKEAMDNVALKAAEDIVRVLEGERAVFQVN

SEQ ID NO: 4269 - protein, 437 aa, Corynebacterium glutamicum
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGIDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADTFRFAPFFHTLLDNGVYAPPSVFETWFVSSALTDDDFSKIEQALKPAARAAAEAKAS

SEQ ID NO: 4270 - protein, 610 aa, Clostridium perfringens SM101
MSKITREAIHHIAQSNYSYGYDNETLHLRVRTKKGEVNKVEIRIGDPYIWDEGGCDGGNMNATGGRWTGGKSYPMRKECETKYFDHWIVYYKPLTKRSRYGFILYGDEETLLCTEKRIEELDGKYDEEKLSAIGNFYCFPYLNAIDVAKTPQWVKDTVWYQIFPDRFCNGDKSIDPENVEPWGTEPTRDNFMGGDLQGVLDKLDYLCNLGINGLYFCPVFEATENHRYETIDYFKVDPALGGNEVFKKLVSEAHKRGMKIMLDAVFNHIGYFSPKWQDVLKNNEKSRYKDWFCIKKFPVLENGLENVDGNNLNYETFGRIATMPKLNTENPDVVEYLLKVAKFWVEEMDIDGWRLDVCNEVDHVFWRKFREVVKETNKEVYILGEVWHDGLPWLMGDQFDAVMNYPVTDAVKEYFCLNQSNPEDFKYMIEANKVSYLRQIGETIFNLLDSHDTPRILTVAGGNKNKMKLAYLFMFTQAGSPCIYYGDEVGMEGNQGMGMEFHRRCMIWDENKQDKDMLKFMKQIIKIRKENKELNLLDNNWIRANRDENILIYSKKNIFIIMNNSDKEEKVFLPKEIKNNKVKDLFEEKIESLKEDVELKPFAFRVYKKL

SEQ ID NO: 4271 - protein, 457 aa, Lactobacillus acidophilus NCFM
MNDKQSQNNSGYKRTLSNAHIQLIALGGTIGTGLFLGVGDSIHRAGPSVILIYIIVGVFLFLLMRALGEMIMSDLNKHTYIDFIEQYLGKNIGFITGYLYWISWITLGMAETTALGIYFKYWFPTLKPWIPGIITIVLLLLINLISARVFGNLEFSFAIIKIVTIVAFVILIFYLLITGGKTTFGPVSFENLDDHGGFFARGTKGFLQGFQMVIFSFIGVELIGLTAAEAQNPKVTLKRAINQLPVRIILFYVMAILGILLVIPWSKVSTNSSPFVQALGATGIRNASSIINFVVISAAVSSTNSFLYSAGRLLFSVTYNGKGKWNQTFGHLSKRQLPQNSLILSALLMACAPLITMVIGDQAFNFISSTSTSMFLIIWCLMVLTHISFRKKTPESVYSDFKMPGFPYVDYLILLFFGLMIILLLILPSYRIPMIAAIVTFIILYIISKIWSNEKTV

SEQ ID NO: 4272 - protein, 380 aa, Methanococcoides burtonii DSM 6242
MPSSRLERVEESETIKIANAANKMKSEGIDIISFSLGEPDFNTPDHICKAAADAMYRGDTHYAPSTGIPELREAIANKLQTENKLEVTSDDVLVTPGAKQAIFEVMMSVLDDNDEAILSDPSWVSYSPCIKFAGANPVWAPTDPDNGFMPYGIEELITNKTKLIVVNSPCNPTGGVFDNEMLKTVADLAVDHDLLVLSDEIYEKIIYDKKHISMGSLDGMHERTITVNGFSKAYAMTGWRLGYVTAIPELMKGFKKIHSHSVSSATTFAQFGGVAALEGPQEPVNDMLKEFKARRDILINGLNTIGIKCKRPDGAFYAFADVSEFGDGDAVAEKLLQDAHVAVTPGSAFGLSGKDFVRISYATSQERIKQALQRIEETLL

SEQ ID NO: 4273 - protein, 376 aa, Glycine max
MDLGLSILLQPLFGDSPVLPLPFPITCNGSIQSCFFFRILLFIPLVLNITQQLTTLLLLFSMRLHLLLLLLLLLCFSAPHASAQSSQARSLDAILQEYAFKALVKPRTGTIYNATATQLPSNLTGVKISALRLRSGSMRRKGFPSYNEFEIPIGVIAKPYVKRLVLVYQNLGNWSNSYYPLPNYTYLAPVLGLLVYNASNLSATNLPTLNVNASGDPIKVKFLHVKVPPLGAVPKCVWFDLQGSSNFSNVTGGNTCSTSSQGHFSIVAESSALPPPAPSQPPSPPPPPAAVVPKESKSSNKVGVIVGSVLGGFAFLVLLSLLVLWLLKYKQKKKIQQMERAADAGEALHMASVGDTKAPAATVTRTQPTLEHEYAP

SEQ ID NO: 4274 - protein, 219 aa, Escherichia coli
  misc_feature (42)..(42): Xaa can be any naturally occurring amino acid
  misc_feature (90)..(90): Xaa can be any naturally occurring amino acid
  misc_feature (92)..(92): Xaa can be any naturally occurring amino acid
  misc_feature (138)..(138): Xaa can be any naturally occurring amino acid
  misc_feature (174)..(174): Xaa can be any naturally occurring amino acid
  misc_feature (182)..(182): Xaa can be any naturally occurring amino acid
  unsure (1)..(219): unsure at all Xaa locations
MTQDELKKAVGWAALQYVQPGTIVGVGTGSTAAHFIDALGTXKGQIEGAVSSSDASTEKLKSLGIHVFDLNEVDSLGIYVDGADEINGHXQXIKGGGAALTREKIIASVAEKFICIADASKQVDILGKFPLPVEVIPXARSAVARQLVKLGGRPEYRQGVVTDNGNVILDVHGXEILDPIAXENAINAIPGVVTVGLFANRGADVALIGTPDGVKTIVK

SEQ ID NO: 4275 - protein, 93 aa, Shigella flexneri 2a str. 301
MAKTAAALHILVKEEKLALDLLVQIKNGADFGKLAKKHSICPSGKRGGDLGEFRQGQMVPAFDKVVFSCPVLEPTGPLHTQFGYHIIKVLYRN

SEQ ID NO: 4276 - protein, 487 aa, Burkholderia vietnamiensis G4
MSTENLALKDPSLLRQQAYINGEWQSAANGESFEVRNPATGGLLGTVPAMGAAETRQAIDAANAAWPAWRKKTAKERAAILRKWHDLMMENADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGELTSNPIVRKLSFTGSTPVGRLLMSQCAATVKKVSLELGGNAPFIVFDDADLDAAVQGAIASKYRNSGQTCVCTNRFYVHEAVYDAFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 4277 - protein, 271 aa, Xanthomonas campestris pv. vesicatoria str. 85-10
MSSHADSKPWTVPALAQAKREGRKLVMLTAYDAGFARTFDAHGVDLILVGDSLGMVVQGHDSTLPVTTADMVYHTAAVARALDRALLVADLSFQADATPERALDAATQLLQAGAEMVKIEGAGHKLEVIRYLVEREIPVCSHLGLTPQSVLRFGGYKVQGRGEAGEQLRRDAQAVVDAGASLLVLECVPTPIATQISADLSVPTIGIGAGPGCDGQVLVMHDMLGLDSGHRRPKFVKDFLAEGGSVAGAVRAYAQAVRDGSFPDAEHAYAA

SEQ ID NO: 4278 - protein, 264 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEKHHHHHH

SEQ ID NO: 4279 - protein, 222 aa, Zea mays
MSMFNRIFGKPKEQANSNALATLDKLNETLDMLEKKEKVLEKKAAAELERAKEFSKAKNKRAAIQSLKRKKLYEQQIEQLGSFQLRIHDQMIMLEAAKATTETVDALRTGAAAMKAMQKATNIDDVDKTMDEINEQTENMKQIQDALSAPLGASADFDEDELEAELEELEGAELESQLLEPVAAPPVHPVHAPANKQPARPAPQKATAEDDELAALQAEMAL

SEQ ID NO: 4280 - protein, 363 aa, Oryza sativa
  misc_feature (29)..(29): Xaa can be any naturally occurring amino acid
  unsure (1)..(363): unsure at all Xaa locations
MAHAAAATGALAPLHPLLRCTSRHLCASXASPRAGLCLHHHRRRRRSSRRTKLAVRAMAPTLSSSSTAAAAPPGLKEGIAGLYDESSGVWESIWGEHMHHGFYDAGEAASMSDHRRAQIRMIEESLAFAAVPDDAEKKPKSVVDVGCGIGGSSRYLANKYGAQCYGITLSPVQAERGNALAAEQGLSDKVSFQVGDALEQPFPDGQFDLVWSMESGEHMPDKRQFVSELARVAAPGARIIIVTWCHRNLEPSEESLKPDELNLLKRICDAYYLPDWCSPSDYVKIAESLSLEDIRTADWSENVAPFWPAVIKSALTWKGLTSLLRSGWKTIRGAMVMPLMIEGYKKGLIKFTIITCRKPETTQ

SEQ ID NO: 4281 - protein, 245 aa, Arabidopsis thaliana
MARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 4282 - protein, 432 aa, Bradyrhizobium japonicum USDA 110
MHRPRFMSCGKAAILGDSMPAPGQSPERSAKALLLEGVNDSAVDLFRSAGFANVERLTKALDGEALRQALKGVSLLGIRSRTQITDDVLAAADQLLAVGCFSVGTNQVDLLAARKRGIPVFNAPFSNTRSVAELVIGEIVMLLRQIFPRSVSAHDGGWDKSATGSREVRGRTLGIIGYGNIGSQLSTLAEAMGMRVIYYDRTDKLRHGNTEPVEKLEELLAQSDVVSLHVPETPETSGMIGEKELRAMKPGSFLINNSRGTVVDLDALARALRDGHIAGAAIDVFPVEPSSNSDRFKSPVQGLGNVILTPHIGGSTEEAQERIGGEVARKLVDYFITGSTMGAVNFPEVQLHLRPSGARFSHVHRNVPGMLRRLNEVFLQRDINIAAQYLETAGDLGYVVLDADLGGQDSGELLQQIRALDGTVGARLVFEH

SEQ ID NO: 4283 - protein, 487 aa, Brucella melitensis 16M
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGILAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKRGAKK

SEQ ID NO: 4284 - protein, 212 aa, Zea mays
MEQTFIMIKPDGVQRGLFLAQIGDIISRFEKKGFYLKVIRMNFSAVEARFDVQILSNREVDKNHRSALLLEKKRKKRILGHGFQKQIFLPTVCAFHQVSNIPFPFQRQGMKFMNVERSFAQQHYADLSDKPFFPGLVEYIISGPVVAMVWEGKDVVLTGRRIIGATRPWEGSPRNVIHGSDSVENGKKEIALWFPEGVAQWKSNLHPWIYEA

SEQ ID NO: 4285 - protein, 592 aa, Debaryomyces hansenii CBS767
MQTVKAEHIDKLRIKLFQSCQILTNLNLFQAAKWCAEALNGLSQTDQNESVPYEYPIIEQDPEDKMDQEKFMLAKAYFNCKEFDRASYVLKDCKSGSALFFRLYCILISVDKKATEETDGSINLGSLFLLGNGNHEPSDNEFNNAASRGKDELVGSLNIKLSKIIQESENYHSKPENKPNAFLYYLNGIVYNKKKKYAMAQHNFFQSLRLFPYNWSCWQELISTLNTFDEAIAFINKLKSAKSSLTNNIMFHFFEVVILQEFYQQLASLKANLDNLINTFPKFNFLKVQQFLIAYHGLDYFQAESIFDQILIEDPLRLDDLDTYSNMLYVMEKRSKLSFLAQFASLVDKFRPETCCIIANYHSMKCEHEKAIMYYKRALTLNKNCLSAWTLMGHEFVELKNSHAAIESYRRAVDTNPKDFRAWYGLGQAYEVLDMHLYALYYYQKATSLQPLDKRMWQAIGNCYEKIEKYDEAIKSFEKALKIDNYSKGGLDNVEEVINYEPHICFRLATISQKLGRSKDTYKYMKLCFDQEYEWGVSDETSKARLWLARSALENHRFEEAYELAKDLNHSNAHDVEEARSIARESRNRMLK

SEQ ID NO: 4286 - protein, 123 aa, Zea mays
  misc_feature (12)..(12): Xaa can be any naturally occurring amino acid
  misc_feature (20)..(20): Xaa can be any naturally occurring amino acid
  misc_feature (95)..(95): Xaa can be any naturally occurring amino acid
  misc_feature (108)..(108): Xaa can be any naturally occurring amino acid
  unsure (1)..(123): unsure at all Xaa locations
TPFKGILAADEXTGTIGKLXHTITVENVDENQAALREHMKRCPGTLQYISGEMLSKVTLHQKTKDGKTTVAVLKEADVLPGIKENRCTIEVVAPXKETTTHCHYDLTXRGTKYYEAGARSAKQ

SEQ ID NO: 4287 - protein, 462 aa, Mesorhizobium sp. BNC1
MATPTDLVAASFRPPAPSPRQTPPSTLQMMRIVYRNPLELWGEPSYNEPWVQLTGGIGGPLLIANDPGLIRHVLVDNARNYKMARVRQKILRPILRDGLLTAEGEVWRRSRKAMAPVFTPRHISGFAGPMLQKAEAFAERYEQAIGGTVDVSRDMTMLTFDILSETLFSGEVAGDPGGFAHQVDRLFETMGRVDPLDLLGAPDWLPRITRILGRNSLAFFRNIVARTMEMRKEKLAGGDAEVPEDFLTLLLRAEGPQGLSRGEIEDNIITFIGAGHETTARALGWTLYCLANLPEERERIEAEIDSVLSSEPDPVKWLDAMPLTRAAFEEAMRLYPPAPSINREAIENDSYSDLKIAAGTQVLVMPWTVHRHRKLWDDPDAYRPSRFHPENREKINRFQYLPFGAGPRVCIGATFAMQEAVIALAVLMSRYRFDLLPETKPWPVQKLTTQPQGGLPMGVSRR

SEQ ID NO: 4288 - protein, 839 aa, Sorghum bicolor
MTRLLSSYLLTVIFTVFLLLLKASAAGTPSDTLSSSSNITDGETLVSSGSSFTLGFFSPAGVPAKRYLGVWFTMSPEAICWVANQETPLNNTSGVLVVDDSTGTLRLLDGSGHTAWSSSSSTTTTSSAPPPPVVLPQAQLLDSGNLVVRDQSTGDVLWQWFDHPGNTYLAGMKFGKNLRTGAEWTTTSWRASNDPAPGDYWRSLDTRGLPDTITWHGNVKMYRTGPWNGQWFSGIPEMASYLDLYSNQLVVGADEIAYSFNTTAGAPISRLLLNENGVMHRLGWDPVSLVWTSFAEAPRDVCDNYAMCGAFGLCNMNTASTMFCSCAVGFSPVNPSQWSMRETHGGCRRDVPLECGNGTTTDGFKMVRAVKLPDTDNTTVDMGVTLEQCRERCLANCACVAYAAADIRGGDHGCVMWTDAIVDVRYIDKGQDMYLRLAKSELVEKKRNVVLIILLPVTTCLLALMGMFFVWVWCRRKLRGKRRNMDIHKKMMLGHLDETNTLGDENLDLPFFSFDDIVSATNNFAEDNMLGQGGFGKVYKGILGENREVAIKRLSQGSGQGTDEFRNEVVLIAKLQHRNLVRLLGCCIHGDEKLLIYEYLPNKSLDSFIFDAARKNVLDWPTRFRIIKGISRGVLYLHQDSRLTIVHRDLKTSNILLDADMNPKISDFGMARIFGGNQQEANTNRVVGTYGYMSPEYAMDGAFSVMSDTYSLGVILLEIISGLKITSTHSTSFPSLLAYAWSLWNDGKAMDLVDSFVLESCSANEALRCIHIGLLCVQDNPNSRPLMSTVVFMLENETTLLSVPKQPMYFSQWYLEAQGTGENTNSSMNNMTVTVLEGR

SEQ ID NO: 4289 - protein, 320 aa, Pseudomonas fluorescens Pf-5
MSTLLELLKDGRFHSGQALGQALGVSRSAIWKQLQLLEAELGLVIHKVRGRGYQLATPITLLSSAEIGRSSISSGSWDIRILDSTDSTNAQALRSIEEGSVAPFLVLAERQTVGRGRRGRKWVSPFAENIYYSLVLRMDGGLRQLEGLSLVVGLAVMHTLREYGIPGAGLKWPNDVLVGQKKVAGILLELVGDPADVCHVVLGIGINVNMQSAEEIDQEWTSVRLESGKVIDRNQLVARLNEVLVSYLERHRLNGFSAIQGEWEQGHLWQGRAVSLIAGVNKIDGVVLGIDRQGALRLSVEGEEKTYSGGELSLRLRDGS

SEQ ID NO: 4290 - protein, 377 aa, Frankia sp. EAN1pec
MRAVVYREPFQVAVADVPDPRVEHPQDAIVRVSSTSICGSDLHVYEGRTSVRPGTVLGHENMGTVVDRGSAVSHVQLGDRVSVPCTVSCGTCANCERGRTEFCLRTNPDPHRAGAAYGCPDMGPYLGGQAEYLRVPFADFNLLRLPPGDDQELDFATLSDVFPTGFHGTELADVQAGNTVVVFGAGPVGLLAAYSAALRGATALVVDPVPSRLRLCERIGATGIDSSTEDAAERVREETRGRGVDCGIDAVGYQARTASGEEQAGLVLNQLVDCVRWTGSIGVLGVYPTRDPGAADESGARGRLPFDMGAFFAKGLRMGSGPANVKRYNRFLRDLIITGRAQPSCVMSHQLPLADAPDAYARFDHRDAGWIKITLQP

SEQ ID NO: 4291 - protein, 616 aa, Xanthomonas campestris pv. vesicatoria str. 85-10
MSQPAESSELINVVVLLGAAVVAIPLFRRLGLGSVLGYLAAGLAIGPFGLGLFNEPQAILHVAELGVVMFLFVIGLEMRPSHLWSLRKEIFGLGTLQIAVCALVLTGVGMLLGFALPVAFVAASGFVLTSTAVVMQLLAERGDVALPPGQKIVAILLFEDLLIVPLLAIVAWMGASGDPQAASQRWQGIGIGLACIVGLLAAGRWLLNPLFRILAASKAREVMTAAALLVVLGAALLMQVGGLSMAMGAFLAGVLLSESTFRHQIEADIEPFRGILLGLFFLGVGMSLDLRVVAADWRLIVVGVLALMVGKGVCIYAVARLMRSDHRQALDRGVLMAQGGEFAFVLFAAASASGVIDAQVNASLTAIVVLSMALTPLFVLLQRRLTPAAAVSLDGVEAASGQTGSVLIIGFGRFGQVASQSLLARDVDVTIIDNDIEMIQSAEEFGFKIYYGDGTRLDVLHASGAHSARAIAVCVDNQEAANRIVELATREFPHAKLLVRSYDRQHSLQLVAAGVDYQIRETFESAVLFGKVALVELGVDEDEAGMISRQIRRRDAERFELEIAAGDARAGAKLMYGNTVPTAPRPTPFTRPRRGSRTLNPDAVPQAEPAETQTRD

SEQ ID NO: 4292 - protein, 580 aa, Prochlorococcus marinus str. MIT 9211
MTNIHFKRRTKIVATIGPATESKERITELVEAGATTFRLNFSHGDHSEHAKRIETIRLVEAKLGVKIGILQDLQGPKIRLGRFKDGPIRLNSGDKFVLTSKDVGCNNEIANVTYEKLVSEVSINKRILLDDGRVEMVVERVDKLEEKLHCKVVVGGMLSNNKGVNFPDVQLSINALTPKDKIDLSFGLSQSIDWVALSFVRNPDDIKEIKELIRSHGYTTPVVAKIEKFEAIDQIDAILRLCDGVMVARGDLGVEVPAEEVPLLQKELIKKSNSLGIPIITATQMLDSMASSPRPTRAEVSDVANAILDGTDAVMLSNETAVGDYPIEAVKTMATIAKRIEKDYPQRALESHLPSTIPNAISAAVSSISRQLNASAILPLTKSGSTAHNVSKFRPPTPIVAVTNETDVARRLQLVWGVTPIVIKEQETTTKTFNLAMEMAQGMGLLKPGALVVQTAGTITGVSGSTDLIKVGIVNDIVARGNSEGNNSVCGKVRIAKEQKDLSELKKGEILVLDKNINNYSQALKYAAGIILEGTLNIENNNTVPTIYNVKGATDILRDGDMVTLVLKEGTICRGEILND

SEQ ID NO: 4293 - protein, 252 aa, Lactococcus lactis subsp. lactis
MSRKPIIAGNWKMNKTLSEAQAFVEAVKNNLPSSDNVESVIGAPALFLAPMAYLRQGSELKLAAENSYFENAGAFTGENSPAAIVDLGIEYIIIGHSERREYFHETDEDINKKAKAIFAAGATPILCCGETLETFEAGKTAEWVSGQIEAGLAGLTAEQVSNLVIAYEPIWAIGTGKTATNEIADETCGVVRSTVEKLYGKEVSEAVRIQYGGSVKPETIEGLMAKENIDGALVGGASLEADSFLALLEMYK

SEQ ID NO: 4294 - protein, 301 aa, Clostridium perfringens str. 13
MLRILLNDGLDKKAISNLEFLGFDVDTNHYDIEDLKEKIKKVDCIVIRSATKIRRELIDEAIKGGKLKLIIRGGVGVDNIDVQYAEQNGIKVRNTPNASSSSVAEIILAHMFSLARFLNQSNITMKAGLWKKKDYVGVELEGKTLGIIGMGRIGSELAKKCTALGMKIIYFDLMDIKNIDNNYRKVEFDELLRESDFISINISGTKSIIGSEELKKVKKGVFIINTSRGKALDEEAIITSLNDGTLGGVGLDVFLEEPSKNLELINHPKVSLTPHIGASTKEAQMKIGEEVINIIKEEMYN

SEQ ID NO: 4295 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNMRQVQCVSFIAFRPPGCEESGKA

SEQ ID NO: 4296 - protein, 235 aa, Photobacterium leiognathi
ASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDDVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVASGTTNTASVHVL

SEQ ID NO: 4297 - protein, 392 aa, Clostridium perfringens str. 13
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNKEELQKIVDVLKDKDVIIISDEIYAELSYDEDHVSIASFQEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 4298 - protein, 337 aa, Oryza sativa (japonica cultivar-group)
MGKIKIGINGFGRIGRLVARVALQSEDVELVAVNDPFITTEYMTYMFKYDTVHGQWKHHEVKVKDSKTLIFGTKEVAVFGCRNPEEIPWAAAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 4299 - protein, 959 aa, Debaryomyces hansenii CBS767
MFTFSIITPSTDDYSCKASLLSFDNDIKILADPSWNGNNHNDILYMEQYLKEVDIILLSHSTPEFISGFVLLCIKFPNLMSNIPIYSTLPVNQLGRVSTVEYYRANGVLGPLNNSILEVDEVDEWFDKIIPLKFFQTLSVFDNRLVITPYNAGHTLGGTFWLITRRLDKIIYAPSWNHSKDSFLNSASFLSSSSGNPLSQLMRPTVLITNTDLGSTMSHKKRTEKFLNLVDATLANGGAVLLPTSLSGRFLELLHLIDQHLQSAPIPVYFLSYSGTKVLSYASNLLEWMSSQLVKEWEEASSVNNNSSNKNNFPFDPSKVDLLLDPSELVQLSGPKIVFCSGIDLKNGDMSSEALQYLCQDEKTTIVLTEKTHFGLDNTINSQLYHDWYNLTKQKQGGTVEDGVAVPLEKVISLENWNREEPLIGAELTDFQEKINLQRKQKLLAKVRDRKNQNLLNADTINGDDSSSDEEDDVVSSDDEAAALKYTEAPANADASTTTNVPAVVKVDELSAHEAFITDHVKQTLEANRPLDLKITHKLKPRQAMFPYIVGSHKQKFDDYGEVIDIKDFQKQEDTSSNKLIMESKRKFEQNEKRKWGNVDNKGKGRGKNSDKDNNNQNKITPQELLNNQLLQKNLDTLFSPRKRIPLNAASSFSSKPQELRMRCGLSFVDLSGLVDMRSLSLIVSSLKPYNLLLLPDFSVNQNTIEEMNGLAAVKQMFDQQQDQHQQEQNKKSLANSSRYLSLATIRGGISNFVTSKNSAGKLAIVAVQCNTPVKIGGDDSDDTGIGLSNFEIKLDDSIIDSLKWQNIDGSYRVAQVYGELEIHNQDLPNKKQKTISDYMNSSTQFTLKHISNQDFLKQQQALVDAHAATTGQLLNNNGPKLAIGNIRLPELKKKLISRNMNAEFKSEGTLVVNNSLAIRKVTYSNVEGEDTGDIVIDGAMGPLYYEIKDCIREMLAYV

SEQ ID NO: 4300 - protein, 284 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGD

SEQ ID NO: 4301 - protein, 425 aa, Mycoplasma genitalium
MQQTFFKDPILGEIIFDENTKWMYELVNTKAFQRLRNIKQLGINFHFYPSGVHTRYAHSLGVYELIRRILNSSAFLNIDQIKKQTVLVAGLLHDLGHGPHSHAFEIYFAKNPDFKKQLFIHEKVTSMLVNSEPIVSILKANKIDPNLIGALIDENQNIQPINWWMRQLISSDLDTDRMDYLLRDAYFTGTSHSLVDYQSIINGMECVDNQGTYKIVFQEKCLPFIENFLITRHHMYQSIYSDGRSIATELNLWFVFQRIKALIEEDNFNFHNFKNVESVIKPLLKNQLFKKSLLTCFVKLDDYVFHSFLVNTFETTKDAILKTLLDSYLNTLKFQVKFYESCEKRDLDFELKVKEYQTPSYFITKFNNQFKGFYEGWNKHKNELKIKTSQNKIKNLSEISMLVKRSNELFFENSFYRWANVFYQN

SEQ ID NO: 4302 - protein, 478 aa, Bifidobacterium longum NCC2705
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENGMNRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLSPTPLEYELYFHI

SEQ ID NO: 4303 - protein, 330 aa, Mesorhizobium sp. BNC1
MSQYDVLCIGNAIVDIIARCDDAFLVENGIIKGAMNLIDAERSELLYERMGPAIETSGGSAGNTAAGVANFGGTAAYFGKVSNDHLGAIYRHDIRAQGVAFDTPSLDGNPPTARSMIFVTPDGERSMNTYLGACVELGPEDVEEEKARNAKVTYFEGYLWDPPRAKEAIRKTAEIAHAAGREVSMTLSDPFCVDRYRAEFLDLMRSGTVDIVFANEHEVMSLYQTASLDAAISAFREDCRLGLITRSEKGSIAVTREETITIKPVPVSNLVDTTGAGDLYAAGFLFGYTHNRSITDCGRLGSLAAALCIEQIGPRVQVSLKEAAEQAGLL

SEQ ID NO: 4304 - protein, 417 aa, Shigella flexneri 2a str. 301
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMTVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLIAF

SEQ ID NO: 4305 - protein, 475 aa, Ralstonia metallidurans CH34
MRQQQGFDAIVEREQGLHRGLSTGQLSMIAIGGAIGTGLFLGSGFAIGFAGPSVLVSYAIGALIALLLMGCLAEMTVAHPTSGSFGANAEHYIGPLAGFLVRYAYWSSIVFAVGTEVTAIAVYMKYWFPMVPGWYWIVGFSAALIGINATSVKVFGAVEYVFSMLKIVAIVGFILLGAYVVTRAPTGSGIGLANYTAHGGFFPKGMWGTWVAVIVSIFSYLSIEMIAVAAGEARDPETAITRAFRATMVRLVFFYLLTLALMLMIVPWTAAGAGESPFVRVMAATRVPGAAAVFNFVILVAALSAMNSQLYITTRMMFSLSRAGYAPKALGQVNGRGVPMTALLLSTVGIAFAVVLNVVYPDASFMLMMAISMFGAMFTWLMIFITHLFFRRQHRGRPLAFRMWGFPVTTLLGAGLMFATLVTTWFTPEFRMTLVAGVPFMLALSAAYWLWYRKRGGAAQGDGEDAGRAEVRNSW

SEQ ID NO: 4306 - protein, 230 aa, Triticum aestivum
  misc_feature (103)..(103): Xaa can be any naturally occurring amino acid
  misc_feature (187)..(187): Xaa can be any naturally occurring amino acid
  misc_feature (198)..(198): Xaa can be any naturally occurring amino acid
  unsure (1)..(230): unsure at all Xaa locations
FAFGLLGNIISFTSLLAPIPTFYRIYKSKSTEGFQSVPYVVALFSAMLWIFYALVKSGEGLLITINAAGCVIETVYIVMYLVYAPRKAKVFTAKIILLLNIAXFGLILLLTLVAFHGERRVVSLGWICVGFSVCVFVAPLSIIGRVIKTKSVEYMPFSLSLTLTLSAVVWFLYGLLIKDKYVALPNXLGFTFGMIQMXLYMFYMNATPVVTSDKVKGGMERCLQRTNPRD

SEQ ID NO: 4307 - protein, 248 aa, Nostoc sp. PCC 7120
MTEQKRIAVVTGSNRGLGYAISRKLAQIGIHVILTSRNEADGLAAKQQLSSEGLDADYCVLDVTNDVSVQKFTKWLHETYSKVDILVNNAGINPTTKPEESSLLTVQLETMRFTWETNVLAVVRITQALIPLMQAQNYGRIVNISTEMASLSSISDDYYPLAPSYRLSKVGVNGITAILAKELQGTNILVNAYSPGWMKTDMGGDNAPFTAEEGAETAVYLATLPDRGVQGQFFAEMRKFGGPVQLQW

SEQ ID NO: 4308 - protein, 937 aa, Mesorhizobium loti MAFF303099
MMTTALTPFSARHIGPGVNDVRAMLAVIGVPSVETLISQAVPQSIRLDLPLTLPAPASEAEALAELSAIMAKNTVLKSFIGAGYHGVHVPPVIQRNLFENPAWYTAYTPYQAEISQGRLEMLFNFQTLVTELTGLPVASASLLDEATAVAEAVGIALRHHRDKRTKVAFAGTPHPQTLDVVRTRAEPLGIEIDGETIDDNTAALLVSWPDTLGVYGDHKAAIDKARAAGALVVFIADPLGLTLTDAPAKLGADIAVGPMQRFGVPMGFGGPHAAYCAVSDRLTRLMPGRLVGQSTDSKGRPGYRLALQTREQHIRRDKATSNICTAQALLANMATAYAIWHGPAGLQAIAGRIHALANRLASGLKAAGVSVLGASRFDTVTVEAKGKAAEIAEAAEKTGRLLRVLDADHVGIAFDETSTDADLDAIASLFGAKAAPSADSTVPGKPRGKEFLTQPVFNENKSETDMMRLLRRLADKDLALDRSMIPLGSCTMKLNAAAEMMPVSWPSIADLHPFAPASHSAGYRAMIGELEGWLSEITGFDAVSLQPNAGSQGEYAGLLAIRAYHRSRGEGHRTVCLIPSSAHGTNPASAAMAGMSVVVVRCLEDGNIDMDDMRAKANEHSKNLAALMFTYPSTHGVYEEGARHLCALIHEHGGQVYFDGANLNALVALARPADIGADVCHMNLHKTFCIPHGGGGPGVGPIGVKAHLKPYLPGHVTEGSAHAVSAAPFGSASILPITWMYIRMMGAAGLKQATETAIISANYVATRLAPHFPLLYKGRHDRIAHECILDTRVLKESAGISVDDIAKRLIDYGFHAPTMSFPVAGTLMVEPTESEPKRELDRFCEAMIAIAGEAAKVARGDWPLADNPLVNAPHTAAETLAGQWTHPYSRLEAAYPAGDADTAAKYWPPVSRIDNVAGDRNLVCSCPPLSDYLGAAE

SEQ ID NO: 4309 - protein, 312 aa, Medicago sativa
MGSVEIPTKVLTNTSSQLKMPVVGMGSAPDFTCKKDTKDAIIEAIKQGYRHFDTAAAYGSEQALGEALKEAIELGLVTRDDLFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNAHGIVLTAFSPVRKGASRGPNEVMENDMLKEIADAHGKSVAQISLRWLYEQGVTFVPKSYDKERMNQNLRIFDWSLTKEDHEKIAQIKQNRLIPGPTKPGLNDLYDD

SEQ ID NO: 4310 - protein, 542 aa, Streptococcus pyogenes MGAS315
MTIDKKKVVYQIYPKSYKDTTGNGVGDLRGIIDKLPYLQELGIDMIWLNPFYPSPQRDNGYDVSDYTAVNPDFGTMADFEDLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMGQGNGWNALFYNNHDQPRALNRFIDVTHFRNEGATMLAASIHLSRGTPYIYMGEEIGMLDPDFDSMDDYVDVESLNAYSSLLVSGKSAEEAFAIIKDKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILAEN

SEQ ID NO: 4311 - protein, 183 aa, Zea mays
  misc_feature (121)..(121): Xaa can be any naturally occurring amino acid
  misc_feature (128)..(128): Xaa can be any naturally occurring amino acid
  unsure (1)..(183): unsure at all Xaa locations
MFLRRILTGGGGLAALRAARAVKETTGIVGLEVAPNAREVLIGLYTRTLKEIEAVPKDEGYRKAVESFTNHRLQICQEEDDWKRIEDRIGCGQVEELIEEAEDELKLIAKMIALARMQIKXEWDPWGXVPDDYECEVIEDDTPIPKHVPQHRPVALPEEFFKALDAVKSDPALQGDAPPQVKA

SEQ ID NO: 4312 - protein, 474 aa, Agrobacterium vitis
MFIRSNRRAKIVATVGPASSSPAILRSLFLAGVDTFRLNFSHGSRDDHAAAYRHIRALEKELGTSIGILQDLQGPKIRIGVLHEGRLQLTKDAEIRFVCGTEPGRGLMDIPLPHREIFAAVKPGDDLLIDDGRVRVRALGVSDEFIDAKVIVAGPISNRKGVNLPGTVLDISPLTPKDRKDLEFGLELGVDWIALSFVQTARDMIEARSLVSDRAGLIAKIEKPSALDEIDDIVALSDAIMVARGDLGVEIPPEDVPGRQKELIRACRIAAKPVIVATQMLDSMVTSPTPTRAEASDVAGAIYDGADAVMLSAESATGAFPVETVEIMSRIIEKTEKHKFYRPILEATEPQIAHTPPHAVATAAADVALALKAPVIVAFTVSGTTASRISRARPPLPILALTPSEQTARQLGLMWGVVSLLSPTVDTYEQSVDRATQAAVQTGLAEKSDQIVVVTGFPFATAGSTNNLRVTQAG

SEQ ID NO: 4313 - protein, 236 aa, Nostoc sp. PCC 7120
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPHKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRRL

SEQ ID NO: 4314 - protein, 312 aa, Medicago sativa
MGSVEIPTKVLTNTSSQLKMPVVGMGSAPDFTCKKDTKDAIIEAIKQGYRHFDTAAAYGSEQALGEALKEAIELGLVTREELFVTSKLWVTENHPHLVIPALQKSLKTLQLDYLDLYLIHWPLSSQPGKFSFPIDVADLLPFDVKGVWESMEESLKLGLTKAIGVSNFSVKKLENLLSVATVLPAVNQVEMNLAWQQKKLREFCNANGIVLTAFSPLRKGASRGPNEVMENDMLKEIADAHGKSVAQISLRWLYEQGVTFVPKSYDKERMNQNLCIFDWSLTKEDHEKIDQIKQNRLIPGPTKPGLNDLYDD

SEQ ID NO: 4315 - protein, 502 aa, Zea mays
MATGRPVRLVLDASLLLDPSSTREAAAVALRPGVEELLRRLRYSNLSVAICYAEGMPTNESDFLEKVASSHLFGSIVLLAKSGNLSPIELMIEWSRTSFCFYATSRVDKGLISELQNQNWRVLSVANECSIEVPGVLNVQRLQELLLTLATLMKKELCGSSVLVIGYIMKKSREEDFAKRGAFPIYPSKGSLIFVPLSFEIPLSLQLQEVDMVLHKITDEIVKIDPNCSIDFPKGISFSAGMSEIIRFVEEHPDFCIMDPFKNIYPLLDRLQIQKILVRLQELGTEGKPKLRAPYSCKVDSFHNGELDKHLVEANLSFPLIVKPQVACGVADAHNMALVFQIEEFSNLSVPLPAVLQEYVDHGSKIFKFYVIGDKVFYAVRDSMPNARFLKPSSGGEALTFNSLKTLPVATNEQRPQTGAEDGKLLDADLVEEAAKFLKGLLGLTVFGFDVVVQEGTGDHVIVDLNYLPSFKEVPDSEAVPAFWDAVRQAYESTRGNANAQG

SEQ ID NO: 4316 - protein, 482 aa, Agrobacterium vitis
MFIRNNRRSKIVATVGPASSSPDMLRSLFLAGVDTFRLNFSHGARADHAEVYRNIRALEQEHDAAIAVLQDLQGPKIRIGVLAHGRLDLARGSTIGFILGREGGEGMNDIPLPHREIFEVAVPGMDLLIDDGRIKVRIMEVMDGRLVCEVLNGGALSNRKGVNVPGAVLDISPLTAKDREDLEFGLELGVDWVALSFVQRARDMIEARSLVGDRAGLIAKIEKPSALDDIEDIVRLSDSVMVARGDLGVEIPPEDVPGKQKEIIRACRLAAKPVIVATQMLDSMVSSPTPTRAEASDVAGAIYDGADAVMLSAETATGAYPVEAVEIMNRIIEKTEKHKHYRPILEATEPDVAQSPPHAVATAAANVAVALGSPVVVAYTSSGTTAARISRARPALPILALTPSEQVARRLNMFWGVVGVRSQDVHTYEASLIHAQQAVQEAKLASPSDHIVIVAGFPFAQQGSTNNLRVVQIAATDNLEIA

SEQ ID NO: 4317 - protein, 811 aa, Clostridium perfringens str. 13
MLSINKESFKRDYKKKFLELHGIELEEGKNFHKYEALGCLVRDYIAEDWVNTKKKYESSKQKQVYYFSMEFLLGRLLGDALLNLGIRETCREALKELNIDLEELEEFESDQGLGNGGLGRLAACFLDSMASLNIAGHGCGIRYKYGFFNQKIIDGSQVETPDSWLKNGNVWEFKKLDKSEVVKFGGNIKCENINGRLTFTHVNYEPILAVPYDTPIVGYENNVVNNLRLWSAEPVDNEFDFCYFNRGQYLKAIEYRNSIEAISQVLYPDDSMYEGKLLRLKQQYFFVSAGLQSIVRHYKKNGGKIEEFDEYIAIHINDTHPTLAIPELMRILLDEEGLSWESAMRITTNTISYTNHTILSEALEKWPINMFKELLPRIYMIVEEMNERYCAELWHKYIGQWDKISKMAIIGDGFVRMANLAIVGSHSVNGVAKLHTEILKKKEMSDFYYLYPSKFNNKTNGIAHRRWLLKSNPELTNLLKETIGDSFIKHPTDMENFEKYIDDEYVLKRLGEIKRKNKENLAKVILDNQGIKVDPNSIFDVQVKRIHAYKRQTLNCLRIMELYNRLLENPNLDIAPRTFIFAGKAAPAYYLAKNTIELINAVAKKVNNDKRINDKIKVVFLENYRVSLAEKIIPATDLSEQISTTTKEASGTSNMKFMMNGAVTIATLDGANIEIRDEVGDDNIVIFGLTENEVLDYYSRGGYSAWDVRNNDNRLIRVTDDLINGVYSKDRDKFRSVYDNLLTYNDEFFVLKDFDSYLKAQDKVDLLYRNNKEWQRKCGVNIAHSGIFSSDRTITEYATGIWGSKVIYKNL

SEQ ID NO: 4318 - protein, 606 aa, Clostridium perfringens str. 13
MGKAYIYHDSQDTFYREPFGAVSIGSKVSLRLECEECGEVFIEVIKFDGSRYSIPMTIEERRNECIIYKGIIDTTNSLGVINYYFKYIKDGFTKYYGNNDECLGGEGKIYYDFPNYYQITVYEDNKIPSWYKEGIIYQIFVDRFFNGNKNSVILNKKKNSFIYGNWYDEPMYIRDNNGSIKRWGFYGGNLRGVIEKLDYIKSLGVNIIYMNPIFDAVSCHKYDTGDYENIDKMYGTNSDFKELCQKAEEKGIRIILDGVFSHTGSDSRYFNKYGNYGELGAYESKYSKYYKWYRFYDYPNSYECWWGFENQPNVEELEKTYSDYIVNSENSIIAKWLRLGASGWRLDVADELPDEFIQMIKERMKNEKEDSVLIGEVWEDASNKVSYSKRRKYLLGDELDSVTNYPYRDIISNFLNEEISSKDFYKVIMSIKENYPRENFYANMNILGNHDTERILTVLKENLNKLKLALCLQMTLPGVPLIYYGDEAGLLGNKDPENRKTYPWGRENKEILSYYSFFGNFRKNEEVLRKGDFYIFKDTPEDVIAFKRVYKDKEMIIIVNRSNSRKTITLDSEKGRYKDKFSKEEFYGDGSITLEVERENYKILTN

SEQ ID NO: 4319 - protein, 455 aa, Mycobacterium sp. MCS
MGTRTGMLAQADLERMVSEREIDTVIVAFTDMQGRLTGKRISARLFVDDVAAHGAECCNYLLAVDVDNNTVGGYAISSWETGYGDMVMTPDFDTLRLLPWLPGTALVMADLSWTDGRPVTQAPRSILNRQIDRLAERDLVPYASTELEFMVFDDSFRAAWAAGYRGLTAATDYNIDYAMLASTRMEPLLRDIRLGMEGAGMYCEGVKGECNLGQQEIGFRYDHARVTCDNHTIYKNGAKEIADQHGKSLTFMAKFDEREGNSCHIHISLRGSDGSTVFADEDAEDGMTPLFRSFIAGQIATMREFSLCYAPNINSYKRFAEGSFAPTAIAWGFDNRTCALRVVGQGAGMRMENRAPGGDVNQYLAVSALIAGGLYGIENELELPDPVKGNAYTSGAERLPTTLSEAAELFDRSEIAREAFGDDVVDHYLNYARVELNAFNAAVTDWERVRGFERL

SEQ ID NO: 4320 - protein, 181 aa, Triticum aestivum
  misc_feature (122)..(122): Xaa can be any naturally occurring amino acid
  misc_feature (143)..(143): Xaa can be any naturally occurring amino acid
  unsure (1)..(181): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFXGCTDATQVINKWRSQEGVPDXYVRIIGFTTSPSECVSSCLKQRAARSARLNTHTAHIMH

SEQ ID NO: 4321 - protein, 345 aa, Haloquadratum walsbyi
MSAAVYYGPRDIRVENVVKPTLEESTDAVVRVTHTAVCGSDLWFYRGKTDRDIPSRVGHEPMGIVEEVGDDVQSVDVGDRVFAPFKISCGMCEFCRRGLHTSCVNGDGWGDDNGGAQGEVIRCRHADGTLVRVPDAYANDDSALRSILPLTDVMGTGHHAAVSAGVSAGSTCVVVGDGAVGLCGVLAARRLGAARIVAVGHHPDRLSLASEFGATDTVSARGQEAIETVQEMTGGGAEHVLECVGATSAMETAVEVCRPGGTVGYVGVPHGLDDGLDLFSFFGDNITLQGGVAPVRAYADELLADVLQGTLDPAPVFTKTVDLDSISEGYQAMDERDAIKVLVEI

SEQ ID NO: 4322 - protein, 94 aa, Arabidopsis thaliana
  misc_feature (17)..(17): Xaa can be any naturally occurring amino acid
  misc_feature (22)..(23): Xaa can be any naturally occurring amino acid
  misc_feature (27)..(28): Xaa can be any naturally occurring amino acid
  misc_feature (30)..(31): Xaa can be any naturally occurring amino acid
  misc_feature (34)..(34): Xaa can be any naturally occurring amino acid
  misc_feature (40)..(40): Xaa can be any naturally occurring amino acid
  misc_feature (83)..(83): Xaa can be any naturally occurring amino acid
  misc_feature (85)..(85): Xaa can be any naturally occurring amino acid
  unsure (1)..(94): unsure at all Xaa locations
PSRGCAGSQPDIACVGXLVDAXXHVPXXEXXIFXSGQGLXRSVFKPMSMLLTHPQQRCAQDDLDIPMSLAKKVPVTEAASAVXPXNGNNIQIIN

SEQ ID NO: 4323 - protein, 254 aa, Phaseolus vulgaris var. nanus
  misc_feature (254)..(254): Xaa can be any naturally occurring amino acid
  unsure (1)..(254): unsure at all Xaa locations
MGRKFFVGGNWKCNGTTEEVKKIVTTLNEAKVPGEDVVEVVVSPPFVFIPTVKTLLRPDFHVAAQNCWVRKGGAYTGEVSAEMLVNLGVPWVIIGHSERRQILQETNEFVGDKVAYALSQGLKVIACIGETLEQREAGTTAAVVAEQTKAIAAKVSNWDNVVLAYEPVWAIGTGKVATPAQAQEVHVDLRKWVHDNVSAEVAASVRIIYGGSVNGGNCKELAGQADVDGFLVGGASLKAEFVDIINSATVKKNX

SEQ ID NO: 4324 - protein, 340 aa, Aspergillus nidulans FGSC A4
MPPKKPDQPKKKKATVDDKTFGMKNKKGGSAKKQIAQLQAQAAHSKTADEKRKAAEKERREAEKRAAEQAKKEALELFKPVQVQKVPFGVDPKTVLCQFYKQGHCEKGRKCKFSHDLNVDRKAAKKDLYTDSREAEDEKKKADTMEQWDEAKLRSVVLSKHGNPRTTTDKVCKYFIEAVENQKYGWFWVCPNGGDKCMYKHSLPPGFVLKTKEQRAAEKAMMDKSPLNTLTLEDWLESERHKLTGELTPVTPETFAKWKKERMDKKAAEEQARKAKEATGRTLFESGNWRTEESEEESDEDDDGAWNLAALRKETERIREQKEEERLAKLHGEQQPGGED

SEQ ID NO: 4325 - protein, 245 aa, Lactobacillus reuteri
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYNLSTQIIKKVVFESRASDIYLTVEEGFYKRTLDIHRTLGLLLHTQVSIQQLLKLPAECFHPKPKVNSVLIKLTRHTTDVPDKYWKLYKYFVSKWVNREYRQLFTKNQFRQAMKHAKVNNLSTITYEQVLSIFNSYLLFNGRK

SEQ ID NO: 4326 - protein, 278 aa, Oryza sativa
  misc_feature (17)..(17): Xaa can be any naturally occurring amino acid
  misc_feature (37)..(37): Xaa can be any naturally occurring amino acid
  misc_feature (178)..(178): Xaa can be any naturally occurring amino acid
  misc_feature (202)..(202): Xaa can be any naturally occurring amino acid
  misc_feature (249)..(249): Xaa can be any naturally occurring amino acid
  unsure (1)..(278): unsure at all Xaa locations
MVVRAGAYDDELIKTAXGILAMDESNATCGKRLASIXNRQAYRTLLVTAPGLGQYISGAILFEETLYQSTVDGRRIVDVLAEQGIVPGINVDKGLVPLAGSDPESLEDGLVPIVEPEILLDGEHRVERTFEVAQKVWADTFFHMSENNVMLEGILLKPSMVTPGAESKDGAATPEQVXRRVPPAVPGVMFLSGGQSEVEATXNLNAMNQAAPSANPWRWRVSFSYARALQNTCLKTWGSRRENVAAAQXNSLAQLGKYTSDGEAAEASEGMFVKNYTY

SEQ ID NO: 4327 - protein, 796 aa, Thermococcus kodakarensis KOD1
MSERREVKLKVASAYQRDVGRGIVRIDRKAMRELGVQSGDIVEIIGTKNTAAVVWPAYPEDEGLGIIRMDGTIRKNAGVGLGDEVTVRKADVKEAKKVIVAPTEPIRFGADFVEWLHSRLVGRPVVRGDYIKIGILGQELTFVVTATTPAGIVQITEFTDFQVSEKPVKEVSKATALGVTYEDIGGLKDVIQKVREMIELPLKHPELFEKLGIEPPKGVLLYGPPGTGKTLLAKAVANEANAHFIAINGPEIMSKYYGESEERLREVFKEAEENAPAIIFIDEIDSIAPKREETHGEVEKRVVSQLLTLMDGLKSRGKVIVIGATNRPDAIDPALRRPGRFDREIEVGVPDKQGRKEILQIHTRGMPIEPEFRRDKVIEILEELEKNDTYREAAERAIMKVKKAKDEEEIRRILRETDEKLYEEVRAKLIDALLDELAEVTHGFVGADLAALAREAAMAALRRLINEGKIDFEAEYIPKEVLDELKVTRRDFYEALKMVEPSALREVLLEVPNVRWDDIGGLEDVKQELREAVEWPLKYPEAFMGLGITPPKGILLYGPPGTGKTLLAKAVANESEANFIAIKGPEVLSKWVGESEKNIREIFRKARQAAPTVIFIDEIDAIAPRRGTDVNRVTDRLINQLLTEMDGIQENSGVVVIGATNRPDIIDPALLRPGRFDRLILVPAPDEKARLEIFKVHTRRVPLAGDVDLRELAKKTEGYTGADIAAVVREAAMLAMRRALQEGIIRPGMKADEIRGKVKVTMKDFEEALKKIGPSVSKETMEYYRKIQEQFKQARG

SEQ ID NO: 4328 - protein, 447 aa, Methanosarcina barkeri str. fusaro
MVQIKKCITKEDVLEAVKERDVKFIRTQFTDTLGIIKSWAIPVEQLEEAFENGVMFDGSSIQGFTKIEESDMKLVLDPSTFRILPWRPTTGAVARILGDVYLPNGRPFEGDPRYVLKSAIEEAKKMGYSMNVGPELEFFLFKLDANGNPTTELTDHGGYFDFSPLDRAQDVRRDIDYTLERMGFQIEASHHEVAPSQHEIDFRFGDVLSTADNVITFKYVVKSIAYHKGYYATFMPKPLFGVNGSGMHTNQSLFKGDNNVFYDPESADQLSQEAMYYIGGLLNHIIEFAAVTNPVVNSYKRIVPGYEAPVYLTWSAKNRSSLIRIPETRGNGTRVELRCPDPSCNPYLAFALMLRSGLDGIKNKIDPGEPTNTNIFHLTEKEREGKGIRSLPADLKGAIDEMKGSKFVKEVLGEHVFNHYLCAKEMEWDEYKAIVHPWELEKYLHML

SEQ ID NO: 4329 - protein, 353 aa, Gibberella zeae PH-1
MSSNLSFVLNKPGDVSFEERPKPSLASPHDVLVAVNYTGICGSDVHYWVHGSIGKFVVEDPMVLGHESAGTVVEVGDKVKTLKAGDRVALEPGYPCRRCQNCLAGKYNLCPDMVFAATPPYHGTLTGFWSAPADFCFKLPDNVSLQEGALIEPLAVAVHIVKQARVKPGDSVVVMGAGPVGLLCAAVAKAYGASKIVSVDIVQSKLDFAKDFASTHVYASQRIAPEENAKNICDLAGLPDGADVVIDASGAEPSIQASIHVLKNGGSYVQGGMGKADITFPIMAFCIKEATASGSFRYGAGDYPLAVELVATGKVDVKKLITGIVDFKQAEEAFKKVKEGEAIKVLIKGPNEQ

SEQ ID NO: 4330 - protein, 663 aa, Methanosarcina barkeri str. fusaro
MTDNLLTDLLIIFGLSIPVVFTFSRLKIAPLIGFLLAGILAGPFGFGFIREIENIELLAEIGVVLLLFTIGIEFSMRDLLQLRRIVIFGGGLQLSITSVIVALILLWLGHSRETSIFLGLLVALSSTAIVLKLLQEKGEIYSLHGRTSLGILIFQDIAAVIIILLIPVLAGTPGTEKSFLELILQGFGLIVFTFLSARYVVPFIMYHVAKTRNNELFLLSVVVIGLSVAWLTSMVGLSLALGAFLAGLIISESEYSVQALGNLIPFRDMFMSIFFISIGMLLDLNILREHLLLILAATLAVLFLKVLVNSLSTFLIGFPLNTMILVGFSLSQVGEFSFIVAKVGLASGLISSLIYQEFLNVVVLSMVLTPLFMSIGYRTTVFAEFLPLPPVLKRGWYSKFKESGPEEKPENHVIIVGFGINGKNVVTAAKETSIPYIVIDMNPEVVRIEKQREEHIFYGDAAQNAVLEHAGIRTAKSFVVTAGDPPSAKRIIETARRLNPEIHIIARTHFLRELDKFYDFGADEVISDEFESSIELFTRVLHRYLVPSSEIDSLTSTLRADHYKMLRSPGIPRKKFCDLALDFADVEIRSIRVGKFSKSAGMTLGELNLRKNYGVSALAISRSHRIIPGPEAGTIILADDILLVISPPKNIDVVRKLFEDSKE

SEQ ID NO: 4331 - protein, 304 aa, Prochlorococcus marinus str. MIT 9313
MILAGTTLTSAVVIWTQRDRRYKSSASVASAYDAWTNDQLLERLWGEHVHLGYYGKPPSTRDFRAAKQDFVHELVQWSGLAQLPRGSRVLDVGCGIGGSARILARDYNFDVLGITISPAQVKRASQLTPEGMTCQFQVMDALDLKLANGSFDAVWSVEAGPHMPDKQRYADELLRVLRPKGVLAVADWNRRDYEDGEMTSLERWVMRQLLDQWAHPEFASIKGFRRNLLHSPFACGTVESDDWTRSILPSWNDSILEGFRRPGAVLGLGPAALVKGFREIPTILLMRWAFAHGLMQFGVFRSRD

SEQ ID NO: 4332 - protein, 386 aa, Thermosynechococcus elongatus BP-1
MYNATNSRSRMFRYEVVGLRQTAETEKTNYAIRNSGSQFFNVPYDRMNQFMQQITRWGGKIVSIQPLNGTVAPLAATTEPAANNGAAPVKEKKVDIPVNIYRPNNPCIGKVISNEELVREGGEGTVKHIIFDISGTELRYLEGQSIGIIPAGTDANGKPHKLRLYSIASTRHGDFQDDKTVSLCVRRLEYKDKETGETIYGVCSSYLNQLQPGDEVKITGPVGKEMLLSDDPEATIIMLATGTGIAPFRAFLWRMFKENNPDYQFKGLAWLFFGVAYTANILYKDELEAIQAQYPDHFRLTYAISREQKTPDGGKMYIQGRIAEHADEIWQLLQKKNTHVYMCGLRGMEPGIDEAMTAAAAKNGADWQEFLKGTLKKEGRWHVETY

SEQ ID NO: 4333 - protein, 393 aa, Bradyrhizobium sp. BTAi1
MNAPLKQHLIDPEICIRCNTCEETCPEDAITHDNNNYVVDATKCNFCMDCIQPCPTGSIDNWRIVAQAYSIDDQYSWNELPKQAELASGAEGEAVDAEVLALIDAAHTGAGGKSVAPASAAKPAINLYNRDAAAVATVTGNYRLTHDESDVDVHHVILDFADQPFPVLEGQSIGIVPPGLDADGKPHRIRLYSIASPRHGERPNTNNLALTVKREPNGVCSNYICDLKKGDKVQVTGPFGATFLMPNDPAANIIMICTGTGSAPFRGFTEWRRRAMPGASGRMMLFFGARRPQDLPYFGPLQKVPESLLRKHFAYSRVPGEKKVYVQDLLRREEAAVSGLLASAATHIYVCGLKGMEQGVDAALDDICRGSELRWHELRSQMRAEGRYHVETY

SEQ ID NO: 4334 - protein, 389 aa, Nostoc sp. PCC 7120
MKAVCWYGANEVRVETVPDPKILNPRDAIIKITSTAICGSDLHIYGGYIPTVQQGDIIGHEFMGEVVEVGSRVDNLKIGDRVVVPSTIGCGRCHYCEHDMWSLCDNSNPNGWLEEKLYGNITSAIYGYSHLLGGYAGAQAEYIRVPFADVGVVKVPPDLPDEMLLFISDAIPTGYMGAEMCDIQPGDTVAVWGCGAVGQFAMISAYMMGAEKVIAIDRFPERLEMAKKYAKAEVINYEEVNAGEALKEMTGGRGPDACIDAVGLEAHGVGLEDFYDQTKQKLKLESDRPHVLREMMVACRKGGTLSIMGVYGGFVDKIPFGAAFNKGLTFRMGQMHGQKYMNLLLQLILDGKLDPSFVVSHQLPLEQAPLGYHIFQQKKDNCIKVVLKP

SEQ ID NO: 4335 - protein, 393 aa, Streptococcus suis 89/1591
MSKLSRRVLEMEESVTLAAGARAKALKAEGRDILELTLGEPDFVTPKNIQEAAIKSIEDGKASFYTVASGHPELKDAVNTYFENFYGYSIERNQVVLATGAKFVLYAFFAAVINPGDEVIIPTPYWVSYADQIKMNDGVPVFVTAREEHNFKVTVDQLEAARTDKTKVFLLNTPSNPTGMIYSREELEAIGNWAVEHDILILADDIYGRLVYNGNGFTPISSISESIRQQTIVVNGVAKAYAMTGWRVGFAVGNPEIIAAMSKIVGQTTSNLTTAAQYAAIEAFTGPQDTVETMRQAFEERLNTIYPLLAEVPGFEVIKPEGAFYLFPNVKKAMEMKGYTDVTEFTTAILEEVGVAMVTGAGFGAPENIRLSYATDMDTLKEAVARLHTFMKK

SEQ ID NO: 4336 - protein, 389 aa, Nostoc sp. PCC 7120
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWLVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLKPLLERIQNGEIDPSFVITHTIPLEQAPHGYEIFKHKKDNCIKVVLKP

SEQ ID NO: 4337 - protein, 366 aa, Bradyrhizobium sp. BTAi1
MQIKAAVARVQGAPLSIEALDIEDPRDNEILVKVVATGVCHTDLVVRDGMLPTPLPVVLGHEGAGIVTKVGRAISKVDVGDHVVMTFNSCGRCPSCQDHHVSYCHEFFPRNFFAARADGTSALSKQGERINGNFFGQSSFACHAICHEANVVKVDAKFDLELLGPLACGIQTGAGAVMNALKISAGKSFAVFGAGSVGLSALMAARVVGAATIVAVDTNDDRLAMARELGATHTINPTRVDATEEITKITGYGVNFALDTTGIAAVIRGAVMSLAPMGTCGILGASAMGTEITLDEVHFMSGGRRLMGIVEGESVPEVFIPMLAELNAQGRFPFDRLVKFYSLDQINEAIHDSETGRTIKPIVRMS

SEQ ID NO: 4338 - protein, 155 aa, Triticum aestivum
  misc_feature (123)..(123): Xaa can be any naturally occurring amino acid
  misc_feature (128)..(128): Xaa can be any naturally occurring amino acid
  misc_feature (141)..(141): Xaa can be any naturally occurring amino acid
  misc_feature (154)..(154): Xaa can be any naturally occurring amino acid
  unsure (1)..(155): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGXCTDAXQVINKVEESRRSXPDAYVRIIGSTNXK

SEQ ID NO: 4339 - protein, 190 aa, Triticum aestivum
  misc_feature (114)..(114): Xaa can be any naturally occurring amino acid
  misc_feature (124)..(124): Xaa can be any naturally occurring amino acid
  misc_feature (151)..(151): Xaa can be any naturally occurring amino acid
  misc_feature (161)..(161): Xaa can be any naturally occurring amino acid
  unsure (1)..(190): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGXCTDATQVINEVEEVKKEYPDAYVRIIXGFDNMRQVQXASGFIPFKPTGLRRSPAKAKTAHSTRGHI

SEQ ID NO: 4340 - protein, 381 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWCQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMAIFVRRTVGGGGNTQLERNEPGTKPMARVLLLRTCVAEHLSENMGRQTRERERSSDHSLGPCQGQFVGSARKIHR

SEQ ID NO: 4341 - protein, 1226 aa, Arabidopsis thaliana
  misc_feature (227)..(227): Xaa can be any naturally occurring amino acid
  misc_feature (708)..(708): Xaa can be any naturally occurring amino acid
  unsure (1)..(1226): unsure at all Xaa locations
MAARNLEKMASIDAQLRLLAPGKVSEDDKLIEYDALLLDRFLDILQDLHGEDVREFVQECYEVAADYDGNRNTEKLEELGNMLTSLDPGDSIVVTKSFSNMLSLANLAEEVQIAYRRRIKKSLKGDFADEACATTESDLEETLKRLLQLNKTPEEVFDALKNQTVDLVLTAHPTQSVRRSLLLDLASVRECLTQLYAKDITPDDKQELDEALQREIQAAFRTDEIRXRTPPTPQDEVRAGMSYFHETIWKGVPKFLRRVDTALKNIGINERVPYNAPLIQFSSWMGGDRDGNPRVTPEVTRDVCLVPRMMAANLYFSQIEDLMFEMSMWRCNEELRVRAERQRCAKRDAKHYIEFWKQIPANEPYRAILGDVRDKLYNTRERARQLLSSGVSDVPEDAVFTSVDQFLEPLELCYRSLCDCGDRPIADGSLLDFLRQVSTFGLALVKLDIRQESERHSDVLDAITTHLGIGSYKEWSEDKRQEWLLSELSGKRPLFGPDLPKTEEVADVLDTFKVISELPSDSFGAYIISMATAPSDVLAVELLQRECGITDPLRVVPLFEKLADLESAPAAVARLFSIEWYRNRINGKQEVMIGYSDSGKDAGRLSAAWQLYKTQEELVKVAKEYGVKLTMFHGRGGTVGRGGGPTHLAILSQPPDTIHGQLRVTVQGEVIEQSFGEEHLCFRTLQRFTAATLEHGMHPPVSPKPEWXRVLMDEMAIIATEEYRSVVFKEPRFVEYFRLATPELEYGRMNIGSRPSKRKPSGGIESLRAIPWIFAWTQTRFTYPKNLNMLKEMYNQWPFFRVTIDLVEMVFAKGDPGIAALYDRLLVSEELQPFGEQLRVNYQETRRLLLQVAGHKDILEGDPYLRQRLQLRDPYITTLNVCQAYTLKQIRDPSFHVKVRPHLSKDYMESSPAAELVKLNPKSEYAPGLEDTVILTMKGIAAVMGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAEDTLICNSLLSSYYLSLWIQS

SEQ ID NO: 4342 - protein, 69 aa, Arabidopsis thaliana
  misc_feature (59)..(59): Xaa can be any naturally occurring amino acid
  unsure (1)..(69): unsure at all Xaa locations
SPAQAGMVSPFNGLKTSTPFPATRKANNDITSITSNGGRVNCIQVWPPIGKKKFETFFXPPDLTDSELA

SEQ ID NO: 4343 - protein, 571 aa, Candida albicans SC5314
MPEDYEKYRMGSSNESHQKSVQPISSSISKSNKKTKHQTDFVQDSDIIEASSINDEFGEVKRDLKARHVSMIAIGGTIGTGLFISTGSLLHTTGPVMSLISFLFVTTICFSVTQSLGEMATYIPISGSFAQFVTRWVSKSCGAANGWLYWFSWAVTFGLELSVVGQVIQFWTDAVPLAAWISIFFVILTIFNFFPVKFYGEVEFWIASIKIIAVFGWIIYAFIMVCGAGKTGPVGFRYWRNGYAWGDGILVNNNGKYVAAFVSGLINSIFTFQGTELVAVTAGEASPRALRSAIRKVMFRILVFYVLCMLFMGLLVPYNDPKLTQDGGFTRNSPFLIAMENSGTKVLPHIFNAVIVTTIISAGNSNIYSGSRILYGLAQAGVAPKFFLRTNKGGVPFFAVAFTAAFGALGYLACSSQGNKAFTWLLNITATAGLISWGFISVSHIRFMKTLQRRGISRDTLPFKAFFMPFSAYYGMVVCFIVVLIQGFTVFWDFNASDFFTAYISVILFVVLWVGFHFFFYGFGKDSFKMSNILVPLDECDIDSGVRDINDAEFDIPPPKNAWDKFWAIVA

SEQ ID NO: 4344 - protein, 491 aa, Deschampsia antarctica
GPKSRSVEAISACLKAGMSVARFDFSWGDAAYHQETLENLKLAIKATKKLCAVMLGTVGPELQVVNKSEVTISLEENESVVLTPHQGQEASSKLLPINFSGLAKALKPGDTIFVGQYLFTGSETTSVWLEVSEVQGDDVVCVIKNSATLAGSLFTLHCSQIHIDLPTLSDEDKDVIKKWGAPNKIDFLSLSYTRHAEDVRQAREYLSKLGDLSQTLIFAKIENVEGLNHFDEILEEADGIFLSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKTSGVIKSHDRVVVCQKVGDSSVVKIIELDD

SEQ ID NO: 4345 - protein, 273 aa, Thermosynechococcus elongatus BP-1
MPNNTIVPRVPALGIIGCGRMAEAMLARLLAKGLLPDHVWVSARSPQRQQYLAHTYGVRVTTNLEVATAETLLLAVKPQVLADIESELADTPVAQEMGVVLSIMAGIHSGRLRRLFPQRLIFRAMPNTPAQVGAGVIALASDSAASELEIQKIKNLLGVLGQVVAVSEGQMDAVTALSGSGPAFVALIVEALCDAGVAVGLSRSLTQELVYGTIAGTVQLLKERGLHPAQLKDAVASPAGTTIAGLEVLEAAGMRGTLMQTVKAAYERSQALN

SEQ ID NO: 4346 - protein, 463 aa, Burkholderia sp. 383
MQQHTMRRELGARQISFMALGMAIGVGLFLGSASAIKAAGPGALVAYLIGGAMIFLIMRALGEMAVHRPVSGSFGAYAFEYVGPFAGYVVGWSYWLLMVGVGVAETTAIGIYMGFWFPDVPQWLWVVSAIAAISAFNLLNVKVYGELEFWFAIVKVVTIVLMIAGGALIVFTGIGHGGVPVGLSNLWRHGGVFPHGVLGVVSALPIVAYSFAGVEMIGLTAGEAREPQKMIPRAINSVLWRILIFYVGALFIIMALYPWHELGEHGSPFVTTFESLGLRQAAGIVNFVVVTAALSSFNCIVFSGARMLSSMAGNGLAPASFAALSASGSPSRAVRATVLFMSVGVVLNYVIPARVFGWLMSFLSFDVAVIWAMIVLTHMRFRRALAARGETVAFRMPYASVTSWICLVFVAFVFVMLGVDPTTRGSLYAGAAVMALMAIIYRRSRHLQAAARSTRVGLGVERV

SEQ ID NO: 4347 - protein, 176 aa, Triticum aestivum
HYRTSLYKKAGWYRSGIPGISSTHASARDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 4348 - protein, 517 aa, Oryza sativa
MAMKRTMKVVFSLALLLLPLASVAEEFDFMYLAQQWPDSYCSTHKCLVKPPPPSHFTIHGLWPSYNKLIDGKMWLEDCNKEDPLDPTQIQDLEKQLDQKWPSLKQTNLEFWSLEWKKHGTCSNLGQHAYFEAALALERLTNLTKILADGGVGPSDVKTYTFREISDALARGTGFRTYFKCSKNKAGDTLLSEVRQCVDRYGEKLINCTALSFDYCDNADKIKMPQSVGGPGGPRNTQKNSGPRPNRRTKWRRVWTRVRTLHSFPSRCFGDQAQGSKGGVLARRQAAGCGDATGVSVRVWRLMAAAATCGLRAASNATMQSARKGRLSKRALGQGVPAGRLKGRNDLKRKTATRLTTYSLKTGDCLIYIDVVQGCISTFDLLDCSDLPGLVFFINTQIGTPNGTRQKSELQLQFFSMAEKPPASPSSAGPGSIKEKIQKLGLSEVDEANIVPVTLDKLTPEQQKDLDTMMQQAQNQFLSSFTETRKGTLESTKVFKVMVLREFKVKALIKMATRHSYS

SEQ ID NO: 4349 - protein, 361 aa, Thiobacillus denitrificans ATCC 25259
MSLASTLEIIEELKAGRMVVLVDEEDRENEGDLVMAAEHVTPDAINFMAKYGRGLICLTLTDARCRQLGLKQMVSDNQTPHGTAFTISIEAAEGVTTGISAADRAVTIRAAVTKDAKPSDIIQPGHIFPLRAQPGGVLVRAGHTEAGCDLAGLAGLEPASVICEILKDDGSMARLPDLVPFAQEHGLKIGAIADLIHYRNQTESLVERAADRLIQTIYGAFRLIAYRDKCAKETHIALVKGEIHADRETLVRVHEPLSVMDFLDVTGGGHSWPIMGAMERIAESQSGVLVLLHRPETADALLGRINPAPAASHKYDLRDYGIGAQILRDLGVGKMKLLASPRKMPAMDGFGLEVTGYSEKA

SEQ ID NO: 4350 - protein, 311 aa, Prochlorococcus marinus str. MIT 9211
MIWSVDSIPNQEGRIVLVTGANSGLGFDTARFLLNKGAGVILGCRTMQKAELARQKLLEQTPSANIELLEIDLGDLNQVDRAADQIAIKYKKLDLLINNAGVMAPPFTLSKQGLELQFAVNHLSHMALTLKLLPLMSKQDGARVVTVSSGAQYMGKINWNDLQGNNHYDRWASYSQSKLANVMFALELHKRLKKSNCNVASLSSHPGLARTNLQIASVAANGSWQEGFAYKLMGPMFQSSAMGSLPQLLAATDPNAKSGEQYGPRFNFRGYPKLCRVAPLALNMELREKLWELSLKLIRNFIQINSFKEIL

SEQ ID NO: 4351 - protein, 309 aa, Pseudomonas aeruginosa PAO1
MHPWTRRNIPQLAGRLALVTGANSGLGWQAARTLAGKGATVVMACRNREQAERARRAILDEYPQARLELADLDLADLASIRACAAGFRQRHARLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 4352 - protein, 383 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 4353 - protein, 223 aa, Oryza sativa
ARGAAGEAAVTGGEEAEVEALLRAAQDAVMLKLQANSHLVSSSSSATAPNLPPSLDHPAAAAAADPLDADLARRFDALRSHRPPDPKPKQPDAPSAAAAGGMDELEARFAALKGAAGPEKETRVRLEDLGGESDEDEDDEVDKVMRWAMDAARLDVATAGAGKAKSTKKDDDEEEEEKDQTSSSVSSEDEEEEEEEKLEKERERKRKEMMSKNKSKTKWFSLF

SEQ ID NO: 4354 - protein, 180 aa, Nicotiana tabacum
MASSVLSSAAVATRTNVAQANMVAPFTGLKSAASFPVSRKQNLDITSIASNGGRVQCMQVWPPYGKKKYETLSYLPDLSEEQLLSEIEYLLKNGWVPCLEFETERGFVYRENNKSPGYYDGRYWTMWKLPMFGCTDATQVLAEVGEAKKAYPEAWIRIIGFDNVRQVQCISFIAYKPEGY

SEQ ID NO: 4355 - protein, 341 aa, Streptococcus suis 89/1591
MKAVVVNPESTGVVVVDKELRSLEAGEALVQIEYCGVCHTDLHVANGDFGKVPGRVLGHEGIGIVTEIAPGVTSLKVGDRVSVAWFFQGCGMCEYCTTGRETLCRTVKNAGYSVDGGMAEQCIVTADYAVKVPEGLDPAQASSITCAGVTCYKAIKEAHLEPGQWIAIYGAGGLGNLAVQYAKKVFNAHVIAVDINNNKLELAKEVGADVTINGLEVEDVPGYIKEITGGGVHSTVVTAVSKVAFNQAIDSVRAGGYVVAVGLPSEYMDLSIVKTVLDGIKVVGSLVGTRKDLEEAFHFGAMGLVVPVVQKRPVEDAEAVFNEMVAGTIQGRMVLDFCHSH

SEQ ID NO: 4356 - protein, 360 aa, Candida albicans SC5314
MDLDTDVPMEDVEEQQQQQEQSLSKQSATKSLTNPQGTGATATSSAQQQRKDLDGSSINQLDVWIEKLSKCEPLSETDVKKLCDMAVEVLQFEENVQPVQVPVTICGDVHGQFHDLMELFKIGGPCPDTNYLFMGDYVDRGYYSVETVSYLVCMKVRFPNRITILRGNHESRQITQVYGFYDECLRKYGSATVWKLFTDLFDYFPITALVDNKVFCLHGGLSPMIETIDQVRELNRIQEVPHEGPMCDLLWSDPDDRGGWGISPRGAGFTFGQDISEQFNHTNDLSLIARAHQLVMEGFSWSHQENVVTIFSAPNYCYRCGNQAAIMEVDEQHNRQFLQYDPSVRPGEPTVTRKTPDYFL

SEQ ID NO: 4357 - protein, 357 aa, Aspergillus nidulans FGSC A4
MPAQHRPLWWYGWNALRGGNPTFLTPDQVPVPDLSGKWIIITGSNSGIGLEAAKAFASAGANLILGCREPAAWETHPAAAAEECQTLARVNGHTESVIEWWKIDMADLSAVDAFAQRWLDTGRALDILCNNAGMGPTGSRKPILTKDGLEILHQVNFTSHVLLTLRVLDSLAKAPQPRIVCTTSCFHFRGYFDLDHFNGELGMAGDPYPNNKLYFQVWLTELHSRLLASPNYRHVTVNGINPGYVNSGIWNNPLSETKNTWIDTAYKFWKFVASILAISPQQGSLAIVYAATSAEFGPDPVTQGVGEIGGKGGGHYINRIWEGEAMPHCSDEECRKEVWEKVGKELGLEERGLGHWV

SEQ ID NO: 4358 - protein, 227 aa, Glycine max
MESKESIFVKLLLILHLSVLCVSQDFDFYYFVQQWPGSYCDTTQNSCCYPTTGKPAADFGIHGLWPNYKDGSYPSNCDSNNRFQPSQISDLTSSLQRNWPTLACPSGNGVQFWTHEWEKHGTCSQSVLKQHDYFETALDLKQRANLLQALTNAGIQPDGGFYSLSSIKGAIKNAIGYTPYIECNVDTSRNNQLYQVYLCVDTSGSNFIECPVFPRGKCGSQVEFPTF

SEQ ID NO: 4359 - protein, 341 aa, Glycine max
FGSRDHSADAQRTDLMTITRFVLNQQSNHPESRGDFSILLSHIVLGCKFLCSAVNKAGLAKLIGLAGETNVQGEEQKKLDVLSNDVFIKALVSSGRTCILVSEEDEEATFVEASKRGKYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYAAEE

SEQ ID NO: 4360 - protein, 426 aa, Polaromonas sp. JS666
MDMTEIHVIKQHLIDPEICIRCNTCEAICPVQAITHDSRNYVVDAEKCNLCMACISPCPTGSIDNWRTMPRIKAYSLTEQLGWDELPPELTPEELAAEGVVPGAMPEIEPVAPSLPAAVSGETAFNSAQYGATMPPWSAAHGYTNLYGAKAAEKFITATVVGNVRVTEVGKEYDTHHIVLDFGSMPFPVLEGQSIGILPPGTDEASKPHYARQYSIASPRNGERPGYNNVSLTIKRVLQDHQGNAVRGVGSNYMCDLQIGDKVQVIGPFGTSFLMPNHPRSNIVMICTGTGSAPMRAMTEWRRRLRQSGKFEGGKLMLFFGARTKEELPYFGPLQTLPKDFIDINFAFSRTLEQPKRYVQDAMRERAADLGVLLKDPNTYFYVCGLKSMEEGVVLALRDVAQQAGLSWETVGAALKQEGRLHLETY

SEQ ID NO: 4361 - protein, 294 aa, Mycobacterium sp. KMS
MTIRLLGRTEIRRLAKDIDFRPRKSFGQNFVHDANTVRRIVSASGVHRHDHVLEVGPGLGSLTLALLDRGAHVTAVEIDPLLAQQLPTTIADHSHSEINRLTVLNQDILTLMPSDLENQPTALVANLPYNVAVPALLHLLAEFPTIRSVMVMVQAEVAERLAADPGGKDYGVPSAKVRFYGNVRRYGMVSPTVFWPIPRVYSGLVRIDRYETSPWPTDADFRAQVFDLIDIAFAQRRKTSRNAFAEWAGSGNESARRLLAASIDPSRRGETLAIADFVRLLQRSGEAEEQVRVQ

SEQ ID NO: 4362 - protein, 394 aa, Streptococcus thermophilus LMG 18311
MTVMDLTQRFNKNLDKIEVSMIRQFDQSISDVPGIKKLTLGEPDFTTPDHVKEAAKTAIDANQSHYTGMAGLPDLRQAAANFVKEKYNLTYNPDNEILVTIGATEALSASLTAILEPGDTILLPAPAYPGYEPIANLVGAKIVEIDTTANDFVLTPEMLEKAILEQGDKLKAVLLNYPTNPTGVTYSRQQIEDIAEVLKKYDIFVVSDEVYSELTYVDQHVSIAEYLPEQTILINGLSKSHAMTGWRIGLIFAPASLTAQLIKSHQYLVTAAATMAQFAAIEALSAGKDDAQPMKVEYLKRRDYILEKMTELGFKIIKPDGAFYIFAKIPEGYNQDSFKFCQDFAREKAIAIIPGVAFGKYGEGYVRLSYAASMDTIETAMTRLKEFMEEHAEA

SEQ ID NO: 4363 - protein, 180 aa, Oryza meyeriana
FGSVYRGRLKGKELAVKQLDRNGMQGTREFLVEVLMLSLLEHPNLVTLLGYCTDADHRILVYEYMPRGSLEDHLLDLPPGASSLDWTTRMRVAQGAARGLEHLHDAARPPVIYRDFKASNILLDRSFQARLSDFGLAKVGPVGDKTHVSTRVMGTYGYCAPEYALTGKLTTCSDVYSFGI

SEQ ID NO: 4364 - protein, 272 aa, Oryza sativa
  misc_feature (224)..(224): Xaa can be any naturally occurring amino acid
  misc_feature (233)..(233): Xaa can be any naturally occurring amino acid
  unsure (1)..(272): unsure at all Xaa locations
CNKIVDILTEQKIVPRIKVDKGLVPLAGSNNESWCQGRDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGXTPENVKAAXQDALLLRAKANSLAQLGKYTSDGEAAEAKEGMFVKNYVY

SEQ ID NO: 4365 - protein, 390 aa, Wolbachia endosymbiont of Drosophila melanogaster
MPDLKTMMLNFGPQHPAAHGVLRLVLEMDGEVIERADPHIGLLHRGTEKLIEHKTYLQALPYFDRLDYVSPMSQEHAYSLCVEKLLQCEVPIRAKYLRVLFCELTRILNHLLNVSSQALDVGAMTPLLWLFEEREKILEFYERASGARFHAAYIRPGGIAADVPEDLIEDIAKFIEQFPKYIDDVDELLTENRIWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLQALDFMAKGHMLADVAAIIGSLDIVFGEIDR

SEQ ID NO: 4366 - protein, 92 aa, Nicotiana tabacum
MADSQPSIEAKVHIVYTEKPEDLEAEDYHIKTLASVLGSEEAAKEALIYSYKHAASGFSAKLTAEQVSELSKQPGVLQIVPSQTVQLHTDRV

SEQ ID NO: 4367 - protein, 204 aa, Oryza sativa
ARGLVPNSARGFWLATPPKVHSTHPRRKVEAVSWGLDMLKRSHGGFRLGRKLLSAWRWALCCRRRRRRGYLRLQTTSGGCGGACKEGSEEAKRLAPVLRWGRSLVRRLSLGRKDGGRRRILDEPVSTPKGQVAVYVGGGNPGESLRYVVPVVYFNHPMFGELLREAEEEFGFQHPGGITIPCAASRFERAAAVAAAGKKAFGRW

SEQ ID NO: 4368 - protein, 63 aa, Actinobacillus pleuropneumoniae serovar 1 str. 4074
MELVFIRHGFSEWNAKNLFTGWRDVNLTERGIEEAKSAGQKLKAAGYEFDIAFTSVLTRAIKT

SEQ ID NO: 4369 - protein, 550 aa, Nicotiana tabacum
MGQYSSTHCGGGPKLRHRNLHPSPLPNHHRSTSESDFFSLMNSDEDESILPSDFENPDYTYELPDECLALIFQCLSSGDRKKCSLVWRRWLLVEGQSRHRLSLNAKAEFLPHIPTIFSRFDSGTKLALRCDRKSVSINDEALTLISLRCVNLTRLKLRGCRDVTDVGMSAFAKNCKSLKKFSCGSCMFGAKGMNALLDHCSTLEELSVKRLRGINDGFAADPIGPGAAASSLKSICLKELYNGQCFEPLIIGSKNLRTLKLLRCLGDWDRLFETIGSRENHVAEIHLERLQVSDTGLNAISNCPNLEILHLVKTPECTDAGVVAVARKCKLLRKLHIDGWRTNRIGDEGLVAIAENSLNLKELVLIGLNPTSPSLLAIASNCQKLERLALCGSDTIGDPEVSCIATKCMALKKLCIKGCEVTDEGFESFAWGCPNLVKIKVKKCKHVTGDVADWLRARRRSLAVNLDVGEVDVEPVDGSASDGGALEDAVEFQPIANTLPVIGAADIPSTSNVGRSAAAKSWFGFFGGRGLVACTLRRLSNGNGDSNESL

SEQ ID NO: 4370 - protein, 727 aa, Rhodococcus sp. RHA1
MTSPELALTVRLNTSAADTRRGVVRLHPEALAALGLREWDAIALVGARRTAAVAGRAPAGTPTGTALLDDVTLSNAGLTENSTVVVTPVTVYGGKTVTVSGSNLAVNSVSDVTLRHALLGKVLTVGDTVSLLPRDLGPGTSTAPATQALSRTFGVAWTSELLTVTGVDPAGGPVSVQPNTAVGWGEGVRATVSAAPTRLPAPPVRPAEEVPPVPVEDLVGAHTQAAKLTEWLGLALDEPELLRKLGASPHLGVLVTGPAGVGKATLARAVLASRRLVELDGPSAGALEADSRLQRVTAAVDAIRSGGVLLITDIDALLPATPEPVSALIVEQLRRAVDTVGVAFVATSAHPESVDARLRGQDLCDRELTLTLPDGSTRRALLELLLRKVPTDGIALEAIAARTPGFVVADLAALCREAALRAASRAARKPVDPALTQDDLLGALDVIRPLSRSGSEELAIGTLTLDDVGDMVETKQALTEAVLWPLQHPDSFARLGVDPPRGVLLYGPPGCGKTYLVRALASSGHLSVHAVKGAELMDKWVGASEKAVRELFQRARDSAPSLIFLDEVDALAPRRGQSSDSGVSDRVVAALLTELDGVEPLRDVVVVGATNRPDLIDPALLRPGRLERLVFVPPPDGEARRAILRTSGKSVPLADDVDLDALADDLDGYSAADCSALLREAALAAMRRNIDAADVTAADVAEAREKVRPSLDPEQVAHLESYALSRP

SEQ ID NO: 4371 - protein, 278 aa, Bordetella bronchiseptica RB50
MSVPTAAKRITTRQLRMRTPDEPIVALTAYTAPIAGLLDAHCDLLLVGDSLGMVIYGMETTLPVTVDMMIQHGRAVMRGSQRACVAVDMPFGSYQEDERQAYRNAARIMAETGASCVKLEGGAEMASTVAFLVERGIPVMGHVGLKPQSVHGHGGFRTVGRGAEAEQVMADAQAIAAAGAFTVVIEGTLEPVARAITEALPVPTIGIGASPACGGQILVSDDVLGLFSDFTPRFVKRYAQLGPIIEQAAAAYASEVRARTFPAPEHCTGMPAPDGRPA

SEQ ID NO: 4372 - protein, 402 aa, Synechococcus sp.
MYGITSTANSTGNQSYANRLFIYEVVGLGGDGRNENSLVRKSGTTFITVPYARMNQEMQRITKLGGKIVSIRPAEDAAQIVSEGQSSAQASAQSPMASSTKIVHPKTTDTSVPVNITRPKTPFLGKCIENYELVDEGGSGTVRHVTFDISEGDLRYLEGQSIGIIPPGEDKNGKPHKLRLYSIASTRHGDMEDNKTVSLCVRQLEYQDPESGETVYGVCSTYLCNLPVGTDDVKITGPVGKEMLLPDDEDATVVMLATGTGIAPFRAFLWRMFKEQHEDYKFKGKAWLIFGVPYTANILYKDDFEKMAAENPDNFRLTYAISREQKTADGGKVYVQSRVSEYADELFEMIQKPNTHVYMCGLKGMQPPIDETFTAEAEKRGLNWEEMRRSMKKEHRWHVEVY

SEQ ID NO: 4373 - protein, 341 aa, Oryza sativa (japonica cultivar-group)
MASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSAANCYKSEHLKKPENWALVEKAKYIYIAGFFLTVSPDSIQLVAEHAAANNKVFLMNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 4374 - protein, 444 aa, Xylella fastidiosa Temecula1
MNHSRSHALFVQAQTRIPGGVNSPVRAFRSVGGEPFFVARADGPYLFDVDGHRYIDYVGSWGPMIVGHNHPAVREAVQVAISNGLSYGAPCAAEVTMAETIARLVPSCEMVRMVNSGTEATLSAIRLARGATGRNYIVKFEGCYHGHGDSFLVKGGSGMLTLGIPSSPGVPAELSKLTITLTYNDFDAATALFEEMGHHIAAVIVEPVIGNANCIPPQPGYLQHLRTLCTQYAVLLIFDEVMTGFRVALGGAQALYGVTPDLTTFGKIIGGGMPVGAYGGRRDLMQHIAPTGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIETTLEAARTAFQTIANEAAILSKSETPIKMR

SEQ ID NO: 4375 - protein, 339 aa, Glycine max
MSVSCSNCFPDDDDSFLLCGEDSSGIIDSSPECSSDLDSPPPSEAEAESIAGFIEDERNFVPGFEYLNRFQSRSLDASAREESVAWILKVQAYYAFQPLTAYLSVNYLDRFLNSRQLPQTNGWPLQLLSVACLSLAAKMEEPLVPSLLDLQVEGAKYVFEPKTIRRMELLVLGVLDWRLRSVTPFSFLDFFACKLDSSGTFTGFLISRATQIILSNIQEASFLAYWPSCIAAASILHAANEIPNWSFVRPEHAESWCEGLRKEKVIGCYQLMQELVINNNRRKPPKVLAQLRVTTRTRMRSSVSSFSSSSSSSTSFSLSCKRRKLNNRLWVDDEKGNSE

SEQ ID NO: 4376 - protein, 181 aa, Zea mays
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 4377 - protein, 304 aa, Arabidopsis thaliana
MEERRDDESSPTHQGSELAERVKLLSFESQGEALSKDSPRSVEQDCSPGQRASQHLWDTGILSEPIPNGFYSVVPFLKFEILLQDKRVKELYNRLPTPSELHALGEEGVRIEVILVDFQKDKKLAMLKQLITTLVSGSGTNPALVIKKIAGTVSDFYKRPTLESPSKLALEENAFLFENHGAQLLGQIKRGCCRARAILFKVLADTVGLESRLVVGLPSDGTVNCMDSNKHMSVIVVLNSVELLVDLIRFPGQLVPRSAKAIFMSHISPAGESDSAENDSCDSPLEPNSPLYERRDPERSASVV

SEQ ID NO: 4378 - protein, 375 aa, Arabidopsis thaliana
MSLPSSPHAYRCQTFGRRGPSEFAVKDTWNKVVESSTLQNQPLLPYQEWDIDFSELTVGTRVGIGFFGEVFRGVWNGTDVAIKLFLEQDLTAENMEDFCNEISILSRVRHPNVVLFLGACTKPPRLSMITEYMELGSLYYLIHMSGQKKKLSWHRRLRMLRDICRGLMCIHRMKIVHRDLKSANCLVDKHWTVKICDFGLSRIMTDENMKDTSSAGTPEWMAPELIRNRPFTEKCDIFSLGVIMWELSTLRKPWEGVPPEKVVFAVAHEGSRLEIPDGPLSKLIAGLVLLNTMFLELFCLFSYISQLLQSELKLTTISVQIVGQSLKNAQIVKRYLEAYSIVSTHCANNTSLSGGYEPEDVLAQKTSQLLLNLGS

SEQ ID NO: 4379 - protein, 353 aa, Candida albicans SC5314
MPPKKKVNQPADKAKAKAKAKSAEDKSFGLKNKNKSKKVQQQINQMKAGIDGGLAKKKEAEAKRKAEEKKAQEEAKKEAAALFGIQQQKVPFGVDPKSILCEFFKQGLCTKGNKCKFSHDPNVGRKVVKKDLYTDSRQEEKENDTMDNWDEEKLRKVILSKHGNPKTTTEKVCKFFIEAVENGKYGWFWVCPNGGNECKYKHSLPPGFVLKTKEQKKLERLAAENEPKITLEEFLELERSKLDKSKFTPITAESFAKWKQEQTSKKESQRKEDEKRGRRVLTGREVILEKFSDKYYTEEDNGETWDLSQFKSNLPDDSDPNIKDYGDGSKAQEYYQQEDNQSESLENKDAITA

SEQ ID NO: 4380 - protein, 406 aa, Aquifex aeolicus VF5
MSEREEFKFNTVEEAIEDIRQGKMVIVVDDPDRENEGDLVMAAEKVTPEAINFMAKYGRGLICLSLTPERCEQLDLHPMTPMNTDPKGTYFCVSIDAHPKHGTTTGISAYDRALTIKLAISPDAKPSDFVRPGHVFPLKARPGGVLERAGHTEASVDLARLAGLYPAGVICEIMKDDGTMARVPDLMEFAKKHNLKIITIADLIKYRLRRETLVEKVASAHLPTPWGVFKIHAYRHKLTGEEQVALTMGEWKEDEPVLVRVHSECLTGDVFRSFRCDCRPQLEKALEMIAKEGKGVLVYILGHEGRGIGIANKIKAYELQEKGYDTVEANEKLGYPPDLRDYGIGAQILRDLGVRKMKLMTNNPRKIVALEGFGLEVVERVPIKIEPNPYNKIYLQVKKDKLGHMF

SEQ ID NO: 4381 - protein, 762 aa, Desulfotalea psychrophila LSv54
MVRALPKIESLRQGSNKNRPQRVSTPVTAPGMTNIYLDKRNTTRRMTPKQYTNESSTPTFQKIALPLNFSTKHHILKHQHFLFCPTIYLTKSYIKRQNMGIATDIIIIVLAAFCCGLLMQMLRQPLILGYILAGIIVGPHTGGFTVAGVHEIELLAEIGVALLMFALGLEFSLKDLKPVKNIALIGTPIQILLTMIFGYGIGYLLGWSWKDSLWFGTMISLSSTMVILKTLMNQGWMGTLSSKVMIGMLIVQDLAIVPMMIIMPELNDPAMGLSSLGIAAVKATLFLGTMLLLGAKLLPTMVRHIARSGSRELFLLAIITIGLGVGLVTHLVGLSFAFGAFVAGMVLSESDHGHQALSDIIPLRDLFGLLFFVSVGMLLDPHFLFAHLQLIALLVLLVGLGKGIIFSAISWFFGYGNIVPIAVGLGLFQVGEFSFVLAQVGLETKSISSDLYNTILTTAILSMALTPLISSQAGRFYALKKKWFSQESLKNIALPDEKLCGHVVIIGHGHVGFKIATALKQLAIPFILVELDQQRVEEAKRLDFPVIFGDACHETIQEALCLETASLLVVTIPSVIAAQEIIKRIRRSQNNIRIVARISDPASSHIFTDLDIHDLVLPKLETSLEMIRLILLHRQISPTEIHNLTNIIRQDFIAPNTQNYITLAHMRAAELQFDLEWIVLETGNTLPGKSIREAEIRNKTGATVVSIIRERQLYSNPDSNFCFEAGDMVAIIGTEEVRTAFHSYGQATDVKTGRDNPLTNNS

SEQ ID NO: 4382 - protein, 247 aa, Aquifex aeolicus VF5
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 4383 - protein, 417 aa, Zea mays
  misc_feature (210)..(210): Xaa can be any naturally occurring amino acid
  misc_feature (398)..(399): Xaa can be any naturally occurring amino acid
  misc_feature (401)..(401): Xaa can be any naturally occurring amino acid
  unsure (1)..(417): unsure at all Xaa locations
GATLTSSIVDSGSSSSQRKLMEHKRTILLVNKADLLPLNIRKRWADYFKAHDILYVFWSAKAATATLEGKKLSGYSEGESASLDLDTKIYERDELLMKLQAEAESIVAQRRISPTVDDHEASSSDSVSSVTKHVVVGFVGYPNVGKSSTINALVGEKRTGVTHTPGKTKHFQTLIISEELTLCDCPGLVFPSFSSSRHEMVACGVLPIEXFPVPKHRGAIQVVANRVPRNILEQVYKITLPKPKAYEEASRPPTAAELLMAYCTSRGHVSHAGLPDETRAARQILKDYIDGKIPHFELPPGEIDDETDAEDNSDLEGSSTAAADQSDDGASDEDDEEINRAEPNISHALNDLASFDMNGQMTKGSTKKKKKEASHKHHRKPQRKKDRSWRVGNDGADXXSXVIRVVQKPAVNLAAVH

SEQ ID NO: 4384 - protein, 473 aa, Pseudomonas fluorescens Pf-5
MSGQNSHSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYVHYWWPDVPTWASAAVFFVMINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVVLLSLTPWDTLLVTLNASGDAYSGSPFVQVFSMLGSNTAAHILNFVVLTAALSVYNSGTYCNSRMLLGMAEQGDAPKALAKIDKRGVPVMSILASALVTFVAVVLNYLIPQHALELLMSLVVATLVINWAMISYSHFKFRQHMERTGQTSLFKALWYPYGNYVCLAFVVFILGIMLMIPGIQISVYAIPVWVVFMWVCYCIKNKRSAQHALQAASASLK

SEQ ID NO: 4385 - protein, 515 aa, Candida albicans
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGVTEISFETLKQCEYLKAVINETLRLYPSVPRNGRFANKNTTLPRGGGPDGMSTILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 4386 - protein, 151 aa, Solanum brevidens
  misc_feature (7)..(7): Xaa can be any naturally occurring amino acid
  unsure (1)..(151): unsure at all Xaa locations
RKSFYYXAENNVVFEGILLNPSMVTPGAEHKEKATPDTIAKYTLTMLKRRVPPAVPGIMFLSGGQSEVEATLNLHAMNQSPNPWHVSFSYARALQNTVLKTWQGRPENVDAAQRALLIRAKANSLAQLGKYSAEGESEEAKKGMFVKGYTY

SEQ ID NO: 4387 - protein, 76 aa, Arabidopsis thaliana
  misc_feature (26)..(28): Xaa can be any naturally occurring amino acid
  misc_feature (31)..(31): Xaa can be any naturally occurring amino acid
  misc_feature (59)..(59): Xaa can be any naturally occurring amino acid
  unsure (1)..(76): unsure at all Xaa locations
MASSMFSSTAVFTCGGQSTIVAPFTXXXSSXSFPVTRKANNYITWITSNLLIVICIKKXPPIRNNNFHTLSYLPDL

SEQ ID NO: 4388 - protein, 404 aa, Leptospira interrogans serovar Copenhageni str. Fiocruz L1-130
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITPEQLKKVITPKTKCLILNSPSNPTGAGYTKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGSSETSLSKIFCSTLLEKYKVAAVPGIAFGEDQALRLSYAMGENDIRRGVERIAEMIRDLN

SEQ ID NO: 4389 - protein, 216 aa, Zea mays
HNDSLLPEGVSRVQQFVEKPDEKRATEFVKSGGYFWNSGMFLFRASRFLEELKKHDPDIYDTCVLTLERSNHTADTIDIDESTFACCPDNSIDYAVMEKTQLACVVPLTAGWSDVGCWASLWDVNEKDANGNVSKGDVVIQDSKNCMIHGNGKLVSVIGLENIVVVETKDAMMIAHKDKVQGVKQMVNTLNEQGRSETQNHCEVYRPWGSYDSVDI

SEQ ID NO: 4390 - protein, 404 aa, Mannheimia succiniciproducens MBEL55E
MELFPKSNKLEHVCYDIRGPVHKAALRLEEEGHKILKLNIGNPAPFGFEAPDEILIDVIRNLPTAQGYCDSKGLYSARKAIVQYYQSKGIHGATVNDVYIGNGASELITMAMQALLNDGDEVLVPMPDYPLWTAAVTLAGGKAVHYLCDEEQDWFPAIDDIKSKITSRTKAIVIINPNNPTGAVYSKELLLEIAEIARQNGLLIFSDEIYDKILYDGAVHHHIAGLAPDLLTITMNGLSKAYRICGFRQGWMILNGPKDKARGYIEGLDMIASMRLCANVPMQHAIQTALGGYQSINELIVPGGRLYEQRNRAYELLNQIPGVSCVKPMGALYMFPKIDIKKFNIYDDEKLVLDLLAQEKVLLVHGRGFNWHAPDHFRIVTLPYVHQIEEALNKFARFMENYHQ

SEQ ID NO: 4391 - protein, 271 aa, Mannheimia succiniciproducens MBEL55E
MKNKLLTFIGGGNMAQAIVFGLLNKGYSAAKLIVCDRNEAKRNLFAQKGVEVNLTNVEAAEKAEVVVLAVKPQAMAETCGPLSAVDFSGKLVISIAAAVSVSRLSALLPTAKNIVRVMPNTPALVSEGMAGLFASAGLNGEYQDFAEDLLNAVGKTCWLQKEEDMHAVTAGSGSSPAYFFLFMEAMEKTLSSMGISPENARTLVQQSALGAAKMVENNPQLPLSTLRENVTSKGGTTAAALAVFNQYQLDKIVQQAMEACVARSQEMEKLF

SEQ ID NO: 4392 - protein, 263 aa, Synechococcus elongatus PCC 7942
MGEVRRHLKLVNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 4393 - protein, 396 aa, Propionibacterium acnes KPA171202
MRHPQRVFSSMRKIMFVIGSMPLTHPSQSADGDPGKKYEVTRLDLGHLHPTRSGLVTIATTVDDDVIISSQVNVGTLHRGDEKLFEVRDYRQIPMLASRHDWTAPFIGETGAAHAIEDAMGITIPTRVAWIRTLLAEFSRITSHFTFLSWVGHHCDDAGLENAIATAIENARRIWQRCSGNRIHPMITRIGGLRIHPESEWQPALGEWLDDANALVTRLRTALDATVGVRGVAVIPTNMIDRYGLSGPVSRASGVDLDTRRRTAVYDELKWPEVVIEPRGDAYSRLATLCNDAAVSSSLCRQILDRLPSLDGPLETRLPTAIKAPRGRTWTTIEALWGRAGYLLESRGSTTPWRMALRTPTFANVQVLEAVLPGTRVDDVEATIASLGWTLGDLDK

SEQ ID NO: 4394 - protein, 470 aa, Vibrio fischeri ES114
MKKTKIVCTIGPKTESVEKLTELANAGMNVMRLNFSHGDFAEHGQRIDNVRQVMKNTGKQLAILLDTKGPEIRTIKLENGDDVALVAGQDFTFTTDTSVVGNKDVVAVTYPGFANDLEVGNTILVDDGLIEMEVVATTETEVKCKVLNNGDLGENKGVNLPGVSVQLPALSEKDKADLKFGCEQGVDFVAASFIRKEEDVKEIRELLVANGGENIQIISKIENQEGVDNFDSILEASDGIMVARGDLGVEIPVEEVIFAQKMMIEKCNRARKVVITATQMLDSMIKNPRPTRAEAGDVANAIMDGTDAVMLSGESAKGKYPVEAVTIMAQICARTDAALKAELGSRLDSPRLRITEAVCKGAVDTAEKLNAPVIVVATEAGKSARSIRKYFPTAKIIAVTTNTKTAAQLCLSKGITPMIVDSIDSTDAFYLRGKELALESGIGAKGDIVVMVSGALVPSGTTNTASVHVL

SEQ ID NO: 4395 - protein, 177 aa, Echinochloa crus-galli var. formosensis
YYEAGARLAKWRAVLNIGPNEPSQLAIDQNAQGLARYAIICQENGLVPIVEPEILVDGPHDIERCAYVTEKVLAACYKALNEHHVLLEGSLLKPNMVTPGSDAKKVANEVIAEYTVRALQRTVPAAVPAIVFLSGGQSEEEATLNLNAMNKLNTKKPWSLSFSFGRALQASTLKAWS

SEQ ID NO: 4396 - protein, 71 aa, Triticum aestivum
AVGVVGGVIALGLLALLLVCFVRYKREKKMEVMERNAEVGETLRMAQVGRSQAPVALGTRTKPVIESEYVA

SEQ ID NO: 4397 - protein, 102 aa, Medicago truncatula
MYSDQMSNLTVVEKILRSITSMYDYVDGVWFTSLDYKNAQPDPLREFAENLLVEINTNTMKDITRFCNVFVDLNFQDSEAKMIWVDRLGLDMRLFSPNYGLF

SEQ ID NO: 4398 - protein, 263 aa, Candida albicans SC5314
MFIRSLYHRISNTKTITNLIIRNMSSTSKVESAKKLAAYKAVDENFPKDAKVIGIGSGSTVIYAAERIGQLDNKDSFICIPTGFQSKQLIIDNGLRLGTIEQYPDIDIAFDGADEVDPQLNLIKGGGACLFQEKLVAASAKKFVVVADYRKKSDKLGQSWRQGVPIEIVPNSYSKIIQELSKKLGAKNVDLRQGGKAKAGPIITDNNNFLLDADFGEIEIDNVGKLHEQIKLLVGVVETGLFTNMANKAYFGEEDGSVSVWSK

SEQ ID NO: 4399 - protein, 179 aa, Fritillaria agrestis
MASSATMLSSVATAACVAPAQASMVAPFVGLKSASAFPVTQKTVTGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 4400 - protein, 482 aa, Ustilago maydis 521
MSDEEFIMDDAADEDYDFEYEEDDDLDDADADIENRYYNAKNIRDSDPDGAIQELKAVVQAEKEKGDWGFKALKQMTKINFHRGHHVEALDTYTQLLSYTKSAVTRNYSEKSINNILDYVSNATDVGLSTMQSFYDVTKSALEDARNDRLSVKTDLKLARIWLARKEWGRLAKSLKQLHAYCTSKDGSDDQSKGTILLEIFALEIQMYGEVGNFKKLKEVYNSTLQVKSAIPHPRIMGVIRECGGKMHMSEKNWAAAQVDFFQAFLNYDEAGSTQRIQVLKYLVLAHMLMGSDINPFDSQETKPYKNDPEIVAMTNLVAAYQRREVHEAEKILRENKRTILEDSFIKAYIDDVLRGLRTQYLIDTIKPYSRMQLGYLAQQLNISVDQVEDLLMSLILDEIIKARIDQVGQYVELDRSANSSGKPRYQALGKWNVELDRLGSSVHVKHAAGAGSGSGTNLGGSFLRMGIGLGGTAPGLGPSLR

SEQ ID NO: 4401 - protein, 215 aa, Aeromonas hydrophila
MKKIVVLLGMLLAPWFSSAVQAKGEAGEFDYYAMALSWSPEHCAIKPADRDQCSRQLGFVLHGLWPQYQRGYPSSCTRERLDPAMEQEFAGLYPSRFLYRHEWEKHGTCSGLSQHDFHQLASDLRQKREDPGRLSVSCRAAAQKPLPAQGGSGQCQRLAGPGQHHGGLRRRWRFLREVYICLNKEGTDAVTCSDEMQKRELPSCGQPDFLLRTVR

SEQ ID NO: 4402 - protein, 535 aa, Oryza sativa (japonica cultivar-group)
MAKKKERAVNVSGKPRHSLDVNRANDKKGAGGGAGGGGGGRSAATVRRLKMYKMRPLRDRGGKILKHDLQSKELPNTRIEPDRRWFGNTRVVNQKELEFFREELQSRLSNNYNVILKERKLPLSLLQDHQKQARAHLLDTEPFEHAFGPKGKRKRPKLMALDYESLLKKADDSQGAFEDKHATAKLLKEEEEDGLRDLVRHTMFEKGQSKRIWGELYKVIDSSDVVVQVLDARDPMGTRCYHLEKHLKENAKHKHLVFLLNKCDLVPAWATKGWLRTLSKDYPTLAFHASINSSFGKGSLLSVLRQFARLKSDKQAISVGFVGYPNVGKSSVINTLRSKSVCKVAPIPGETKVWQYITLTKRIFLIDCPGVVYQNNDSETDIVLKGVVRVTNLADASEHIGEVLRRVKKEHLKRAYKIEDWVDDNDFLVQLSKTTGKLLRGGEPDLTTTAKMVLHDWQRGKIPFFVPPPQQGEDSPSETAEPVEKSDEEGVSSDRTAAAMKAIAGIISSQQQMNVPCQKEFGVTNEDSEVAEQSE

SEQ ID NO: 4403 - protein, 372 aa, Arabidopsis thaliana
MFAQLAPSPSPSPANVSHFVHRRTFRQCTYAVSASLPTANSSRPPPIQIVGGKDLNLDVTRKDDSIGFKLEANEDEIDWMNLESDIRLWTRALRPVQWYPGHIMKTEKELREQLKLMDVVIEVRDARIPLSTTHPKMDAWLGNRKRILVLNREDMISNDDRNDWARYFAKQGIKVIFTNGKLGMGAMKLGRLAKSLAGDVNGKRREKGLLPRSVRAGIIGYPNVGKSSLINRLLKRKICAAAPRPGVTREMKWVKLGKDLDLLDSPGMLPMRIDDQAAAIKLAICDDIGEKAYDFTDVAGILVQMLARIPEVGAKALYNRYKIQLEGNCGKKFVKTLGLNLFGGDSHQAAFRILTDFRKGKFGYVSLERPPL

SEQ ID NO: 4404 - protein, 277 aa, Citrobacter freundii
EIVAINDLLDADYMAYMLKYDSTHGRFNGTVEVKDGHLIVNGKKIRVTAERDPANLKWDEVGVDVVAEATGLFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAASYEEIKKAIKAASEGPMKGVLGYTEDDVVSTDFNGEVCTSVFDAKAGIALNDN

SEQ ID NO: 4405 - protein, 316 aa, Oryza sativa
MMSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRFAYREGIRFAKINDESEYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 4406 - protein, 262 aa, Dehalococcoides sp. BAV1
MNTACISLNDIQNNLRTCFMGREIIYLPETASTQIVAMEMARKGAGDGTVIITERQTDGHGRLKRLWVSPQGNIYMSFILRPSQTEISRLIMAASLAISFAIQDTTGIMTELKWPNDILINGKKVCGMLVENDIRDGQVNFSVVGLGINVNADMQDYPELKDIATSLINHTGKPVSREKLILSFLHEFERLYLDLNEHGKCVFEMWKKRLITLGKEVDVTSGKDIYSGIVETVASDGSLKIRLADGNLVHIVAGDVSLRHAV

SEQ ID NO: 4407 - protein, 440 aa, Xanthomonas campestris pv. vesicatoria str. 85-10
MRTAHRGHPIAHPIWHSCRPDCCIAFPMSPKKTSFPKQDIRVLLLEGISPTAVDVFRAAGYSQIELHAKSLPEDELIARISDAHIVGIRSRTQLSAEVLAHAKRLIAVGCFCIGTNQVDLDAAELAGIPVFNAPYSNTRSVAELVIAEAILLLRGIPQKNAQCHRGGWSKSAAGSHETRGKVLGIVGYGHIGTQVGVLAEALGMQVIFHDIETKLSLGNARAAIDLDELLARSDVVTLHVPETPSTKDMIGAAEIARMKPGAHLINASRGTVIDIDALDAALTSGHIGGAAVDVFPIEPKGNGDAFESPLTAHDNVILTPHVGGSTLEAQDNIGIEVAAKLVRYSDNGSTLSAVNFPEVTLPEHAESLRLLHIHRNVPGVLSQINELFSRHNVNIDGQFLRTDPKVGYVVIDVSASEELAGVLKDELGQITGTLRTRVLY

SEQ ID NO: 4408 - protein, 436 aa, Frankia sp. EAN1pec
MHNSTSIFLELGVVLFSLGVLGHAATRFGISPIPFYLLGGLAFGHGGLLPLGASEEFIEVGAEIGVVLLLLTLGLEYTADELLSGLRRNAPAGGLDLALNAAPGVAAAFLLGWGWRAAVVLGGVTAISSSGIIAKVLGDLGRLGNRETPVVLSVLVIEDLAMAIYLPILTALLAGQTVARGSLSLALALAAMVTVLFLALKHSAKVTRLVFNPTSDRNDEIILLRALGLALLVAGVAQQLQISAAVGAFLVGIALSGPIAEGAREVLAPLRDLFAAVFFVFFGLQTDPEQIPPALLTALLLAIAGVLTKTATGWWAARRAGIGTMGRFRAGTALIARGEFSIVIAGLAVAADVEPQLGPLAASYVLLMAVIGPVAARLSEPATRAVIKRRRPTPAHSLPPQPEHRDRPTPPAPPAPTRSRPHHTQPETPQNTAATP

SEQ ID NO: 4409 - protein, 400 aa, Brucella suis 1330
MAFLADALSRVKPSATIAVSQKARELKAKGKDVIVLGAGEPDFDTPENIKQAAIAAINRGETKYTPVSGIPQLRQAIVSKFKRENGLDYKPEQTIVGTGGKQILFNAFMATLNPGDEVIIPAPYWVSYPEMVAINGGTPVFIDTKIEDNFKLTAADLEKAITPKTKWLIFNSPSNPTGAAYTQAELKSLTDVLVRHPHVWILTDDMYEHLVYGDFVFTTPAQVEPSLYDRTLTMNGVSKAYAMTGWRIGYAAGPIELIKAMDMIQGQQTSGACSIAQWAAVEALNGTQDFIPANKKIFQARRDLVVSMLNQATGLQCPTPEGAFYVYPSCAGLIGKKTEAGKVIETDKDFVTELLETEGVAVVHGSAFGLGPNFRISYATSDELLEKACIRIQRFCASLR

SEQ ID NO: 4410 - protein, 478 aa, Spiroplasma citri
MDKFNINEKMKRTKIITTIGPSTHSPGAIEELFKTGMTTIRLNFSHGDHAEQGARIVWAREVSAKIGKPISVLLDTKGPEIRAGIMKGGKQEIVAGATVTIYSLPTEYQNREGTGTEITVSYDMSQDLKVGDVVLVDDGKLQLNVTGIKPGIIETKAFNHHIVKTNKRINLPGVDFTLPFLAEKDINDIKFGVEQGIDYIAASFVNTAGNIKEIRKLLKECKAEHVQIIAKIESQIGINNIDEIIAAADGIMVARGDLGLEIPYYDVPYWEKIIIRKCREAGKIVIVATQMLETMTENPSPTRAEVTDVYFATELGSDATMLSGESANGDYPFIAVHTMAMINKRAEHEFYSKLYYEKQLEDAMNSTTGPRADIAKKLANKCKDGKYEYAVVVSNTGELLKTISKFRPNVVILGVSPLPELYTAFGSWHSIFMNKVDNYEAFKTDEKAICEVAKKWGAKIGSTILFARNEEIKEITIK

SEQ ID NO: 4411 - protein, 432 aa, Anabaena variabilis ATCC 29413
MVNTTIKTTKSQEIFAAAQNLMPGGVSSPVRAFKSVGGQPIVFDHVKGAYIWDVDGNQYIDYVGTWGPAICGHAHPDVIGALHEALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFAENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVAQETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 4412 - protein, 245 aa, Streptococcus pneumoniae
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGSIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 4413 - protein, 474 aa, Microbispora rosea subsp. aerata
MSRRAKIVCTLGPATSSPERLRELIKAGMNVARFNLSHGSHELHKEVFDRVRAAADELGCAVGVLADLQGPKIRVGRFASGPVRLGYGDVFTITTEDVPGDRDIVSTTYEGLPGDVKPGDTILVDDGRLNLEVTAVDGPRVVTKVVIGGMISDNKGLNLPGVAVSAPALTEKDEEDLRWALRTGFDMIALSFVRCPDALVRAIMEEEGVRLPLLAKIEKPQAVERLEEIVDTFDGVMVARGDLGVELPLEQVPIVQRRIIDLCREKAHPVIVATQMLDSMMSSPRPTRAEASDVAYAVMDGADAVMLSGETSVGNYPVEAVSTMARIASPRRATRCRPPTPWTACPRPPAAHRPRGAEVGAIVGAKALVAYTMSGETARRLARYRSPIPLLAFTSNPLVRGQLALTWGVETFEVPFVHHTDDMVRQVEASLLSLGICEKGDKVVVVAGSPPGNHGSTNSLRVHTIGSAVAHPAV

SEQ ID NO: 4414 - protein, 239 aa, Wolinella succinogenes
MGVVEVGPGLGDLTNKLLGFWDVLAFEVDTDLRPHLEKRFQKELSIGRFEIRFGDVMEEWREKRSLIPRPYVLVSNLPYYVATAIILKALKDPMCHSLVVMVQKEVAEKFCARSGESDFSALSVITESYGESELLFEVPPQAFEPAPKVTSAVFRVVKHHGEVAEGLEELLRLAFSAPRKKVLKNLASGYETSRLKEAFGALNLKEEARAHELETSHYHRLLKILNKGGNHNGREEQIK

SEQ ID NO: 4415 - protein, 630 aa, Medicago truncatula
MSSSSCTKSILPSPIFSSSSSTSSETKSSKSSNLSFLNSNTFGIIPNNIKLSHANSQQRCFMVNSVLKTVDQTKQTNNVVSVNDENEKPTILVSEKLGEAGLQVLRQLGNVECAYDLSPEDLCKKISSCDALIVRSGTKVTRKVFEAGKGKLKVVGRAGVGIDNVDLQAATEFGCLVVNAPTANTIAAAEHGIALLAAMARNVSQADASLKAGKWLRSKYVGVSMVGKTLAIMGFGKVGSEVARRAKGLGMNVIAHDPYAPADRARAVGVELVSFDQAITTADFISLHMPLTPTTNKVFNDNTFAKMKNGVRIINVARGGVIDEDALVKALDSGIVAQAALDVFTEEPPAKDSKLVQHENVIATPHLGASTKEAQEGVAIEIAEAVVGALNGELSATAVNAPMVAPEVLSELAPYVVLAEKLGRLAVQLVSGGSGIQSVKVVYRSARGPDDLDTRLLRAMITKGIIEPISNTIVNLVNADYIAKQKGLRISEERVVVDSSPELPVESIQIQISNVESKFASAVSETGQISIDGKVKYGTPHLTCVGSFAVDVSLEGNLILCRQIDQPGMIGTVGNILGEKNVNVSFMSVGRTSRRKKALMAIGVDEEPNKEALENIGAVPAIEEFVFLKL

SEQ ID NO: 4416 - protein, 286 aa, Medicago truncatula
MKNLSMSSTSVTSQQRYEGGGVTTHDSEKRSPSTSQVLAIITGLHVGIILLALAGLYLLGTLTGVVVTTPLFVLFSPVLIPATIVTGLTVVSFFTSAIFGLTALSLFSWVMNYIRHAQGTLQEHLELEKQRMVEWWLEWCNMEVFFSSITMAAILSLSSLVPQNHCFNITKTTRRFLTNSELTNLQHLESFLYSQNTKSGSILVRVMRDNEVDPIVCLLADAFAELMLFPKCYINVVRFLMKQYLIKRRTLMPHVATLIGFYRGIIDGEEMQLAGTVEICFDKKWC

SEQ ID NO: 4417 - protein, 339 aa, Armillariella tabescens
MVKVGINGFGRIGRIVLRNALQFSEIEVVAVNDPFIDLDYMVYMFKYDSVHGRFKGTVEAKDGKLYIEGKPITVYGERDPSAIPWGSVGAEYVVESTGVFTTIDKASAHLKGGAKKVVISAPSADAPMFVVGVNLDAYDPSYKVISNASCTTNCLAPLAKVIHDKFGIVEGLMSTIHATTATQKTVDGPSNKDWRGGRGVNNNIIPSSTGAAKAVGKVIPSLNGKLTGLSFRVPTSDVSVVDLVARLQKDASYDDIKAAVKEAAASGPLKGVIEYTEDAVVSTDFVGHSASSIFDAKAGIQLNKNFVKLIAWYDNEWGYSRRVCDLLVYAAAQDKKAGL

SEQ ID NO: 4418 - protein, 232 aa, Dechloromonas aromatica RCB
MRSKPFRSITMTQDELKQAVAQAAADYVAQTAPAGSIIGVGTGSTANFFIDALAPLKDKYKGAVASSEATRKRLEGHGIAVYDLNDVEDIPVYVDGADEIDAGLNMIKGGGGALTREKIVAAVAREFVCICDGSKLVDTMGKFPLPVEVIPMARAHVARELAKLGGTPVLREGFVTDNGNIILDVKGLSITDPKGLEAQINQITGVVTNGLFAVRPANLLLLGTADGVRTIR

SEQ ID NO: 4419 - protein, 179 aa, Fritillaria agrestis
MASSATMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 4420 - protein, 417 aa, Solibacter usitatus Ellin6076
MTHTKSEELFRRAVEKIPGGVNSPVRAFRSVGGQPVFIARGQGSHLFDVDGNEYIDYVGSWGPLILGHRHPEILAALERALEIGTSFGAPTEQEIDLADAIIDAVPSVEMVRLVNSGTEATMSAIRVARGFTGRDLVVKFEGCYHGHVDSLLVKAGSGMATLGIADTQGVPKAFADTTIPLPYNSLDALEEAFRAHGDRIAAVIVEPVVGNMGCVPPLPGYLEGMRAITERYGALLIFDEVMTGFRVAFGGAQQLYGIKPDLTTLGKVIGGGLPVGAYGGRKDIMSKVAPAGPIYQAGTLSGNPLAVAAGLAMLRHLKRNPQVYTRLEECGARLAAAAPKGVTVNRVGSMFTFFFTDGPVTDWESAKRCDTSRFGEFFRGMLDRGVYLAPSQFEAAFVGAAHSDEDIAKTIEAAKTA

SEQ ID NO: 4421 - protein, 468 aa, Gibberella zeae PH-1
MATLRLASRGVKSLCMRPATFAARPFSTTCLRRNAAPVETVGTRLVPVDEDFSSAQDSYGLSKPHTPGTRKSRENSVSDRKVRHYTVNFGPQHPAAHGVLRLILELNGEEIVRADPHVGLLHRGTEKLIEYKTYLQALPYFDRLDYVSMMTNEQCFSLAVEKLLNVEIPERAKWIRTLFGEITRILNHLMSVLSHAMDVGALTPFLWGFEEREKLMEFYERVSGARLHAAYVRPGGVHQDIPVGLLDDIYQWATQFGDRIDETEEMLTDNRIWIERLRGVGVVPAAEALNLSFTGVMLRGSGVPFDVRKNQPYDAYDQVEFDVPVGTNGDCYDRYLCRMEEFRQSLRIIHQCLNKMPAGPVRVEDYKVSPPPRAAMKENMEALIHHFLLYTKGYAVPPGETYSAIEAPKGEMGVYVVSDGSERPYRCHIRAPGFAHLGGFDHVSKGHLLADAVAVIGTMDLVFGEVDR

SEQ ID NO: 4422 - protein, 316 aa, Pisum sativum
MWPFSSKKGVSGFSGSSTAEQVTHGIDATGLTAIVTGASSGIGAETTRVLALRGAHVIMGVRNMVAAKDVKDTILKDIPSAKVDAIELDLSSLDSVKKFASEFNSSGRPLNILINNAGIMACPFKLSKDNIELQFATNHIGHFLLTNLLLDTMKKTTRESKKEGRIVNVASEAHRFAYPEGIRFDKINDQSSYNNWRAYGQSKLANVLHANQLTKHLKEDGVNITANSLHPGTIVTNLFRHNSAVNGLINVIGKLVLKNVQQGAATTCYVALHPQVKGVSGEYFSDSNVYKTTPHGKDVDLAKKLWDFSINLVKQK

SEQ ID NO: 4423 - protein, 217 aa, Salmonella enterica subsp. enterica serovar Typhi
MNQTLLSSFGTPFERVELALDALREGRGVMVLDDEDRENEGDMIFPAETMTVEQMALTIRHGSGIVCLCITEDRRKQLDLPMMVENNTSAYGTGFTVTIEAAEGVTTGVSAADRVTTVRAAIKDGAKPSDLNRPGHVFPLRAQAGGVLTRGGHTEATIDLMTLAGFKPAGVLCELTNDDGTMARAPECIAFAGQHNMAVVTIEDLVAYRQAHERKAS

SEQ ID NO: 4424 - protein, 378 aa, Arabidopsis thaliana
MALSTTPSQMSVALPTRIDGSSRSMIKVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGQSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSNEIFKLLDNGAHIYFCGLKGMMPGIQDTLKRVAEERGESWEQKLTQLRKNKQWHVEVY

SEQ ID NO: 4425 - protein, 389 aa, Thermococcus kodakarensis KOD1
MALSDRLDLVNPSEIRKLFDLAAGMQDVISLGIGEPDFDTPEHIKGYAKEALDKGYTHYGPNAGLPMLREAVAKKLKEQNGIEADPKTEVMILTGANQAFLMGLATFLKDGEEVLIPSPMFVSYAPAVILAGGKPVEVPTYEENEFRLSVDDLEKHVTDKTRALIINTPSNPTGSVLTKKDIEEIADFAVEHDLMVISDEVYEHFVYDGVKNHSIASLDGMFERTITVNGFSKTFAMTGWRLGFVAAPAWVIEKMTRFQMYNSTCPVTFAQYAAAKALEDPRSWKAVEEMRKEYDRRRNLVWKRLNEMGLPTVKPKGAFYIFPRIRDTGLTDHQFSELMLKEARVAVVPGSAFGKAGEGYIRISYATAYEKLEEAMDRMEKVLKEKKLV

SEQ ID NO: 4426 - protein, 252 aa, Enterobacter cloacae
NDLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDF

SEQ ID NO: 4427 - protein, 387 aa, Candida albicans SC5314
MALPSSKKTHSEQHKQILKQLLKEDANRTCADCKVSKNPRWASWNLGCFICIRCSGIHRSMGTHISKVKSVDLDAWTDDQIENMVKWGNANVNQYWEDKLPSGYIPDQSKIENFIRTKYDLRKWTMSKNLPDPLSLNKNKAATTATIQQPKHESKSHSNTTLSNDINLLDDNSGNKSNDEEFGSFTATRSPHKRSNKLAPPPTKTVLPAAPTTSSSPQQQHQHQPLQSAQNTGGSVSSMGRPDLKKSILSLYASPSSSNSFIQQQPQQQQQPQQPLGMNSLSNSLSSLNIQGGNSTTNNNNVYRSSTTVNTQNNHTQRHPLVNSTPSLNNNQPKQNWNNEWTTDTFTSSPSIPSSSASSLAGTSNYKTTSSLNVNGLDDDLFKNVWG

SEQ ID NO: 4428 - protein, 230 aa, Triticum aestivum
  misc_feature (168)..(168): Xaa can be any naturally occurring amino acid
  misc_feature (217)..(217): Xaa can be any naturally occurring amino acid
  unsure (1)..(230): unsure at all Xaa locations
GTSKERDADMIMVEGTSQLCNDLLVDPQDVVMLVISWHMKAATMCEFTRQEFIDGLQSIGVDSIEKLREKLPSLRAEIKDDNKFREIYNFAFAWAREKVILESKLFVPIFSIVIVFIGTSVFQPVLSMKLSYNIPLILQGQKSLPLETAIGMWRLLFAERHWPLIDHXWCQFLQVRHNKAISRDTWSQLLEFVKTIDPQLSNYDEEGAAWPYLIDEXFVEYLTEDGMRSA

SEQ ID NO: 4429 - protein, 220 aa, Enterobacter cloacae
YDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEG

SEQ ID NO: 4430 - protein, 120 aa, Polaromonas sp. JS666
MISQLNPSDFAAWRDSAQAATPGAPPVVLDVREPWELQTASVREDGFRLVRIPMREIPARLAELQEAGGTDQPIACLCHHGMRSLQVANYLAQSGFTEVVNLQGGIDAWSQQVDPSVPLY

SEQ ID NO: 4431 - protein, 742 aa, Magnaporthe grisea 70-15
MPSSSRNPSTWDEYDGGISPHRTGSMSSMGGRSGRSVQFRDQENEPLLGDDQERRGSDQDTEWAGGLRRRRSSVTMRLASIADIGGVNSMRSFTRSWARAAGFAEVIPQRPSFVFAQDQAPMQPGSTEDIVYSRSGTEGGFLRPTLENSGPSLLRQHLEAGSSVGSRSAEAVFDDRDESPSRPLQPQQSGDGIDFRERELKALDSEINNGFRIGSWSGGSGSGSGSAARSQSIFAIPPHLAAPSIGGDPGPYGTSYGSIGSQQSLNYGTVRSRGREESPARGVSVAPSARGSVWASAPEEGPDAEVQPILVKEVEQDGKMVLTVEGQSTLPQTIFNSINVLIGVGLLSLPMGIKYAGWLCGIGFLTFAAGVTMYTAGLLSRCMDLDPSLITFSDLAFISFGSKARVATSILFTLELLAACVALIVLFADSLDLLFPGLLTVTQWKVTCAIILMPLHFMPLSLLSYSSILGIFSCFSIVLIVVTNGLIKPDSPGSLIEPAATYLFPANWLTLPLSFGLLMSPWGGHSVFPNIYRDMRHPYKYKQALKVTFSFTYCLDAVTAVAGILMFGDNVADAITSNILRTEGYPRALTVLMCCFIAIIPLTKVPLNARPIITTLEVVMGVYHGAGGDPHAPVQISGEPAPQTGSRKVVIMRAAIRILTILSFLVIAILFPEFDRIMAFMGSALCFSICVTLPIAFYLKLFGPEISAREKVIAWIIMLTSFVMSLVGTVWAFLPKSLISSA

SEQ ID NO: 4432 - protein, 245 aa, Streptococcus pyogenes
MNKNIKYSQNFLTSEKVLNQIIKQLNLKETDTVYEIGTGKGHLTTKLAKISKQVTSIELDSHLFNLSSEKLKLNIRVTLIHQDILQFQFPNKQRYKIVGNIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 4433 - protein, 533 aa, Coccidioides immitis RS
MVKLGKSSKRTPVRLRHKIEKASTAKQRKQRKLAKKNPQWRSKLKKDPGIPNLFPYKDKVLHEIEERKRLKEEEAMRLREEVLLRRRGVGGVDSLPDAELAHVEELDRAHDLIDDEMEDGDDPGPMAALLASAKARAIEYAEQNGDEQFHKVDEDVDKIEDESGFGGDNILSVKPSSGPVLIETSRRAFDKMFKQVIEAADVVLYVLDARDPEGTRSKEVEREIMAADGGSKRLILILNKIDLVPPSVLKGWLSHLRRSFPTLPLRASTGAPSSNSFDHKQMTVKATTEALLKALKSYVHSKQLKRSISAGVIGYPNVGKSSVINALVSRLNRGAASTCPVGAEAGITTSLREIKIDNKLKLIDSPGIVFPNSDKRKPLYKKLNEEARLILLNAIPPKQISDPIPAVALLLDRLSSSGLISKMLEFYSIPPLFPLNGEKTNDFLVQVARKRGRLGKGGVPNINSAAMTVITDWRDGRIQGWLEPPMLQVASSTDCSSTSIGWDTKTIVSEWSKEFKMEGLWGNEDYQGDEMME

SEQ ID NO: 4434 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVNKSA

SEQ ID NO: 4435 - protein, 320 aa, Triticum aestivum
MEKGMDPALLDNIIARLLEVKSLKPGKNAQLSESEIKQLCAASKEIFLAQPNLLELEAPIKICGDVHGQYSDLLRLFEYGGYPPQSNYLFLGDYVDRGKQSLETICLLLAYKVKYPENFFLLRGNHECASVNRIYGFYDECKRRFSVKLWKTFTDCFNCLPVSALIDEKILCMHGGLSPELNKLDQILNLNRPTDVPDTGLLCDLLWSDPSNEAQGWAMNDRGVSYTFGPDKVAEFLEKHDLDLICRAHQVVEDGYEFFADRQLVTIFSAPNYCGEFDNAGAMMSVDETLMCSFQILKPARKMLPGSTNNKSGFKSMRGW

SEQ ID NO: 4436 - protein, 552 aa, Aspergillus oryzae
MGSGEKPTIAPAASYSHDPESGDVKAGTMQAMVEADLLDERYMNTQRGLKNRHVQLMALGGTIGTGLFVGSGQALVIGGPLSLLLGYTFISALIYAIVTGIAEVGAYMPVHGGTMSYHGFRYVSRSLGFAMGYLYWYSLAILAAYEIVAASMVIDYWPNSVHIAVWITIMLVVIVVLNFLPVGAYGESEFWFASIKIITLVGLLILSFILFWGGGPNRQRLGFHYWKDPGVMNTYLVSGDRGRFVGLLQCIVKSAIAFLFAPELVVISGGEMESPRRNIPKVARRYIYRLVIFYFLGSLAIGVICPSNAKELVHGDGHDASSSPFVVAISNAGIPVLNHIVNAAILTSAWSAGNSFLYMSSRSLYGLAVSGNAPSIFKACNRWGVPYYAVGISSLFLFLAYLSVGSGSNTVFNWLINFTNTSGFISWTCCGIIYIRWNKAIQVQGIEKPYYSRMQPYGMYIGMGGAIFLTLINGFTCFFPSEWSASNFFTAYIGIPAFLVLYAGHRILFWQDPWAWRPEEVDLQTGLQEILAAEKPPRPRDTWGRKLMALIE

SEQ ID NO: 4437 - protein, 262 aa, Neorickettsia sennetsu str. Miyayama
MQRYNKLLGQHFIYDREVLDKIIDAATSVKGKHIFEIGAGSGTLSAAILLREPASLISVEKDKRFSESLSSLMAQYQNYKYTIGDALLIRLSSLFKQEKVTIIANLPYNIATHLLLGWMNELEQVREMVLMFQKEVADRICAQPKSKNYGALSVLVQLECKAESQFALAPEVFTPPPRVTSTVLKLTPLKNKWPRNKPVLEKILTEGFSQRRKMIKKSLSRIFKDSEALHSALAQVGASPTMRIEELNPEQLCRLSCIAEMD

SEQ ID NO: 4438 - protein, 443 aa, Thermococcus kodakarensis KOD1
MTPEEVVERYSQVISRASHVTYVPIVPSRAENALVWDIEGRAYIDFLADAAVQNVGHNNPRVVEAVKKTADRLLHFTFIYGFPVEPLLLAEKLREIAPLEGAKVAFGLSGSDANDGAIKFARAYTGRRSIIGYLRSYYGSTYGAMSVTGLDFEVRSKVGQLSDVHFIPFPNCYRCPFGKEPGKCRMECVSFLKEKFEGEVHAEGTAALIAEAIQGDAGMVVPPENYFKKLKRILDEHGILLVVDEVQSGLGRTGKWFAIEHFGVEPEIITLAKPLGGGLPISAIVGRGEIMDSLPPLGHAFTMSGNPVASAAALAVIEEIEEKELLKRAQILGERAKRRLEKMKKKHELIGDVRGLGLMLGVDLVKDRETKERAYDEAKKVVWRAYELGLIVAFLQGNVLRIEPPLTIEEEVLDEGLDKLEEAIEDVEEGRVPDEVIEKVQGW

SEQ ID NO: 4439 - protein, 137 aa, Zea mays
MGCIGLINLTGTNIYRPVLTRTSNKPYSTRGPSMAAIRAESVATEILGIFVEKNPPESKLTQLGVRSWPKWGCPPSKFPWTYDAKETCFLLEGKVKVYPDGSDEGVEIEAGDFVVFPKGMSCTWDVSVAVDKHYQFE

SEQ ID NO: 4440 - protein, 277 aa, Escherichia coli
EIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDN

SEQ ID NO: 4441 - protein, 359 aa, Dehalococcoides sp. BAV1
MARTVIPFGPQHPVFPEPVQLKLECEDETVVGVTPVIGYVHRGVEKACELNTLRQNIFLVERICGICSIQHALCYCQGIEELANIEIPQRAHYLRTAWAELSRLHSHSLWLGLLSDALGFESLFMQIWRAREIILDILEMTAGHRVITSACVVGGVRRDIDAEMLKKTEAMLGDFRKMMDKTILPTLLNDPTLKKRTVGKGILSYDQAVTLGACGPTMRGSGVPSDVRSTGYAAFKELGFEPVVETAGDSYARTLVRTRELYQSIDLTLAALHQMPAGEIMVKADAYPEGEIFTRVEQPRGELTYYIKANGTNHLDRCKIRTPTFANIPTLLVMLPGCELADVPVITLSIDPCISCTER

SEQ ID NO: 4442 - protein, 220 aa, Escherichia coli
YDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEG

SEQ ID NO: 4443 - protein, 128 aa, Brassica napus
MVSKESCRNEIRAAIGQLSERCLHSAAKWAGEQLVGIEQDPSNFTPSNTRFQRGSSSIRRRFSTNESISTPQPSVGFSQAATPLPEEDDVIDGDLYHLAKSYFNCREYRRASHVLRDQMSKKSVFLRC

SEQ ID NO: 4444 - protein, 245 aa, Streptococcus hyointestinalis
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNSYLLFNGRK

SEQ ID NO: 4445 - protein, 436 aa, Propionibacterium acnes KPA171202
MTSNAELFSAAQAVIPGGVDSPVRAYGSVGGVPRFIEKAQGPWIWDAEGTRYVDLVCTWGPALLGHARPEVVSAVQVAASKGLSFGAPTRTETELADAIIERMAPVEKVRFVSTGTEATMTAVRLARGATGRDVIVKFAGNYHGHSDVLLAAAGSGVATAGLPGSAGVPAASTADTIVVDYNDVAALDAVFSERGDQIAAVIVESCPANMGVVPPEPGFNAAIRRLTTEHGALMITDEVLTGFRCSPSGFWGLQQQAGEDFAPDIFTFGKVVGGGMPLAALGGHADVMDLLAPTGPVYQAGTLSGNPLATVAGVKTLQLADAEVYQRLDVRSEKWRNELESALDAAGVTYRLQNAGNLFSVFLGVDSPVRNYDNAKSQNAEAYTAFFHAMLDAGVNLPPSCFEAWFLSDAHDDEAFEVFRAALPRAAQAAAQVISA

SEQ ID NO: 4446 - protein, 478 aa, Mycobacterium tuberculosis CDC1551
MTEKTPDDVFKLAKDEKVEYVDVRFCDLPGIMQHFTIPASAFDKSVFDDGLAFDGSSIRGFQSIHESDMLLLPDPETARIDPFRAAKTLNINFFVHDPFTLEPYSRDPRNIARKAENYLISTGIADTAYFGAEAEFYIFDSVSFDSRANGSFYEVDAISGWWNTGAATEADGSPNRGYKVRHKGGYFPVAPNDQYVDLRDKMLTNLINSGFILEKGHHEVGSGGQAEINYQFNSLLHAADDMQLYKYIIKNTAWQNGKTVTFMPKPLFGDNGSGMHCHQSLWKDGAPLMYDETGYAGLSDTARHYIGGLLHHAPSLLAFTNPTVNSYKRLVPGYEAPINLVYSQRNRSACVRIPITGSNPKAKRLEFRSPDSSGNPYLAFSAMLMAGLDGIKNKIEPQAPVDKDLYELPPEEAASIPQTPTQLSDVIDRLEADHEYLTEGGVFTNDLIETWISFKRENEIEPVNIRPHPYEFALYYDV

SEQ ID NO: 4447 - protein, 275 aa, Escherichia coli K12
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 4448 - protein, 251 aa, Fusobacterium nucleatum subsp. nucleatum ATCC 25586
MRRLVIAGNWKMYKNNKEAVETLTQLKDLTRDVKNVDIVIGAPFTCLSDAVKIVEGSNVKIAAENVYPKIEGAYTGEVSPKMLKDIGVTYVILGHSERREYFKESDEFINQKVKAVLEIGMKPILCIGEKLEDREGGKTLEVLAKQIKEGLVDLSKEDAEKTIVAYEPVWAIGTGKTATPEMAQETHKEIRNVLAEMFGKDVADKMIIQYGGSMKPENAKDLLSQEDIDGGLVGGASLKADSFFEIIKAGN

SEQ ID NO: 4449 - protein, 227 aa, Triticum aestivum
  misc_feature (178)..(178): Xaa can be any naturally occurring amino acid
  unsure (1)..(227): unsure at all Xaa locations
NKFVQKSRPVPVRNSRDIVDPRVRKDICSAPAQLPVCKSLRSLTIKQCPGFTDASLAVVGMICPHLENLDLSGLGAVTDDGLLPLIRSSESGLVHVDLNGCENLTDAAISALVKAHGTSLAHLSLEGCSKISDASLFAISESCSELAELDLSNCMVSDYGVAVLASAERLKLRVLSLXGCLKVTPKSVPFLGSMPASLEGLNLQFNFIGNHNIASLEKQLWWCDILA

SEQ ID NO: 4450 - protein, 474 aa, Glycine max
MGAYCNGNVSLSPSYDVASAQDPRFCKHVHDNVHGNIYLDSLSLKFIDTEQFQRLRELKQLGFTNMVYPGAVHSRFEHSLGVYWLASQCVEKLKTYQGLELGIDRFDIQTVKLAGLLHDVGHGPFSHLFEREFLPQVISGADWSHEQMSVGMVDYICDEHHIDGYPQMIRRVKEMILASSEYAPSMSSSEKSFLYDIVANGRNGIDVDKFDYLLRDCRACGLGCNFEFQRLLETMRVLDDEICYRAKDYLTIHKMFATRADLYRTVYTHPKVKAIELMVVDALVHANSYLGISSNIHDPSEYWKLDDTIIKTIETTPNQELKEARELILRIRRRNLYQFCNEYPVPKDMLDNYKKVTAQDIVCSQKSGGVTLKEEDVAVCNVKIDLTRGKHNPLESIHFFKDYESDEKFTIPDDRVSHLLPTSYQDMIVKVYAKKPELVEAISEAFENFQLKTYGIKTQAHSTPQKKRRYNSFI

SEQ ID NO: 4451 - protein, 232 aa, Zea mays
  misc_feature (26)..(26): Xaa can be any naturally occurring amino acid
  misc_feature (88)..(88): Xaa can be any naturally occurring amino acid
  unsure (1)..(232): unsure at all Xaa locations
MYKLGRGNRDKVQQFMTITGASEKVXLQALKASDWHLEGAFDFFYSQPQVSVVNTRHLEDIFNRYKEPDADMIMVEGISQFCNDLQVXPQDIVMEFIGGLQSIGVDSIEKFRGKLPSLRAELKDDNKFRDIYNFAFTWAREKGQKSLSLETAIGMWQLLFAERNWPLLEHWCQFLQVRHNKAISRDTWAQLLEFVKTIDPQLSNYDDEGAWPYLIDEFVEYLTENGLVQRKR

SEQ ID NO: 4452 - protein, 341 aa, Mesorhizobium sp. BNC1
MSERLEDIAARMVADGKGILAADESSGTIKKRFDSIGLESTADNRRDYREMLFRADEAMRNSISGVILYDETLRQQAKDGTPLVEIISRSGAVPGIKVDAGAKPLAGFPGETITEGLDGLRERLKEYYELGARFAKWRGVIAVSDDLPTWGSVKQNAQALARYAALCQEAGIVPIVEPEVLMDGTPATHSIDRCYEVTEWVLKTVFTELFDARVALEGMVLKPNMVIDGKNARKASREEVAEKTVRCLKATVPAAVPGIAFLSGGQSDEEATAHLSLMNASHSMPWKLTFSYGRALQAAALKAWGGKSENVAAGQRAFAHRARMNALAARGDWKQELEVAA

SEQ ID NO: 4453 - protein, 220 aa, Hafnia alvei
YDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLAKVLNDKFGIVEALMTTVHATTATQKTVDGPSHKDWRGGRGASQNIIPSSTGAAKAVGKVIPELNGKLTGMAFRVPTPNVSVVDLTARLEKPASYKDICAAMKAASEN

SEQ ID NO: 4454 - protein, 188 aa, Physcomitrella patens
  misc_feature (168)..(168): Xaa can be any naturally occurring amino acid
  unsure (1)..(188): unsure at all Xaa locations
MGNKVDKLAGVQELSVYEINERDRGSPVILPFGGKKDENGAHANSLGDLVPFSNKVYDGSLQRRLGITAGICTLISHNAEKKGDRYEAQYSFYFGDYGHISVQGPYITYEDTELVVTGGTGIFAGCHGVAKLHQIIFPVKLFYTFYLQGIKKLPEELCASVVPPSPSXEPSEQAKKCHPSSVAPNFTN

SEQ ID NO: 4455 - protein, 220 aa, Hafnia alvei
YDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLVKVLNDKFGIVEALMTTVHATTATQKTVDGPSHKDWRGGRGASQNIIPSSTGAAKAVGKVIPELNGKLTGMAFRVPTPNVSVVDLTARLEKPASYKDICAAMKAASEN

SEQ ID NO: 4456 - protein, 140 aa, Desulfitobacterium hafniense DCB-2
MTKILVPVDGSPNSDKAIHYALTLARCKDDLLIFLNVQPNYNTPNIKRFATQEQIKVMQEETSKEVLDHSLEIAKDSIAPIRTLLRTGDPGREICKEAQESVVDSIVMGYRGLGAVKRAILGSVATHVLHETSCPVTIVP

SEQ ID NO: 4457 - protein, 315 aa, Oryza sativa (japonica cultivar-group)
VGKRLRYLTKHPHSDIQSMATDLLGYWKKVVIEEGKKNGTTENVGSTNSAARAEKAQPMKVDKSSASGSVKPEKREVNVRGQKPESIKVEKITNNDSKNQQVKVERAPKEATRTPDTKKPSSVPNGPPKLTSLVKCNDPTRDKIRELLADAFSRVHGETSKDDREEVRNILDEVDARDPFRVAVTVESALFERLGRSTGAHKAKYRSIMFNLRADNNTDFRRRVLLGQVRPERLVDISPEEMASDARKLENKQIKEKALFDCERGGAPKATTDQFKCGRCGQRKTTYYQLQTRSADEPMTTFVTCVNCNNHWKFC

SEQ ID NO: 4458 - protein, 446 aa, Mycobacterium tuberculosis CDC1551
MDRQKEFVLRTLEERDIRFVRLWFTDVLGFLKSVAIAPAELEGAFEEGIGFDGSSIEGFARVSESDTVAHPDPSTFQVLPWATSSGHHHSARMFCDITMPDGSPSWADPRHVLRRQLTKAGELGFSCYVHPEIEFFLLKPGPEDGSVPVPVDNAGYFDQAVHDSALNFRRHAIDALEFMGISVEFSHHEGAPGQQEIDLRFADALSMADNVMTFRYVIKEVALEEGARASFMPKPFGQHPGSAMHTHMSLFEGDVNAFHSADDPLQLSEVGKSFIAGILEHACEISAVTNQWVNSYKRLVQGGEAPTAASWGAANRSALVRVPMYTPHKTSSRRVEVRSPDSACNPYLTFAVLLAAGLRGVEKGYVLGPQAEDNVWDLTPEERRAMGYRELPSSLDSALRAMEASELVAEALGEHVFDFFLRNKRTEWANYRSHVTPYELRTYLSL

SEQ ID NO: 4459 - protein, 502 aa, Pyrococcus abyssi GE5
MYRQAKWDEPLIFELSRPGRVGYTLPKPIEDVDVEIPEKLKRKSPLNLPEVSEPEVVKHYTRLSEMNYGVDSGIYPLGSCTMKYNPKINEELAGHPKVAYIHPYQDERTVQGALRIMWELEQWLKEITGMDRFTLQPAAGANGEFTGVMIIKAYHLDRGETQRNEMLVPDSAHGTNPASAAMAGFKVIEIPSNENGTVDLEALENAVSERTAGLMLTNPNTLGIFEDEIEEIAKIVHKAGGLLYYDGANLNGILGKVRPGDMGFDIVHLNLHKTFSTPHGGGGPGAGPVGVKEFLKDYLPVPLVSYDEENDRYYLDYDVPKSIGKVKELFGNFAVLVRALTYLKVMGKDGLREVSEVAVLNANYLARKLKGTRGYELPHKELRKHEVVFSAEPMKRETGVRTLDVAKRLLDFGMHAPTIYFPLIVHEALMIEPTETVSKEELDAYVEAMKKISEEAYTNPEVVKSAPHNTAVRRVDDVLASKKPIITWKMYKELKEKGEVDY

SEQ ID NO: 4460 - protein, 449 aa, Pyrococcus abyssi GE5
MAKHYIPNSAHKEEMLKEIGLSSIDELFADIPGKFIRDELNLPEGKSEYEVFLEMNEILGKNKTVLEMPTFLGAGTYFHYIPAHVKYLIERSEFLTAYTPYQPEISQGMLQALFEYQSLIAELVGLPVVNASMYDWGTAMAEAALMTVRLHRGKRKKFIVPRHTHPERLQVLETYAKGPGVEIETVKWNERGQVDIEDLKEKVKDAAGVYVEIPNFFGLLEEEVREIGEIAHEAGAYFVVGVDPTILGIVEAPGELGADIVVGEASYFGNPMNFGGPRAGIFAVRNDMKLIRQMPGRLIGMTKDAEGKRAFVMTLQTREQHIRRAKATSNICSNEALVAVAAAIHIASLGPRGIRELGEVILKNTAYLKKRLSEVAEIPFDGVNFKDVLVRFEKPYKEIHEELLKRNIHGGYYVGKHFPELGESALFAATETTRKEWVDALISALREVI

SEQ ID NO: 4461 - protein, 281 aa, Mycobacterium tuberculosis CDC1551
MSEQTIYGANTPGGSGPRTKIRTHHLQRWKADGHKWAMLTAYDYSTARIFDEAGIPVLLVGDSAANVVYGYDTTVPISIDELIPLVRGVVRGAPHALVVADLPFGSYEAGPTAALAAATRFLKDGGAHAVKLEGGERVAEQIACLTAAGIPVMAHIGFTPQSVNTLGGFRVQGRGDAAEQTIADAIAVAEAGAFAVVMEMVPAELATQITGKLTIPTVGIGAGPNCDGQVLVWQDMAGFSGAKTARFVKRYADVGGELRRAAMQYAQEVAGGVFPADEHSF

SEQ ID NO: 4462 - protein, 607 aa, Magnaporthe grisea 70-15
MSMHPGYRGGAAPPQPNGPSRLNELLEGIRAEFEASARAAENYEHQINTQINEMHMVREKVYQMEQTHVQLKAKYEEELAHLRRQLEGRGGGMPQGGIGGPSQHAGPAQPPNIGVGNNVFGAIMSGQTGQPLAPPPPPPQEQQPPQHQMAQPPPGLSGPPPPPPPPSQQPPFQQYPQPPGPGNFPSQPPQSTASPGPGKRGAIGRPPAGGPATPQINNPMPYPGPGQSPQVPNHPTPDHPRGLAQHQPPQPPPGNALGDLDIERIPSHFKKSRDDWWAIFNQAVPRVLDVDLVHTLQHESVVCCVRFSADGKYVATGCNRSAQIFDVNTGEKVCVLQDDNADTTGDLYIRSVCFSPDGKYLATGAEDKQIRVWDITTRTIRIQFAGHEQDIYSLDFARDGRTIASGSGDRTVRLWDIENGTALTVFTIEDGVTTVAISPDTKYVAAGSLDKSVRVWDLTQGCPVERLEGPDGHKDSVYSVAFSPNGRDLVTGSLDKTIKLWELATPRGNMQNQGSKGGRCVKTFEGHRDFVLSVALTPDNQWVMSGSKDRGVQFWDPRTGSTQLMLQGHKNSVISVAPSPTGGFFATGSGDMRARIWSYTRMDNRMA

SEQ ID NO: 4463 - protein, 656 aa, Thermococcus kodakarensis KOD1
MYKVFGFEENFIHGRVARVEFSLPDAGRWDYAYLLGNFNAFNEGSFRMKHEDKRWIIEIKLPEGLWRYAFSAGGEFLLDPENPEKELYRRPSYKFEREVSLAKIAGNDMVFHRPALLYLYSFGDRTHVLLRSKKGKVDAAYLVTDDTHVKMRKKADGEVFEYYEAVLQETEKLRYSFEVFLKEGKSLTLGPFEAAPFRLDAPSWILDRVFYQIMPDRFAKGRDHEPPFLSWEYYGGDLWGIVEKIDHLEELGVNALYLTPIFESMTYHGYDITDYLRVAERLGGEEAFRELVKALKSRDIKLVLDGVFHHTSFFHPFFRDVVERGEESEYADFYRVKGFPVVSEEFIRVLKSDLPPMEKYQTLKKMGWNYESFFSVWVMPRLNHDSPKVREFVARVMNYWLEKGADGWRLDVAHGVPPGFWREVREGLPDDAYLFGEVMDDPRLYLFGVFHGVMNYPLYDLLLRFFAFGEIGATEFINGIELLSAHLGPAEYFTYNFLDNHDTERFIDLAGKERYLCALTFLMTYKGIPAIFYGDEIGLRGSGEGMSAGRTPMSWDEEKWDFQILRQTMKLIELRRSLKSLQVGSFRVIGAGEKWFVYERKAGSERVLVGINCSWNDVETPVPSNGSNEQIKIPAFSSIIRVKDSMNVHIGSDLQE

SEQ ID NO: 4464 - protein, 485 aa, Triticum aestivum
  misc_feature (420)..(420): Xaa can be any naturally occurring amino acid
  unsure (1)..(485): unsure at all Xaa locations
AAVAMAMALLLLATAASAAAAGASWSPRPEGDLVTGLPGQPEVGFKHYAGYVDVGTGGDRALFYWFFEAEKEPEKKPLALRLNGGPGCSSIAYGAAQELGPFLVRSYGANLTRNAYAWNKAVNLLFLEAPVGVGFSYTNKTADLGRLGDRVTAQDSHTFLLNWLAKFPEFKGRDFYIAGESYAGHYVPQLADLIYEGNKAAGRGRIINLKGFIIGNAVLNDETDQLGMVEYAWSHAIISDELHSAVTRECDYFREEADGGKPGKGCSSAVRAFMGAFDDIDIYSIYTPTCLSPSAGPGSTAPRPSRLVAAPRLFSQHEAWHMMRRAPAGYDPCTEAYVSRYFNRQDVQRALHANRTGLKYPYSPCSAVISKWNDSPATVLPILKKLMAAGLRVWVYSGDTDGRVPVTSTRYSVNAMKLRXRARSGWRAWFYRQQVAGWAVEYEEGLTLVTVRGAGHQVPLFAPDRSLAMLYHFLRGQPLPAAAPR

SEQ ID NO: 4465 - protein, 475 aa, Bacillus subtilis subsp. subtilis str. 168
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 4466 - protein, 219 aa, Edwardsiella ictaluri
MTQDELKKAVGWAALKYVRPGTIVGVGTGSTASHFIDALATMKGQIEGAVSSSDASTARLKSLGIPVFDLNEVDSLDIYVDGADEINGAMQMIKGGGAALTREKIVAAVAKKFVCIVDASKQVDILGSFPLPVEVIPMARAYVARELVKLGGQPVYRQGVLTDNGNVILDVHNLQIMEPCKLENAINAIAGVVTVGLFANRGADVALVGCADGVKTLTL

SEQ ID NO: 4467 - protein, 401 aa, Haemophilus ducreyi 35000HP
MFQFSTVDEALAAIAAGKIILVSDDENRENEGDFICALEFATPENINFMATYGKGLICTPISQALADKLSFHPMVTNNTDNHETAFTVSVDHINTGTGISAFERSLTALKMLEQNAQAADFRRPGHMFPLIAKEGGVLVRNGHTEATVDLARLAGLKPAGLCCEIMADDGTMMTMPQLQALAVKHNMPFITIAQLQEYRRKYDSLVKLVSVVKMPTKYGEFMAHSFVEVISGKEHIALVKGEIGDGQAVLARIHSECLTGDAFGSQRCDCGQQFAAAMTQIEKEGRGVVLYLRQEGRGIGLINKLRAYELQDKGMDTVEANLALGFKEDEREYYIGAQIFQALGVKSTRLLTNNPAKISGLKQQGLNIIAREPIIVEPNQNDIDYLKVKQIKMGHMFNFEQ

SEQ ID NO: 4468 - protein, 443 aa, Nocardia farcinica IFM 10152
MVAHETALALIQLGAVFFGLGLLGRVAARIGMSPIPLYLLGGLAFGTGGLVELHQVDEFIHLASEIGVVLLLLLLGLEYSASELVTGLRKSWAAGVLDFALNATPGVLVAFALGWGFTGAIAMAGVTYISSSGIVAKVLNDLGRLGNRETPVILSILVFEDLVMAGYLPVLTAVLAGVGFVAGLQTLGIALAAVTVVLVVALRYGRFVSLIVDSKDREIFLLKLLGSALLVAGIASAVQVSAAVGAFLLGIAISGSTAHNATKLLEPLRDLFAALFFVLFGLSTDPATIPPVLGWALLLAVVTTATKVATGWWAAQRAGASRLGRARAGTALVAHGEFSIVIAGLAVTAGAVPAEFAALATTYVLLMAVAGPVAARVVEPVMGLLARTSAKPAPASRSRLDEPDADGVAGQRQPVAQPQLLEDVRPVPVDRLDTDDESVGDPA

SEQ ID NO: 4469 - protein, 354 aa, Burkholderia sp. 383
MKAAVWHGRHDIRVEQVPVPERPPAGWVTIRVHWCGICGSDLHEYVAGPVFIPVDAPHPLTGLKGQCILGHEFSGEIAELGAGVTGFAVGDRVTADACQHCGTCWYCKHGLYNICENLAFTGLMNNGAFAEYVNVPAELLYKLPDDFPTEAGALIEPLAVGLHAVKKAGNIVGQTVVVVGAGTIGLCTIMCAKAAGAGRVIALEMSAARKQKALEVGASVVIDPKTSDAIAEVKALTGGYGADVSFECIGHTTTAKLAIDVIRKAGKSVMVGIFEEPAPFNFFDIVSTEKEVIGSLAYNGEFADVIRFIADGRIDVQPLITGRIALGDIVSHGFEELVNHKERNVKIIVQPALA

SEQ ID NO: 4470 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKVQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 4471 - protein, 749 aa, Candida albicans SC5314
MSESSSETEISKIPLVMTKEQLDNIEHKILYRQVKSVKAGDIERFKIHFTPHAEGDEVIIPPTLWVKIRNTEPVSKRAIYLAGPYILYVDCRSSDYDPNVKYFVTADQPVFEPQLLAGQSFYIQLSCHTLKKDYSWIVDVVPQIIFNNTISIDFEIMIGTSKQILHEASFPEKSVPLSDKIGCFNELLHVYNWDTLDLWNLPVMSPDKPKHLVILTHGLHSNASSDMLYLKEQIDRIAELRNDNEEIVVKGYFGNIGKTERGIKYLGSRVAEFIIDLVTENESFNNGKVKKISFVGHSLGGCVQTFAIAYLKVNFPWFFDVIKPINFITLASPLLGVVNENPLVVKWVLSAGFVGNTGQELGLKYLENGAKPLLLLLPAGPTHEVLKKFIRRTVYANAINDGIVPLRTSSLMFLDYKGLAEIINSEELAQSDETGKIPESVESANKFSAVQTFLSYLMPQKQTSQEYRRFQTQDDKVVEDHKSDGKAIPNSTFLDSAASLILPPLPSMKYIVDPSTRENVIIHDKVYYEKDLPERDLDVELDSFEWLEEEIAREYHKNMGWRKVVVKIKPDAHNNIIVRRRFANAYGWPVIQHLVENHFGPNRTVDSKMIDSAIVDSVSTDSLDEENGLTRIISRDLISRQNKEIDDNVSEEQRPEEYPHEWINSEHNGDSVFAVGVTGLLGEVADMVGGFRDQITKYSLNPPSLPIIGEIPFPAALMAPTDTNNGNTKSEEELNKDLKLSNGIMNDFI

SEQ ID NO: 4472 - protein, 385 aa, Thermus thermophilus
MRGLSRRVQAMKPDAPVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 4473 - protein, 139 aa, Neorickettsia sennetsu str. Miyayama
MKRTLSILKPDVISRNITGKVNAYIEAAGLQIIAMKQLHLTRIQAEAFYVVHKDRFFFNDLVNFMTSAPVIVQVLSGDDAVHRYRKLMGDTDPKKAAKGTIRGDFAESIDANCVHGSDSEENAKNEIAFFFSRCEIFDR

SEQ ID NO: 4474 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAETLEYGMVGINTGRMSSEAAPFGGMKQSGIGREGSRHGLEDYLEMKYLCMGGL

SEQ ID NO: 4475 - protein, 639 aa, Sulfolobus solfataricus P2
MVNRLASLDRFNRISLIYSELKELGITRIEYEGPTIAVYVKKPALITEKGEVIKKIAKDIKKRIVIKADPSVRKDKKEAVEIIKNLVPAEAEIVDIKFDDDLGEVLIKAKKPGLVIGKGGSLQQRIFAETFWKAEIVREPPIKSRTYDSILEHIYNETEYRAKILKVFGERIHRETIFQDKYVRITALGGFLEVGRSAVLVETPESKVLLDVGLNPSANMFGEKLFPKLDIDQLKMEELDAVVITHAHLDHCGMVPFLFKYGYEGPVYTTVPTRDIMALMQLDSLDVAEKEGKPIPYSAKEVRKELLHTITLDYGEVTDIAPDIRLTFYNAGHILGSGMAHLHIGDGKHNIVYTGDFKYAKTKLLDKANTEFPRVDTLIMETTYGAQDQPNREESELELLEIINKTLNKGGKVLIPVLAVGRGQEIMLIINDFMKKKLIPEVPVYVTGLVDEVTAIHNAYPEWLGREVREEILYKDENPFTSEHFKRIEGYKEDIAKGEPSIILATSGMLNGGPAVEFFKTMAPDPKNAIIFVSYQAEGTLGRKVRDGAKEVQILDRDGRVESIQINMEVEAVEGFSGHSDKRQLLNFLRNIEPKPKNVILNHGEASSIRAFANYIREDRLGYKPNIYTPAILDSLRVA

SEQ ID NO: 4476 - protein, 587 aa, Pseudomonas syringae pv. syringae B728a
MHAINFIQDLAVIMLVAGVVTILFHRLRQPVVLGYIVAGFIIGPHTPPFSLIHDEETIKILAELGVIFLMFCLGLEFSLRKLFKVGATAFIAAFLEIALMIWIGYEIGQFFGWKTMDSLFLGAILAISSTTIIVKALNDLKMKNQRFAQLIFGVLIVEDILGIGIIALLSGIAVSGSVSSGEVFSTVGKLSLFMIVALVIGILVVPRLLSYVARFESNEMLLITVLGLCFGFCLLVVKLEYSMVLGAFLIGAIMAESRELLKIERLIEPVRDMFSAIFFVAIGLLIDPGILLQYAWPIAVITVAVVLGKMLSCGLGAFIAGNDGRTSLRVGMGLSQIGEFSFIIAALGMTLQVTSDFLYPVAVAVSAITTLLTPYLIRGADPLSLKLAAIMPRRVARVFGMYGEWLRSIQPQGQSAVLAGMIRRILLQVGVNLALVMAIFFSGGYFAERLGGYMSEWVGDVSQQKAWICGAALLLSLPFLIAAYRKLKALSMLLAEMGVKPEMAGRHTVRVRKVVAEVIPLLSLVVIFVMLAALSASILPANELLLVVALVAALVAALLWRWLIRVHTRMQIALLETLGNHPESPGH

SEQ ID NO: 4477 - protein, 277 aa, Klebsiella oxytoca
EIVAINDLLDADYMAYMLKYDSTHGRFNGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 4478 - protein, 423 aa, Pyrobaculum aerophilum str. IM2
MLFERAKSVFPGGVNSPARALKHLPSPLVAKAASGAYLYTDRGKLVDYCMAFGAIILGHAHPRVKKAVEEQLEKGWIYALLTEQEVEFAERIRRHMPSVEKMRIVNTGTEATMSAIRAARGYTKRDVIIKFEGNFHGSHDYVLVKAGSGAATWGIPTSAGIPQEVARLTVVVPYNDIDAFIKAVREVGDRLAAVIVEPVAGNYGLIIPDVEFLKALREETQRAGALLIFDEVITGFRVGLGGAQGLFGIRPDLTTLGKVVGGGFPIGIFGGRGEVMDLVAPSGPVYNAGTYNAHPVSIAAGLAVLKELETGEPYRIANEAAERLAKGVEDVAGRLGFDVVVKRMASMFQFYFKKGDVKTPQDVRESNEKMYLKLHEIALKHGVYLTPSQYEVNFTSAAHGREVVEETLAALEKSFQELQREIG

SEQ ID NO: 4479 - protein, 173 aa, Glycine max
ARGLEEEKSFQFHDVFNLDNENRAEDMPTLIDRKDNVFIISNPKSKYPVLQLDLRLISDLAVVIGSATCGGIAFACAGQPVMTGYLLARSIIGPGGLSFVSAMVQVETVAQFGVIFLLFALGLEFSTTKLLVARAVAILGGLLQIFLFMCLCGITASLCGGKSSEGIFVGAFL

SEQ ID NO: 4480 - protein, 315 aa, Magnaporthe grisea 70-15
MTAFGSETTAEEVVSAFSSNVKGRTFLITGASANGLGAYMATSLARASPQALILIARSEVKVAPVIEEIASIDPAIRAIFVPVDLTDQESVRAAAATILDDRDMTKIDVVINCAGIMYVEEFTTDAKGNELQFSANHVGHFLLTNLLMPKILAAGEGARIVNITSHGHQLSDVWWSDPTFNKGKDYHGWSGYGQSKTANILFSVELARRLKDRGVVSLAGTGLFQHVPMERLDEGDMISRKNTGLPFGLDLPWKTSSQGSSSGLAAALDPELAAHSGSYIQNCQVGTPRQYALDGEKAKKLWIMTEELVGQKFDL

SEQ ID NO: 4481 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNNIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 4482 - protein, 467 aa, Pseudomonas aeruginosa PAO1
MTHDTGLRRGLNARHIRFMALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLGGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIALLVIAYRRWVRPKGDAAHGVLQAQGGL

SEQ ID NO: 4483 - protein, 340 aa, Xanthomonas axonopodis pv. citri str. 306
MKALVKREANKGIWLEQVPVPTPGPNEVLIKLEKTAICGTDLHIYLWDEWSQRTIEPGLTIGHEFVGRVAELGSAVTGYQIGQRVSAEGHIVCGHCRNCRGGRPHLCPNTVGIGVNVNGAFAEYMVMPASNLWPIPDQIPSELAAFFDPYGNAAHCALEFDVIGEDVLITGAGPIGIIAAGICKHIGARNVVVTDVNDFRLKLAADMGATRVVNVSKTSLKDVMADLHMEGFDVGLEMSGNSRAFNDMLDCMYHGGKIAMLGIMPRGAGCDWDKIIFKGLTVQGIYGRKMYETWYKMTQLVLSGFPLHKVLTHQLPIDDFQKGFDLMEEGKAGKVVLSWN

SEQ ID NO: 4484 - protein, 335 aa, Chlamydophila caviae GPIC
MKVVINGFGRIGRLVLRQVLKRNSSVDVVAVNDLVPGEALTYLFKYDSTHGRFPADVSYDNGYLVVDGRRIQLLDQRDVQKLPWKDLGVDVVIESTGLFTKKEDAAKHLDSGAKRVLITAPAKGDVPTFVMGVNENAFDPEKDTIISNASCTTNCLAPLAKVLLDNFGIEEGLMTTVHAATATQSVVDGPSKKDWRGGRGAFQNIVPASTGAAKAVALCLPELKNKLTGMAFRVPVADVSVVDLTVRLQKSTTYEEICKAIKNASETNLRGILGYTDQEVVSSDFIGCEYSSIFDAGAGIALTDRFFKLVAWYDNEIGYATRIVDLLEYVAKNSK

SEQ ID NO: 4485 - protein, 385 aa, Thermus aquaticus
MRGLSRRVQAMKPDAVVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 4486 - protein, 754 aa, Streptococcus thermophilus CNRZ1066
MSTFTNYVEAKNKNLKELSNEEIYYLLLEFVKEAAASKPKNDSKRKVYYISAEFLIGKLLSNNLINLGIYKDVKAELAAAGKSISEIEDIEPEPSLGNGGLGRLAACFIDSMSTLGINGEGVGLKYHCGLFKQVFKDNKQYAEPDYWIEDQSWLVPTDISYDVPFKNFTLKSRLDRLDVLGYKKETKNYLNLFDINGLDYGLIEKGITFDQDEIQKNLTLFLYPDDSTRKGELLRIYQQYFMVSNAAQLLIDEAIERGSNLHDLPDYAFVQINDTHPSMVIPELIRLLTEKHGFEFDEAVAIVSKMVGYTNHTILAEALEKWPLDYLEEVVPHLVVIIKKLDAIVRGKFDDPRVQIIDEHNRVHMARMDIHFSTSVNGVAKLHTEILKTSELKPFYDLYPERFNNKTNGISFRRWLEFANQELADYIKELIGDDYLTDATQLEKLAAFADDPAVHKRLSQIKYDNKLALKRYLKANKGIDLDENSIIDTQIKRFHEYKRQQMNALYVIHKYLEIKKGNLPKRKITIIFGGKAAPAYVIAQDIIHLILSLSELINNDPEVSKYLNVHLVDNYNVTVAEHLIPATDISEQISLASKEASGTGNMKFMLNGALTLGTMDGANVEIAELVGPENIFIFGKDSDTIIDLYKKEGYVSRDYYENDANIKAAVDFIVSEDLVKVGDKERLERLYKELISKDWFMTLIDLAEYIEKKEEVYAAYEDQDAWNKKVVYNIAKAGFFSSDRTIEQYDKDIWHTKY

SEQ ID NO: 4487 - protein, 318 aa, Glycine max
FFHFPQNFQTPTSPFSSSASSQSLLQISLLQKTHFSSHSFGIYHSIHGFWNETPRVWCCSSSSSSSSSCLTYLHLFLKSASPTFALQSPPRIHGPSHESHHTLPKTCNKNLFPLFFILLKSPTLFRKLYREQFINPPLRKDTSDFCQEMQFRLGKRVVRVAKCVFRRIRVRTRPGYYHRLGGSTTHSKNPITTRLLTWGQKLKRGAKTLCGKNGSGYLPIGSDPLCDRAPAVPKGHLAVYVGEEDGGFRRVLIPVIYCNHPLFSDLLREAEKEFGFEHPGGITIPCRLTEFERVKTRIASGSGQRGRTRRLGWPLQHY

SEQ ID NO: 4488 - protein, 289 aa, Haemophilus ducreyi 35000HP
MRTSNSKKHLGHTARKRFGQNFLSDMNVIHNIVAAINPRNEDFLLEIGPGLGALTEPVAEQVEKLTVIELDRDLAERLRHHPFLHHKLTVIEQDALRFNFRDYFDSLNLNHHQAIRIFGNLPYNISTPLMFHLFKFHDLIQDMHFMLQKEVVKRLCAAPNSKAYGRLTIMAQYYCQVIPVLEVPPTAFKPAPKVDSAVVRLMPYKTLPYPVKDVYWLNRVTTHAFNQRRKTLRNALSTLFTAQQLEMLGINLTDRAENLTISDYARLANWLCDNPPAIDTNQEILYDEL

SEQ ID NO: 4489 - protein, 469 aa, Shewanella sp. MR-7
MSVESVLKQLEELEVKFVDLRFTDTKGKEQHVSIPAHQVDADFFEDGKMFDGSSIAGWKGINESDMVLMPDPTTFVLDPFTEETTALIRCDILEPGTMTGYDRDPRSIAKKAEEYLRSTGIADTVLVGPEPEFFLFDDVRFGTDMSGCFVKIDAKEAAWNSGTSYEGGNTGHRPFVKGGYFPVAPVDSSQDLRSAMCLVLEEMGQVVEAHHHEVATAGQNEIATRFNTLTKKADEIQILKYVVHNMAHAYGKTATFMPKPIVGDNGSGMHVHQSLSKDGVNLFAGDKYAGLSETALYYIGGIIKHARALNAFTNPSTNSYKRLVPHFEAPVMLAYSARNRSASIRIPVVPSPKGRRIETRFPDPHANPYLGFAALLMAGLDGIQNKIHPGEAMDKDLYDLPAEEAAEIPQVATSLENALENLQADHEFLTRGGVFSEDFIQSYIALKSAEAERVSRTTHPLEFEMYYSL

SEQ ID NO: 4490 - protein, 730 aa, Medicago truncatula
MKGAVLVAIAASIGNFLQGWDNATIAGSILYIKKDLALQTTMEGLVVAMSLIGATVITTCSGPISDWLGRRPMMIISSVLYFLGSLVMLWSPNVYVLCLARLLDGFGIGLAVTLVPVYISETAPSDIRGSLNTLPQFSGSGGMFLSYCMVFVMSLSPSPSWRIMLGVLSIPSLFYFLLTVFFLPESPRWLVSKGKMLEAKKVLQRLRGQDDVSGEMALLVEGLGIGGDASIEEYIIGPADEVGDGHEQTTDKDKIRLYGSQAGLSWLAKPVTGQSSLGLVSRHGSLVMDPLVTLFGSIHEKLPETGSMRSALFPNFGSMFSTAEPHIKTEHWDEESLQREGEDYVSDGAAGDTDDDLHSPLISRQTTSLEKDLPPPPSHGSLLNSMRRHSSLMQESGEPVGSTGIGGGWQLAWKWSGKGEDGKKQGEFKRIYLHEEGVGVSGSRRGSMVSIPGEGDFVQAAALVSQPALYSKELIGEQPVGPAMIHPSKTASKGPIWEALLEPGVKHALIVGIGIQLLQQFSGINGVLYYTPQILEEAGVAVLLADLGLSSTSSSFLISAVTTLLMLPSIGLAMRLMDVTGRRQLLLVTIPVLIVSLVILVLGSVIDFGSVVHAAISTVCVVVYFCFFVMGYGPIPNILCSEIFPTRVRGLCIAICALVFWIGDIIVTYSLPVMLSSLGLAGVFGVYAIVCCISWVFVYLKVPETKGMPLEVITEFFSVGSKQSAAAKNE

SEQ ID NO: 4491 - protein, 483 aa, Bacillus thuringiensis serovar konkukian str. 97-27
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFEKAVGQLKVGDGFGDGTTVGPLIDENAVSKVQEHIEDAIQKGGTVLYGGQKVAELDGHFMQPTVIGLANDTMLCMNEETFGPVAPVAKFKTVEEVIERANHTPYGLAAYIFTKDISQAFQISEALEYGIIGLNDGLPSVAQAPFGGFKESGIGREGGHFGIEEYLEIKYISLGL

SEQ ID NO: 4492 - protein, 361 aa, Sulfolobus tokodaii str. 7
MRAAVLFNYKEPLKIEEVEIEDPKENEVMVQVVATGLCHSDINVFVGATPVPPPVVAGHEIAGIVKKVGPGVTRVKPGDRVISAFIHPCGKCKNCISGHENLCETFSSVRLKGTMFDGTTRLRLKNGTIVRTFLGGGFAEYAIVHENALTVVPQDMDLQKVAVLGCAGITGYGAVDSAKIEPGETVAVIGVGGVGLSIIQLLKASGAGRIIALGTKKWKLEKAMELGATDVINTKETDPIKALKEVTNGGPDVVIEAGGTQETVQMAIESVRIGGRVVLVGLPPVSAQIPLRIAMIVRNGITILGNYGGRPRIDMPRLLELVRSGKYDPGKLVTGKYRLEEVNEAVKLLEEGEAIRSLIIP

SEQ ID NO: 4493 - protein, 478 aa, Ralstonia eutropha JMP134
MTQTPQPSSGLSHGLKQRHMTMIALGGVIGAGLFVGSGVVIKSAGPAAVLSFLITGLLVVLVMRMLGELACAMPGGGSFYEYAREAWSDRPAVGNLASFLTGWMYWYFWVIVVALEAVAGADLVRYWLPDVPNWTISLVLLVMLTLTNLISVKSFGEFEFWFASIKVAAIMVFLFVAGVYVLGLAPGAHGMNVANLTANGGFMPNGIVPVLTGAVAATGFYFGAEIVTIAAAETAEPQKAVARATNSVITRVLVFYVGSVLLVVCLVPWNATGIATPYVSALNVMGIPAAAQIMNAIVLTAVLSALNSGLYASSRMLFALTKRGDAPRSLARVSRNGVPTRAILVATLFGYGAVVMSYVSPDKVFAFLVNSYGTVAIFVYILIAVSQLRLRARLEREAPHLLKVRMWCYPYLTWLAIFGMLAIVVAMAFIPDQRTPLALGVASLGLLVSAYIVRHLFRRGVQQVVPLAEMPRPDLHEY

SEQ ID NO: 4494 - protein, 3307 aa, Oryza sativa (japonica cultivar-group)
MVYFLMFLLLLSIPLCKTDDQLTLGKPIFPSEMLISKGGIFALGFFPPANFSNSLYVGVWFHNIPQRTVVWVANRDNPITTPSSATLAITNSSGMVLSDSQGDILWTAKISVIGASAVLLDTGNFVLRLANGTDIWQSFDHPTDTILAGMMFLMSYKSEIIGRLTAWRSHDDPSTGDFSFSLDPSSDLQGMTWNGTKPYCRNGVRTSVTVSGAQYPSNSSLFMYQTLIDSGNKLYYSYTVSDSSIYTRLTLDSTGTMMFLSWDNSSSSWMLIFQRPAAGSCEVYGSCGPFGYCDFTGAVPACRCLDGFEPVDPSISQSGCRRKEELRCGEGGHRFVSLPDMKVPDKFLQIRNRSFDQCAAECSSNCSCKAYAYANLSSGGTMADPSRCLVWTGELVDSEKKASLGENLYLRLAEPPVGKKNRLLKIVVPITVCMLLLTCIVLTWICKHRGKQNKEIQKRLMLEYPGTSNELGGENVKFPFISFGDIVAATDNFCESNLLGRGGFGKVYKRFPIYIDDNMKGILEGGTEVAVKRLNEGSGQGIEEFRNEVVLIAKLQHRNLVRLLGCCIHEDEKLLIYEYLPNKSLDAFLFDATRKYVLDWPTRFKIIKGIAKGLLYLHQDSRLTIIHRDLKASNILLDTEMNPKISDFGIARIFHGNQQQANTTRVVGTYGYMSPEYVLGGAFSVKSDTYSFGVLLLEIVSGLKISSSKLTPNFFSLTAYAWRLWKDGNATELLDKFFVDSYPLHEAFSDVIYDFKSLMENSGVCCVRILAGYLDHEGDAAAAPPRLDCTTDDDFSSAVSPPHNDVAQFTALAELIPEHARFNEDGMYHAIDIYLKTVVQVLYHEQRRLRAPSQPPSTAPSFCQSDDRLTPAKPLIFPGGDKLISDGGVFAVGFFSLTTTNSTPSLLYLGIWYNNIPERTYVWVANRDNPITTHTARLAVTNTSGLVLSDSKGTTANTVTIGGGGATAVLQNTGNFVLRYGRTYKNHEAVRVVAWRGRRDPSTCEFSLSGDPDQWGLHIVIWHGASPSWRSGVWNGATATGLTRYIWSQIVDNGEEIYAIYNAADGILTHWKLDYTGNVSFRAWNNVSSTWTSPFERPGHGCLHYGACGPFGYCDITGSFQECKCLDGFEPADGFSLNSSRGCRRKEELRCGGQDHFFTLPGMKVPDKFLYIRNRTFEECADECDRNCSCTAYAYANLRTILTTGDPSRCLVWMGELLDSEKASAVGENLYLRLAGSPAVNNKNIVKIVLPAIACLLILTACSCVVLCKCESRGIRRNKEVLKKTELGYLSAFHDSWDQNLEFPDISYEDLTSATNGFHETNMLGKGGFGKHKNLVRLLGCCIHGDEKLLIYEYLPNKSLDKFLFDHAMKSVIDWQTRFNIIKGVARGLLYLHQDSRMMIIHRDLKTSNILLDAEMNPKISDFGMARIFGNSEQQASTRRVVGTYGYMAPEYAMEGIFSVKSDTYSFGVLLLEIAWNLWKDGMAEAFVDKMVLESCLLNEVSESPSSFGGRWPPYSLLGRCQGNCLQNSRPLFTRGADKSRSGVTSLAHRTKFTVQKRVVYGLVAKIKGANCSRFIATGEPRTRPYEIYQIMACLPVFISLLFLISSCKGDDQLTQANRLISPGDVLISKGRVFALGFFSPTASNQSFFLGIWYHNISESERTYVWVANRDNPITTPSFATLAISNSSNLVLSDSGNHTLWTTNVTATGGDGAYAALLDSGNLVLRLPNGTTIWQSFDHPTDTLLMGMRFLVSYKAQVAMRCIAWKGPDDPSTGDFSISGDPSSNLQIFLWNGTRPYIRFIGFGPSSMWSSVFSFSTSLIYETSVSTDDEFYIIYTTSDGSPYKRLQLDYTGTLKFLAWNDSASSWTVVVQRPSPTIVCDPYASCGPFGYCDATAAIPRCQCLDGFEPDGSNSSSRGCRRKQQLRCRGRDDRFVTMAGMKVPDKFLHVRNRSFDECAAECSRNCSCTAYAYANLTGADQARCLLWSGELADTGRANIGENLYLRLADSTVNKKKSDIPKIVLPVITSLLILMCICLAWICKSRGIHRSKEIQKKHRLQHLKDSSELENDNLELPFICLEDIVTATNNFSDHNMLGKGGFGKVYKGVLEGGKEIAVKRLSKGSQQGVEEFRNEVVLIAKLQHRNLVRLISYCIHEDEKLLIYEYLPNKSLDTFLFDAKRKSVLDWTTRFMIIKGIARGLLYLHQDSRLTIIHRDLKASNILLDTNMSPKISDFGMARIFEGNKQQENTTRVVGTYGYMSPEYALEGSFSVKSDTYSFGVLLLELAWSLWKDGNAMDLVDSSIRESCLLHEVLRCIQIALSCVQDDPTARPLMSSIVFMLENETAALPTPKESAYLTARVYGTKDTRENKERSVNNHCIGKKQSAYSKARRRRLIHGKPQAKAKPAHHHQPGSNTLNHNPHSTVEIWINPINQWRTGTLMDLRPEEIRTICVNGTNPHPSMGAPPDGKQPRRLRRCGIQDSPTDRSCKLSSTRRQIRFHPAAAAATAATATAAISDESELTPAKPLYPGDMLISDGGVFALGFFSPTNSNATLYVGIWYHKIPNRTVVWVANRDNPITAPSSAMLFISNSSDLVLSESGGHTLWEARNNITTGGSGATVVLLNSGNLVLRSPNHTILWQSFDHLTDTILPGMKLLLKYNGQVAQRIVSWKGPDDPSTGNFSLSGDPNSDFQVLVWNGTSPYWRSGAWNGALVSAMFQSNTSSVTYQTIINKGNEIYMMYSVSDDSPSMRLMLDYTGTIKMLIWNSNLFAWSVLFSNPSYTCERYASCGPFGYCDAAEAFPTCKCLDGFKPDGLNISRGCVRKEQMKCSYGDSFLTLPGMKTPDKFLYIRNRSLDECMEECRHNCSCTAYAYANLSTASMMGDTSRCLVWMGELLDLAKVTGGGENLYLRLPSPTAVKKETDVVKIVLPVVASLLILTCICLVWICKSRGKQRSKEIQNKIMVQYLSASNELGAEDVDFPFIGFEEVVIATNNFSSYNMLGKGGFGKVYKGILEGGKEVAVKRLSKGSGQGIEEFRNEVVLIARLQHRNLVKLVGCCIHEDEKLLIYEYLPNKSLDAFLFDATRKTVLDWPNRFKIIKGVARGLLYLHQDSRLTIIHRDLKAGNILLDAEMSPKISDFGMARIFGGNQQQANTTRVVGTYGYMSPEYAMEGIFSVKSDIYSFGILLLEIISGFRISSPHLIMGFPNLIAYSWSLWKDGNARDLVDSSVVESCPLHEVLRCIHIALLCIQDHPDDRPLMSSVVFMLENNTAPLPQPKQPIFFVHKKRATEYARENMENSVNGVSITALEGR

SEQ ID NO: 4495 - protein, 471 aa, Mesorhizobium loti
MKVVPVIISGGAGSRLWPASRQSHPKPFLKVADGLSLIQHTVLRAASMQHVVELVTVTSTGHLFLTKDVFDELDSVVLPRTFLLEPEGRDTAAAVAAATVHAKATQGPDAVLCVFPADHMIGDLPAFQTAMNRAIEQAQQGRIATLGITPDRPDTAFGYIEADGEKVVRFVEKPNAETAKSYVASKRFFWNAGIFCFKAQVMLDEMAAHCPQVIDAVLDSYDNARVSHGEHVASVELSSEHFAMAPRISLDHAVMEKTHNLAVVPCEMGWNDIGSWNAMAELVAADGSGNRIRGDVHVVDTVGSYISSDKRVIGTVGISDLVIVDSPDALLVASRDRVQDVKKLFEGLKAAGHEAHLLHSTVHRPWGTYTVLEESERFKIKRIEVKPGGRLSLQMHHHRSEHWVVVSGTAKIVNGDQELLLTTNQSTYIPCGHKHRLENPGNIGLVMIEVQSGEYLGEDDIVRLEDVYGRT

SEQ ID NO: 4496 - protein, 481 aa, Xanthomonas axonopodis pv. citri str. 306
MFPGEPMSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 4497 - protein, 373 aa, Aquifex aeolicus VF5
MDRLEKVSPFIVMDILAQAQKYEDVVHMEIGEPDLEPSPKVMEALERAVKEKTFFYTPALGLWELRERISEFYRKKYSVEVSPERVIVTTGTSGAFLVAYAVTLNAGEKIILPDPSYPCYKNFAYLLDAQPVFVNVDKETNYEVRKEMIEDIDAKALHISSPQNPTGTLYSPETLKELAEYCEEKGMYFISDEIYHGLVYEGREHTALEFSDRAIVINGFSKYFCMPGFRIGWMIVPEELVRKAEIVIQNVFISAPTLSQYAALEAFDYEYLEKVRKTFEERRNFLYGELKKLFKIDAKPQGAFYVWANISDYSTDSYEFALKLLREARVAVTPGVDFGKNKTKEYIRFAYTRKIEELKEGVERIKKFLEKLS

SEQ ID NO: 4498 - protein, 483 aa, Pseudomonas fluorescens Pf-5
MIPVILSGGSGSRLWPLSRKQFPKQFLALTGEHTLFQQTLERLVFEGMDTPIVVCNKDHRFIVNEQLAARKLESQRILMEPFGRNTAPAVALTAMMLVNEGRDELMLVLPADHVLDDQKALQRALALATVAAERGEMVLFGVPATKPETGYGYIKSTNDALLPEGVSRVSHFVEKPDEKRATEFVQAGGYFWNSGMFLFRASRFLEELKKHDPDIYDTCLLTLERSQQDPDTVTIDEATFACCPDNSLDYAVMEKTQRACVVPLSAGWSDVGCWSSLWDVHEKDANGNVSKGDVVIQDSKNCMIHGNGKLVSVIGLENIVVVETKDAMMIAHKDKVQGVKQMVNTLNEQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPVERGVSVKTIAQ

SEQ ID NO: 4499 - protein, 526 aa, Anabaena variabilis ATCC 29413
MSKVLVSDPIDQAGIDILSQVATVDVNTGLKPAELIEIIGQYDALMIRSGTRVTQEIIEAGTQLKIIGRAGVGVDNVDVPAATRRGIVVVNSPEGNTIAAAEHALAMMLSLSRHIPDANASVKRGEWDRKTFVGAEVYKKTLGVVGLGKIGSHVATVAKAMGMKLLAYDPFISTERAEQLGCQLVDLDLLMQQSDYITLHIPKTPETTHIINATTLAKMKPTARIINCARGGIIDEAALAAAVKEGKIAGAALDVFESEPLGESDLRAIGKDIILTPHLGASTTEAQVNVAIDVAEQIRDVLLGLPARSAVNIPGLGPDVLEELKPYMQLAETLGKLVGQLAGGRVELLTVRLQGELATNKSQPLVIASLKGLLHQALRERVNYVNANIEAKERGIRVIETRDASARDYAGSLRLEATGTLGTHSVTGALLGDKEIHLTDVDGFPINVPPSKYMLFTLHRDMPGIIGKLGSLLGSFNVNIASMQVGRKIVRGDAVMALSIDDPLPDGILAEITKVPGIRDAYTVTL

SEQ ID NO: 4500 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 4501 - protein, 406 aa, Bordetella pertussis Tohama I
MLYRQPNMAQIVLFENIHPSARAVFSAAGYTDIVAHAAALPSGELREALRGAEVVGIRSRTHLDADLLAANPDLRVVGCFCIGTNQVDLDAAMMRGVPVFNAPFSNTRSVAELVLGEAILLLRRIPEKNARVHLGHWDKSAAGAYEARGKTLGIVGYGNIGSQISTLAEAIGMRVVFFDVEAKLPLGNARAAGSLAELLEQADVVTLHVPGGKSTQNIVNADTLARMKRGAILINASRGTVVDIQALHDALASGHLAGAALDVFPTEPKSADEPLASPLIGMPNVVLTPHIGGSTQESQENIGREVAEKLVRFLQAGTTKSAVNFPELSYQAPVGGSRIIHVHRNAPGALGALDNLMAQHGLNIVSQSLQTKGQIGYAVTDVDGEVSDTVLADLRSHPVTVRCEKL

SEQ ID NO: 4502 - protein, 146 aa, Glycine max
  misc_feature (54)..(54): Xaa can be any naturally occurring amino acid
  unsure (1)..(146): unsure at all Xaa locations
MASSLSFVSSSHLTLRTPSLTLRKLSPPRTSVSFSVKAQSVALSQDDLKKLAAXKAVEAIKPGMVLGLGTGSTAAFAVDQIGKLLSSGELHDIVGIPTSKRTEEQARSLGIPLVALDTHPRIDLAIDGADEVDPNLDLVKGRGGAL

SEQ ID NO: 4503 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPPVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 4504 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 4505 - protein, 299 aa, Triticum aestivum
MLGLRATRAARLPCPYPTPCSAASLSGLARRAPLLAVASPAPSSPAALSLLASARPVSAAWGSAMRPAGEHPRPGTRVLCTAASSSAPREGKEVLVQHLLVGEKDARLLVDLEKSIASGADLSDLAVEHSLCPSKENGGMLGWVRRGQMVPEFEEAAFSAPLNKVVRCKTKFGWHLVQVLSERDQCLLQDIQPEELHEKMQDPSFIEESQLIDVREPDEVERASLPGFKVLPLRQFGTWGPVMTDEFNPQKDTYVLCHHGMRSMQVAKWLQSQGFQKIYNVAGGIHAYSVKVDSSIPTY

SEQ ID NO: 4506 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 4507 - protein, 380 aa, Synechococcus elongatus PCC 7942
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKAEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKSGRLGLVQTLLISSQDSLPLTGGFFVAKREHPRSQDSINPSGPD

SEQ ID NO: 4508 - protein, 188 aa, Triticum aestivum
FVSAFCQSNCGDVSPNVLGAFCTDTNRPCDFNHSTCNGQNELCYGRGPGYPDEFESTRIIGNRQFLKAVDLFNSASEEIQGKVDYRHTYLDFSQLEVNVSSSTGGQHQTVKTCPAAMGFAFAAGTTDGPGAFDFKQGDVKGNPFWRLVRNVLRPPGPEQVKCQAPKPILLDTGEMKVPYDWAPSILPI

SEQ ID NO: 4509 - protein, 463 aa, Bacillus cereus ATCC 14579
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 4510 - protein, 267 aa, Triticum aestivum
  misc_feature (208)..(208): Xaa can be any naturally occurring amino acid
  misc_feature (242)..(242): Xaa can be any naturally occurring amino acid
  unsure (1)..(267): unsure at all Xaa locations
HLQQVLTKSSSYRSGIPGISSTHASALPELTVHVNYEGFAEDVRVGDDLLVDGGMARFEVVEKLGPDVKCRCTDPGLLLPRANLTFWRDGSVVRAKNAMLPTITSKDWLDIDFGIAEGVDFIAVSFVKSAEVINHLKSYIAARSRGSDIAVIAKIESIDSLTNLEEIIRASDGAMVARGDLGAPIPLKQVPSIHQKMVNLGRQLKQPXVWLLPQLLESMIKYPIPPRAKVLDVSETAPQRAXALWLSGRGPQWGKYPKKRPLLCPPN

SEQ ID NO: 4511 - protein, 515 aa, Zea mays
MSNPWGGIVGAGAWALDAERAEEEERDAAAAPVPAPAPAAGFPSLREAAAGAAGKSKKKNKGTTLSLSEFAGFGPGRRQAPAPPEPRGLTTAEMMMLPTGPRERSADELDRPRGLGGGFRSYGSGDRGGGFDDDGRRGPPGRGSDLDMPSRADEDRDWSMSKKSFTPSPADSGSRSRYGGLGSGAPASVGRADDDGDWSRGKKPLPSGPSRYPSLGSAGGGFRDSPVSTDSSDRWSRAAPSNDERERPRIVLDPPKRDASATPTPPAEAGRSRPSPFGAARPREDVLADKGLDWKKMETEIDQKRTSRPTSSQSSRTESAQPSRPGSPGSQISATGSEAAPTARPKVNPFGEAKPREVILQEKGKDWRKIDRARQRRRFVRPKTNEENVLKEEINLLKVELDESEGKISDEDAKAMSEKITQMEEQLELLRTAMDDKIRFLQRPGSGAGRVIASPPTNFVDEPQIKESMERPRAHSSTEQYTKPTEERWGFQGSRDRGSFGGNRISERSSAGQRW

SEQ ID NO: 4512 - protein, 402 aa, Mesoplasma florum L1
MEKVFRDSIHGDIFIHDEIFMEIINSPEMQRLRRILQLGGAQFAYAGATHTRFTHCLGVYHIISQFLKAPDFEKISAKEKKIVLLAGLMHDIGHGPFSHTFEKISNRSHEEYSADIIRNPEGNISKILKKHKVDPEDIIAILEGKYPNKVLNSLVSSQLDADRIDYLMRDSYYCGVNYSSLDTEFLIRNVRIMDDKIVFPKKTIHAIESYLLGRYHMYKQVYEHKISTAFDVTLISWFERIIDLNEKGYKFLDDRINNYFSYIFNGQNIPIHLYLILDDFTMFDIMKSCQKENDHILNDLSDRLINRNFLKLKEADEFKIREIKTLLKEEGKDPKYYFIEPKVKKPSIYKDGVTDGKDQTIYIVDKNNVVKSLTKFSLLANTVKLIEDEKTIKKYFFPKEVM

SEQ ID NO: 4513 - protein, 1098 aa, Bradyrhizobium japonicum USDA 110
MNVLSSVDTKKIEAAEVVDELWYKDAIIYQLHVKAFADSNNDGIGDFAGLTEKLPYLQELGVTALWLLPFYPSPGRDDGYDIADYGSVNPDFGTMKDFKRFIQEAQKRGLRVITELVVNHTSDQHKWFKRARRSHPGSSARNWYVWSDTDQKYQGTRIIFTDTEKSNWTWDHEAGAFYWHRFFSHQPDLNFDNPRVVSALIQVMKRWLDAGVDGFRLDAIPYLCEREGTSNENLPETHAIIKRLRQELDSYSKGKLLLAEANQWPEDVQEYFGRGDECHMAYHFPLMPRIYMAIAQEDRFPITDILRQTPDIPASCQWALFLRNHDELTLEMVTDVERDYLWTTYANDPRARINVGIRRRLAPLMDNDRRKIELMNSLLLSFPGTPIIYYGDEIGMGDNIYLGDRNGVRTPMQWSPDRNGGFSRCDPARLYAPLIMDPVYGYESVNVEAQSRSLSSLLSATKRLISVRKSTLAFGRGTMTFIRPANRAVLAYVRQYHDEVILCVANLSRAAQATELDLSPWKDRIPQEMLGRTRFPPIGELPYMITLGPYGFYWFHLMERDKSEPVTPRAVPEFETLVVPVNSTWVSLARERGVFEHDVLPGFLSRTRWYPEHDPKHIKPTLTSAVPFCDIGDNRPWIAFFEAAQQDAVATRYVLPMQIEWVRFDRERFNPKALAAVRQGAREGTLLDVATDQIFIGLFLRNLSQNLVVEENNLRLEFKATSRFADYTIKEPGRIRAIEQSNSTALVDNQYVAKIYRQLEGGTNPEIEIGHYLTEVARFANTPALLGSVELVEGDQRSTLGVLHAYVENQGDGWAVTTGYLDRYIDEQRVLSAGEAPRETQEQSPYLHFVMQIGRRLAELHVALAAARPDDLAPEPIGSAHIRHWVSDLKARAGRVFERLADSRDGLREADRPLIDQLTALRTSLPDRLNALLPSDIDGLNIRHHGDFRLGQILIVKDDICIIDFDGDPRLPLADKRRKLPAARDVAGLIRSIDLSVNVALGRALSGGTDEQSRLVAALSEWRERATTTFLSAYREAMTDRRLWPEDPQSAEGLLRFFLLDQAFDEVEYELSHRPEGLHAPLTGLLRILSNAESEAHA

SEQ ID NO: 4514 - protein, 540 aa, Bacillus halodurans C-125
MIEQAIADKSQTENKAIYRILVSDAMSEQGLSPLLNDPRVECVQQNVADADDLHEYDALLVRSATTVTEELMEKMSSLKIIARAGVGVDNIDIDAATKHGIVVVNAPDGNTISTAEHTFAMICSLLRKIPQANASIKAGEWKRKAFQGTELRGKTLGIIGFGRIGSQIAKRAKAFEMTPYVFDPFLTKARAEKLGVTVASLDDVLQVADIITVHTPLTKETKGLLGMKNIGKTKKGVFLINCARGGIIDEEALKHYLREGHIAGAALDVFEEEPVADEELLAFDNVIATPHIAASTKEAQLNVAEQVSQEVLHFLEGNPVSNSINLPTLSKEVYEKVKPYYELTKKMGFLLSQCMKTPVQEIEVRYGGNVADIETSITTRSLMAGFLSPRVDAGVNDVNAGLIAKERGISFTEKHSSNQTFGYANIIHAVVHGEERTFEVHGTFIKEYGPRIVKINGFNVDFVPEGHLIYIQHNDRPGVIGKMGQLLAEHNVNIATMQVGRQEEGGDAIMMVAVDKVATDEVIEALKAVDEIHFADRIEL

SEQ ID NO: 4515 - protein, 359 aa, Nocardioides sp. JS614
MAAVDNFWAVIPAGGAGTRLWPLSRSSSPKFLHDLTGQGRTLLQGTHDRLAPLVADRFVVVTGAAHRAAVLEQLPEVSPERVLGEPAPRDSMGAIGLAAAVLEREDPDAVMGSFAADHVIPDRAAFAEAVRIAAEVARDDWLVTLGIQPVFPSSAFGYIHLGDPLAGHAGASAVREFVEKPSVRTATEYVATGRYRWNAGMFVVRPTVLLDLLATWHAEFAGALRAIAADPARLEELWPGLPKIALDHAVAEPAAAAGRVACVPSSFHWDDVGDFDSLAALLGTTATATTILGDADLVRVVDASGLVVPGSGRTIAVVGLDDVVVVDTPDAVLVTTRSRAQEVKQVVEALKADGRADLT

SEQ ID NO: 4516 - protein, 358 aa, Lotus japonicus
MATMMMSIFPPPPSVASLFILSHCTHTIRVQSTTQFTGFSIRTRTRDCSRILLTEEREMAVMEEKKLLQTGIAEFYDESSGLWEDMWGDHMHHGFYEQDVTVSVSDHRVAQIRMIEESLRFAALSEDPAKKPESIVDVGCGIGGSSRYLAKKFQAKSVGITLSPVQAQRANALAASQGLADKVSFQVADALEQPFPDGQFDLVWSMESGEHMPDKPKFVGELARVAAPGGTIIIVTWCHRDLGPAEESLQPWEQNLLKRICDAFYLPAWCSTADYVKLLESHSLQDIKSADWSPFVAPFWPAVIRSAFTWKGLTSLLRSGMKTIKGALAMPLMIEGFKKGVIKFAIVTCRKPENVEIE

SEQ ID NO: 4517 - protein, 241 aa, Oryza sativa
MAMASSSSASAAAARGGSLVEEWSGRVKALEAGFRKWMAEQPTHIEAAVTTAVGAVQGAALGGLMGTLTADGGSPFPTPPPPPPNANPQAMASFKQAQALAGGPLVQARNFAVMTGANAGISCVMRRIRGGEDIQGSMAAAFGSGALFSIVSGMGTPNPVANAITTGAAFAIFQGGFFMIGQKFSKPQSEDLYYSRARSMLQKLGLEKYEKNFKKGLLTDQTLPLLTDRQVIVFVCNQHHF

SEQ ID NO: 4518 - protein, 127 aa, Brassica napus
  misc_feature (95)..(95): Xaa can be any naturally occurring amino acid
  unsure (1)..(127): unsure at all Xaa locations
MDSGDPTTLLLTKIRILEPDYAPKIIGYLLLQDFSEKDLMRLALGPETVLQSIILKVKGQLGLFTSPSTPTSPSPFNPISRPPINGRGGGGGGGXLSLMGLWDFRRNSPSSSPSPTSPWSVNSVSLY

SEQ ID NO: 4519 - protein, 602 aa, Aspergillus oryzae
MATQHKTQSSPVNAAWWKEASVYQIYPASFKDSNGDGIGDIPGIISELDYLKALGIDLVWLSPILQSPQVDMGYDVSDYYRIHPPYGTVEDVDALIQGLHQRGMRYVMDLVVNHTSDQHEWFKQSRSSSDNEYRDWYIWKKPKYDANGVRQPPNNWGAYFGGSAWQYDETTDEYYLHLFAPEQPDLNWENPKVRSAVHQIMRYWLDKGVSGFRMDVINMISKDQSFPDAPITDPKAQWQHGAMHYCCGPRLHEYLQELGRVLKEYDAFSVGEMPNVYDPVEIGKAVGFDRGELAMAFQFEIMDIDHGPAGKFSPHKYRMSDLKHIVSKWQDFMYENEGWNALYLENHDQGRTISRFTSAGPEYRATAGKMLATFLGLQGGTPFVYQGQEIGLVNVPETWGIEQFRDIETLNYWNEITAAYPNDTELHKVTSQQFRVKSRDNGRTPMQWTSGKFAGFTAAHNGPWIDVHDDYEDWNAASQVGNPNSVFQHWAKVLALRKAHKRLFVYGSYKLIDEANNDLFTYLRVYGSQSALVLANFTGKEVSWVVPAETISILKNGAVLLESYQRHRPVRPDGTIAVMPFESFVMFLDSPNARVGAGGGKL

SEQ ID NO: 4520 - protein, 594 aa, Glycine max
  misc_feature (66)..(66): Xaa can be any naturally occurring amino acid
  unsure (1)..(594): unsure at all Xaa locations
GTAFPTRPIRPRTSFPSLSLRHAPPCQSHTPSSSASSPLPPPPFPPTTTSLPPPSSSRAPPTAASXSLRASFSPETLVSDNNGAPSPPPPSDPSSIEVDSVTEAELKENGFRSTRRTKLVCTVGPATCGFEQLEALAVGGMNVARINMCHGTREWHKEVIDRVRRLNHEKGFAVAIMMDTEGSEIHMGDLGGASSAKADDGEIWTFSVRAFDSALPQRTINVNYEGFAEDVKVGDELLVDGGMVRFEVIQKIGPDVKCRCTDPGLLLPRANLTFWRNGSLVRERNAMLPTISSKDWLDIDFGISEGVDFIAISFVKSAEVITHLKSYIAARSRDSDISVIAKIESIDSLKNLEEIVLAADGAMVARGDLGAQIPLEQVPSAQQRIVQVCRQLNKPVIVASQLLESMIEYPTPTRAEVADVSEAVRQRADALMLSGESAMGQYPDKALTVLRSVSLRIERWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVIAVSDMLQSIQVMNVP

SEQ ID NO: 4521 - protein, 522 aa, Saccharomyces castellii
MKEEIREISVEVEAETVRRELKQRHMGMIALGGTIGTGLFIGVSTPLMNAGPVGALIAYLFMATLAYSVTQSLGEMATFIPVTSSFTVFSQRFVSPAFGAANGYMYWFSWCITFALELSVVGQVIQFWTFAVPLAAWISIFWVLLTGMNMFPVKYYGEFEFWVALVKVVAIMGFLIYCFCMVCGAGVTGPVGFRYWRHPGAFGPGIIAKDKNQARFLGWVSSLINAAFTFQGTELVGITAGEAANPRKTVPRAIKKVVFRILFFYILSLFFIGLLVPYDDWKLTSTDSYVSASPFIIAIENSGTHVLPHIFNAVIVATIISAGNSNIYVGSRIMYGLSTSRLAPGILSRTTQHGVPWVAVLVTSLFGALAYMETSTGGQKAFNWLLNITGVAGFFTWLFISLSHIRFMQALEMRGISRDDLPFKAKWMPGLAYYGVFFMTLIIIIQGFTSFCPWNGIDFLTAYISVFMFIAIWIAFQAWFRCRLIWRVEDVDIDTDRRAVEEAVWIEQEPRGFWDKFWNVVA

SEQ ID NO: 4522 - protein, 332 aa, Escherichia coli O157:H7 EDL933
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYSTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFICEFPDA

SEQ ID NO: 4523 - protein, 422 aa, Galdieria sulphuraria
EFGTRKDVQVYFIQVLLYLYKEECQEITTAKDIFLIRWISIKMIAVQPQPKKTPVAEYLQTSQDTPTSLTRYLLEVAKQNKDMGDMVALINGIQFACKKIASLVGKAGVTDLMGIYQQGIVNVHGEEQKKLDVLSNEVLKNALKYSGKMAVIASEEEDVPIMVEESYSGNYVVVFDPLDGSSNLDAGLPTGTIFGVFQQQFSCLIHDYEESIDNMELACLQNTLQPGRRLIAAGYCIYSSSTMLVLSLGNGLHCFTLDTEVGEFVLTRANIQIPQRGNIYSFNESNFYQWDKGVQDYIERLKKGNNQTNCRYSARYVGSMVADVHRTILYGGIFGYPADKKNVSGKLRLVYECAPMAYLVEQAGGKATTGIENILDLTPKDIHERKPLILGSPADIEEFLQVYGMSRVDREDMHMWDNLSSL

SEQ ID NO: 4524 - protein, 276 aa, Bacillus subtilis subsp. subtilis str. 168
MPTSLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKGQGIQLEAWSPLMQGQLLDNEVLTQIAEKHNKSVAQVILRWDLQHGVVTIPKSIKEHRIIENADIFDFELSQEDMDKIDALNKDERVGPNPDELLF

SEQ ID NO: 4525 - protein, 443 aa, Thermococcus kodakarensis KOD1
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGAYKNFIDYKEREWEEYIEYLSSRDIPIDTKKVTEWELERYFYV

SEQ ID NO: 4526 - protein, 471 aa, Bacillus cereus ATCC 14579
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 4527 - protein, 334 aa, Photorhabdus luminescens subsp. laumondii TTO1
MKTLGEFIVEKQQDFSHATGELTALLSAIKLGAKIIHRDINKAGLVDILGTSGVSNVQGEVQMKLDLYANEKLKAALKARGEVAGIASEEEDDIVIFEGDRAENAKYVVLMDPLDGSSNIDVNVSVGTIFSIYRRITPIGQPVTEKDFLQPGHRQVAAGYVVYGSSTMLVYTTGCGVHAFTYDPSLGVFCLSHEKVQFPPNGNMYSINEGNYIKFPMGVKKYIKYCQEQDEATQRPYTTRYIGSLVADFHRNLLKGGIYIYPSTASHPSGKLRLLYECNPMAFLAEQAGGKASDGANRILDITPSKLHQRVPFFVGSKSMVEKAESFMAEFPDE

SEQ ID NO: 4528 - protein, 137 aa, Triticum aestivum
  misc_feature (11)..(11): Xaa can be any naturally occurring amino acid
  misc_feature (16)..(16): Xaa can be any naturally occurring amino acid
  misc_feature (18)..(18): Xaa can be any naturally occurring amino acid
  misc_feature (26)..(26): Xaa can be any naturally occurring amino acid
  misc_feature (32)..(32): Xaa can be any naturally occurring amino acid
  misc_feature (36)..(36): Xaa can be any naturally occurring amino acid
  misc_feature (39)..(39): Xaa can be any naturally occurring amino acid
  misc_feature (44)..(44): Xaa can be any naturally occurring amino acid
  misc_feature (57)..(57): Xaa can be any naturally occurring amino acid
  misc_feature (65)..(66): Xaa can be any naturally occurring amino acid
  misc_feature (72)..(72): Xaa can be any naturally occurring amino acid
  misc_feature (79)..(79): Xaa can be any naturally occurring amino acid
  misc_feature (81)..(81): Xaa can be any naturally occurring amino acid
  misc_feature (86)..(87): Xaa can be any naturally occurring amino acid
  misc_feature (93)..(93): Xaa can be any naturally occurring amino acid
  misc_feature (95)..(95): Xaa can be any naturally occurring amino acid
  misc_feature (102)..(102): Xaa can be any naturally occurring amino acid
  misc_feature (107)..(107): Xaa can be any naturally occurring amino acid
  misc_feature (109)..(110): Xaa can be any naturally occurring amino acid
  misc_feature (129)..(129): Xaa can be any naturally occurring amino acid
  misc_feature (133)..(133): Xaa can be any naturally occurring amino acid
  misc_feature (135)..(135): Xaa can be any naturally occurring amino acid
  unsure (1)..(137): unsure at all Xaa locations
LVTESSQPSRXYMMIXAXGVQRGLIXEGISRXEKKXFYXKGLKXQNVEKSFAEQHYXDLCSKPFXXGLVEYXVSGPGVXMXWEVKXXVATGRXIXGATSPLXSEPGXIXXDFAVDIGRNVIHGSDSVEXARKXIXLR

SEQ ID NO: 4529 - protein, 265 aa, Sulfolobus tokodaii str. 7
MIREVLRFINKSDLVIEVIDAREPDLTRSKKLEEYALNRERKILIVLNKADLIPREILEGWKKIFENEGKNAIYISATMHLGTKILRDKIKELLRGKEGTVIFVGYPKTGKSSIINALKGKHSASTSKIPMAYGYTKTIQKFKIDSKIYAWDSPGIIPPDGNELEKVIRGISVEKLEDPVKAGEMLLLRIIKYNPNAIKETYNITFNSPYEFFEKLALKRGWLYKSTKEPNIEEAAKAFIRDYHKGKIIYYVPPLSMNDDKDSSV

SEQ ID NO: 4530 - protein, 411 aa, Silicibacter pomeroyi DSS-3
MSDKTILIAGTYDTKDDELTYLAGVIAAQGGGVLSMDVSVLGDPSRPTDVSKHAVAEAGGSSIQAAIDSGDENGAMQIMARGAAAKALELYLAGRIHGVIVLGGTMGTDLALDLCAALPLGVPKYIVSTVSFSPLLPPERIPADVQMILWAGGLYGLNSICKASLSQAAGAVLGAARAVEAPHRDRPLIGMTSFGKTVLRYMVSLKPALEARGYEVAVFHATGMGGRAFESLAAEGAFAAVFDFAPQEVANHLYGGLSAGADRMTNAGRRGIPQLVAPGCYDLVDYIGWQAPPPALADRPSHAHNRLLTSAVLEADERRAVARAICAKLAGASGPVALMLPTGGCNEWDRPDAPLHDAEGLAAFCDEIRSACPANADLVTLDAHINDAAFSERALAIFDDWVARGLVAKGA

SEQ ID NO: 4531 - protein, 142 aa, Brassica napus
QAFLNWRRMLVRLEENEKLVLTPFEKNLDIWRQLWRVLERSDLIVMVVDARDPLFYRCPDLEAYAREIDEHKKMMLLVNKADLLPPEVRAKWAEYFRRNDILFVFWSAIAATAVLEGKVLKEQWRKADNFQNTDDPEVVIYG

SEQ ID NO: 4532 - protein, 269 aa, Rhodopirellula baltica SH 1
MTESEKRKSRITTRTLQRMRDRGERITMLTAYDFPTAKILDEAGVDVLLVGDTVGMVVQGHSTTLPVTMDQMIYHAEMVGRAADHAMVVVDLPFPDGQLDLLHSVRCGARVLKETQCHAVKLEGGAEQAERIEAMVGAGIPVMAHIGLRPQNIHVEGGYRLQRDIERLVADAKAAEAAGAFTVLIECVPSEAAAAITDAVKVPTIGIGAGRDVSGQVLVTHDILGLTSGYTPKFTRLFADVGNTIREAAKSYCDEVKAASFPSDAESFE

SEQ ID NO: 4533 - protein, 267 aa, Bacillus thuringiensis serovar konkukian str. 97-27
MLTKHRILFIGAGRMAEAIFSGLLKTSKEYIEEIIVSNRINVEKLDQLRARYNVSTTTDWKQHVTSVDTIVLAMPPSAHEELLAELSPLLSNQLVVTVAAGIGPSYLEKRLPEGTPVAWIMPNTAAEIGKSISLYTMGQFVNKTHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVAATNKKARGK

SEQ ID NO: 4534 - protein, 179 aa, Sordaria macrospora
VLIGVGLLSLPMGIKYAGWLCGMVTLFLCAAVTIYTAKLLAKCMDLDPSLITFSDLAFISFGRNARIATSILFTLELLAACVALIVLFADSLDLLFPGFLSVTGWKIICAVIMVPLNFLPLRLLSFTSIIGIFCCFSIVLILLTDGFLKPTAPGSLIEPAKTYMFPQNWLTLPLSFGSL

SEQ ID NO: 4535 - protein, 557 aa, Nostoc punctiforme PCC 73102
MSQPNPTQAFKFDSIDAALADLKAGRVIVVVDDENRENEGDLICAAQFATPDTINFMAVEARGLICLAMTGDRLDELDLPLMVSNITDTNQTAFTVSIDAGPELGVTTGISAEDRARTIQVTLNPATKPTDLRRPGHIFPIRAKAGGVLKRAGHTEAAVDLSRLAGLYPAGVICEIQNPDGSMARLQQLFEYAKRHNLKIISIADLISYRLQHDRLVYREVITKLPSQFGQFEIYAYRHTLDNTEHVAIVKGDPDNFKDEPVMVRMHSECLTGDALGSLRCDCRMQLEAALKMIEAAGQGVVVYLRQEGRGIGLINKLKAYSLQDMGLDTVEANERLGFPADLRDYGMGAQMLMDLGIKKIRLITNNPRKIAGVKGYGLEVVDRLPLLIEATDYNSYYLATKAKKLGHMLLQTYLVTVAIHWQDDPEAVTERYERLEKLRHLAKSNDLLLQEEARPLAIAIFDEPSLTVHLGFDQAKVAGCDWYQQSGHPYIQAIFQILDNLATLPYIQKLEFLISSGCDPLSNLQVQLDRQTFADGTLPSSISDRLEKQQIYSFSK

SEQ ID NO: 4536 - protein, 476 aa, Pyrobaculum aerophilum str. IM2
MKFKKAIRDPIHGFIKLTEEEVKLIDGEPLIQRLRYIKQLGFVYLVYPTATHTRFDHSLGVMHIATLLGQRIMQLLGEVDEELLRHLRAAALLHDIGHLPFSHSFEILTRELLHMATVRGCVEVNVAQFDAAQKPHEITTRLLVDKLSPRLSELGYDPDLIKNLLFNSDGKYKLYNKILSGVFDADRLDYIMRDMYFTGAAVGTSFTYVDLERIVENLEIDGDNFRFNEKARVNLEGYLITRYNLYRHVYLHHKTVLFTEVARNILADNIEKCASSLGDSDICQYLCDLARFVTGHVEEKDVWKVTDDYFTSVFIRDARFRDLLSRKPLDYITLWKREKDFIEVFKNPVRVNESVDKIGPIHWALLNRLKKKFVERLNIELGEVAGCKLSPEDVIFSYVSFDPYAEYLYISTAMGPISISKISPLVEAVNEAWKRAPHVFLYIKREALEKCGEKAVESIKSVLEPLMDLAIRRISA

SEQ ID NO: 4537 - protein, 517 aa, Lolium rigidum
MDKAYIAILSSAFLFLVHYVLGKVSDGRRGKKGAVQLPPSPPAVPFLGHLHLVEKPIHATMCRLAARLGPVFSLRLGSRRAVVVSSSECARECFTEHDVTFANRPKFPSQLLVSFNGTALVTSSYGPHWRNLRRVATVQLLSAHRVTCMSGVIAAEVRAMARRLFHAAEASPDGAARVQLKRRLFELSLSVLMETIAQTKATRSEADADTDMSLEAQEFKEVVDKLIPHLGAANMWDYLPVMRWFDVFGVRSKILHAVSRRDAFLRRLINAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFKPERFEDGKAEGLFMIPFGMGRRRCPGETLALRTIGMVLATLVQCFDWEPVDGVKVDMTEGGGFTIPKAVPLEAVCRPRVVMRDVLQNL

SEQ ID NO: 4538 - protein, 141 aa, Triticum aestivum
  misc_feature (57)..(57): Xaa can be any naturally occurring amino acid
  misc_feature (85)..(86): Xaa can be any naturally occurring amino acid
  misc_feature (89)..(89): Xaa can be any naturally occurring amino acid
  misc_feature (102)..(102): Xaa can be any naturally occurring amino acid
  misc_feature (107)..(107): Xaa can be any naturally occurring amino acid
  misc_feature (118)..(119): Xaa can be any naturally occurring amino acid
  misc_feature (124)..(125): Xaa can be any naturally occurring amino acid
  misc_feature (132)..(132): Xaa can be any naturally occurring amino acid
  misc_feature (135)..(135): Xaa can be any naturally occurring amino acid
  unsure (1)..(141): unsure at all Xaa locations
MAPAVMASSATTVAPFQGLKSTAGLPVGRRSSGSLSSVSNGGRIRCMQVWPIEGIKXFETLSYLPPLSTGGLLKQVDYLDSLKVXXCSXLTRLVPLPLSTTXPPGYXDGRYWDKLELXXFRVEXXTQGAEQXEEXKKDTLP

SEQ ID NO: 4539 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHATEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 4540 - protein, 400 aa, Hordeum vulgare subsp. vulgare
MDCCFPCPGARRKRKPPAPAEKPQIPPAPDKAKPGCSSSSAAARQDSLLEAKKEFVLSNGSEHRHIAAQTFTFRELAAATNGFRADCLLGEGGFGRVYKGYLESINQVVAIKQLDRNGLQGNREFLVEVLMLSLLHHPHLVNLIGYCADGDQRLLVYEYMPLGSLEDHLHDPSPDKPRLDWNTRMKIAAGAAKGLEHLHDKTNPPVIYRDLKCSNILLGEGYHPKLSDFGLAKLGPVGDKTHVSTRVMGTYGYCAPEYAMTGQLTLKSDVYSYGVVLLEIITGRRAIDNTRATGEQNLVAWARPLFKDRRKFPQMADPALEGRYPARGLYQALAVAAMCVQEQPTLRPLIGDVVTALSYLASQPYDPEVHGVHRPSRLTASGTPPRSRNHGADRQRGGSE

SEQ ID NO: 4541 - protein, 172 aa, Arabidopsis thaliana
  misc_feature (128)..(128): Xaa can be any naturally occurring amino acid
  unsure (1)..(172): unsure at all Xaa locations
RPTRPGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHRFDLLPNTILDFANSNXRALCGKNSQKNCVHGSDSTSSAEREIKIFFQGVVSRDNATQQHV

SEQ ID NO: 4542 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLVFRPERFEDGKAEGLFMIPFGMGRRRCPGETLALRTIGMVLATLVQCFDWEPVDGVNVDMTEGGGFTIPKAVPLEAVCRPRAVMRDVLQSI

SEQ ID NO: 4543 - protein, 357 aa, Yarrowia lipolytica CLIB122
MSSNPSFVLRKPLDLVFEDRPDPKIQDPHSVKVAVKKTGVCGSDVHYYLHGGIGDFIVKAPMVLGHESAGEVVEVGPEVKDLKVGDRVALEPGVPSRLSQEYKEGRYNLCPCMVFAATPPYDGTLCRHYIIPEDFCVKLPDHVSLEEGALVEPLSVAVHCNKLAKTTAQDVVIVFGAGPVGLLAVGVANAFGSSTIVCVDLVPEKLELAKKFGATHTFVPTKGDSPNESADKIRALIKGAGLSDSPNVALECTGAEPSIQTAVSVLATSGRLVQVGMGKDDVNFPITKCIVKEITVLGSFRYCHGDYPLAVQLVASGKIDVKKLVTNRFTFKEAEQAYKTAAEGKAIKIIIDGPEEE

SEQ ID NO: 4544 - protein, 489 aa, Yersinia pseudotuberculosis IP 32953
MPAQNPLQHQRQHDGIYHIGYFVGGKWSQAQEQFDVCNPATGELVARVAKSGKQETEAAIKAASEAFPAWRKTPAKQRAEILQRWYLLIMEHQQSLAELMVSEQGKPLKEALVEVAYAASFIQWFSEQAKRANGEIIPSAKEGARILATREPIGVVAAITPWNFPLAMLTRKLGPALAAGCTGLIKPANNTPLSAFALLALAEQAGVPAGVLNGVVGDTHAISDAIMASSDVRKISFTGSTNVGKTLMRNAAATMKRISMELGGNAPYIVFDDADLEAAVAGAMACKFRNAGQVCVCVNRFYIQDAIYDEFVNRLAAEVKKLKVGNGMDKDVNMGPLINLAGLEKVEEHVKDALEKGGRLLAGGHRHALGGNFFQPTVIADANEQMKVASEETFGPLAACFRFSTEAEVIQRANNTPFGLAAYFYTQNLQRVFRVSEALESGMIGVNECSVSTELAPFGGVKESGLGREGSVLGLDEFMEVKTLHLGNL

SEQ ID NO: 4545 - protein, 313 aa, Magnaporthe grisea 70-15
MSVPSFITAPEFEGGPPQGLSIPFRLRWSKTHPPKEPIVTFKGRTVLVTGANTGLGFEAAVKYAAFGADKIILAVRSIEKGEEAKKRIVERTGRDATDISVLKLDLGEYSSVKDFVSALHEVTPTLDVALLNAGLGNPTYEKSSAGWEMAVQVNVLSTALLAMLLLPLLRSSAAASGAKSHLTFVNSFAHTLVPRDFPLIEGSILKTATDESSWNASSSYNIVKLLAMASVQGFARMEAGEDQQRVIVNSVCPDLCETDLGRKFTGFISSIGKAIFYYLFALSAEEGARCLIGATALGPESHGRFWHHDFLYP

SEQ ID NO: 4546 - protein, 552 aa, Saccharomyces castellii
HHRTPSPHMKLNQPQVHSFQVDSNDTPTTISTLDDDQEKQQDVKRELKKRHISMIALGGTIGTGLFLGIARPLIIAGPIGALIAYLFMGTVVFSVTQSLGEMCTFIPVTASFTVFAQRFLSPAFGAANGYMYWFSWAMTFALELSVVGQIIQFWTMAVPLAAWISIVWVLLTISNLFPVRIYGEIEFWIASVKVLAILGFIIYGICIICGAGVTGPVGFRYWKNPGPWGMGIISSNVNEARFFGWVSSLINAAFTFQGTELVGITAGEAKNPRKTVPKAIKKVVFRILVFYIGSLLVIGLLVPYNDPKLQSNDSYVSSSPFIITIQNAGTKILPHIFNAVILITIISAGNSNVYIGSRILYGLAKNKAAPKFFTNTSKAGVPYVTVLFTSMFGSLAYMETTTGGDKAFTWLLNIVGVAGFFAWLLISCSHIRFMKALKQRGISRNDLPYKAMLMPWLAYYAVFFMVIIIVIQGFTSFAPKFKVANFFAAYISVFLFIIFWVAFQIWFKCRLVWKLQDVDLDTDRRDIEEEVWSDDVEDKNKNWWDRFWNYVA

SEQ ID NO: 4547 - protein, 453 aa, Xanthobacter autotrophicus Py2
MTSRTEFAREAEGRASVSAKVSLDLAKIAKERGIKYFLISYVDLFGGLRAKLVPASAIGPMQKEGAGFAGFATWLDMSPADPDLFAVPDPTSLIQLPWKEEIGWLAADLYMGGEEVAQGPRTVLKRQLAAAAALGYEVKTGVECEYFLITPDGKGISDTSDTAEKPCYDQSALMRRYDVIKDICDAMIKLGWGAYQNDHEDANGQFEMNWNYDNALLTADRHVFFKYMVKSIAEQHGLRATFMPKPFINLTGSGCHAHVSLWSKGKNAFSDPKGELGVSQLGYHFIGGLIHNADALCAITNPTVNSYKRINAPRTISGATWAPNTVTYTGNNRTHMIRIPDAGRFEFRLADGAANPYLLQAGLTAAGLDGIENQRDPGKRLDINMYTDGHKVKGAKRLPLNMLDALRALEKSRVLGERLGQPFVTGYLKLKNEEWNAYSRHLTQWERDNTLDI

SEQ ID NO: 4548 - protein, 182 aa, Musa acuminata
FGVVYRGELKDTNEIVAVKQLDRNGFQGNREFLVEVLMLSLLHHPNLVKLLGYCADGDQRILVYEYMPLGSLEDHLLDVSADAKPLEWHTRMKIAAGAAKGLQCLHETANPPVIYRDFKASNILIDEDYNAKLSDFGLAKIGPVGDKNHVSTRVMGTYGYCAPEYALTGQLTKMSDVYSFGI

SEQ ID NO: 4549 - protein, 513 aa, Magnaporthe grisea 70-15
MFNLISSLKVGAALVAAVWIWQRIMLYNHRRKIKRDSGCLPAAKFPDWDPLFGIGFTYHMVTEDILDFQIMKNTADCLEKYGNTFTSKAMGFNFIWTCEPENIKAVLSTQFDQFNNQGRSVGAEDFLGKGIFVSDGEHWQKSRALVRPNFARDQITDLVSVEERFQTLISLLPKDGSTVDLLPFMFDFTMDTSTHFLFGDSVKSLEANAHERSIGHHGQENLDEFSAAWDYAQNDMLSRFVLGPLRYVYKEKKAARCIKLVQDHVEKYVDEAIRYNSQVRAAGGDEKKEPEERYIFLRALAKQTQDRRMLRDELLNILVAGRDTTASLLSNMLHTMANRPDIWTKLKNEVAFLQGRIPTYEDIRNMKYMRWCINESLRLHTVLALVGKEASIDTTLPRGGGPDHKAPIFVAKGTFIAYSFLALHRRKDLFGEDAHEFKPERWETLRPGWNYLPFNGGPRICVGQQYALTEAQYVLIRFLQTFSAIESRDPEPWSIGNRMTTCPKNGVQVSLRC

SEQ ID NO: 4550 - protein, 445 aa, Escherichia coli K12
MGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 4551 - protein, 277 aa, Bacillus thuringiensis serovar konkukian str. 97-27
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLHNEVVTIPKSIKEHRIIENANIFDFELSSDDMKAIQALNEDHRVGPDPDNFNF

SEQ ID NO: 4552 - protein, 490 aa, Neorickettsia sennetsu str. Miyayama
MPLILCILDGWGVLPQDEYNAIYQARTPHYCTLLEKFPHSLLSASSLEVGLPEGQMGNSEVGHMTIGSGRIIYHDLVRINRELEKIDKNPQLNVFANKLKGKRCHLVGLLSDGGVHSHVAHINKISNYLTSRGVAVCIHAFLDGRDTAPKAAKRYITEENTRRIATLAGRYYGMDRDKNWDRTVEAYRVIVKPSKQQRIFEKADEAIEYYYSQGISDEFIPPSVIGDYEGAQDGDGLFIANFRPDRARQITSELIGKTSFCKDKIKFSEMMTMSQYFEESLPSLILRQQIKNTLSEIISGAGMHQLKIAETEKYAHVSYFFNGGKEAAFAREERILINSPRVKTYDLEPKMAALEVTDALIKAIKSKRFDFIVVNYANADMVGHTGNLSATIEAIETLDNCLGKLYKEACELNGYEMIVTSDHGNAECMYDHSTKLSNTAHTTNPVPFIVASQRVKHVNNGGLYNIAGTVLKLLGIEKPTELANDLICFE

SEQ ID NO: 4553 - protein, 163 aa, Triticum aestivum
  misc_feature (13)..(13): Xaa can be any naturally occurring amino acid
  unsure (1)..(163): unsure at all Xaa locations
PSFASGPLGQARXFAVMTGADAGISCVMSSARGVEDVQGSMAAAFGSGALFSIVSGMGTPNPVVNAITTGMAFAVFQGGFFIVGQKFSKTKTHNEDMNYSRARNMLSQLGLQNYEKNFKKGLLTDETLPLLNESALRDVNIPPGPRLVILEHIKREPGLTKSN

SEQ ID NO: 4554 - protein, 238 aa, Arabidopsis thaliana
  misc_feature (120)..(120): Xaa can be any naturally occurring amino acid
  misc_feature (135)..(135): Xaa can be any naturally occurring amino acid
  unsure (1)..(238): unsure at all Xaa locations
MASSMLSSATMVASPAQATMVAPFNGLKSSAAFPATRKANNDITSITSNGGRVNCMQVWPPIGKKKLETLSYLPDLTDSELAKEVDYLIRNKRIPCVESELEHGFAYREHGNSPGYYDGXRYWTMRKLPLFGCTXDSAQVLKEAEECTKEYPTASIRHHRFRQHPAKSQCISFHSPTRSPTPTRSIPPLLLAANPKTHPPIESIPRIFRSLLPPLASISGLKVCSPPAPISPSFLPPA

SEQ ID NO: 4555 - protein, 90 aa, Glycine max
MSSTSRAWTWTVAASVGVVEALKDQGICRWNSVMRSAQQHAKHNMKSLSQTKKLSSQSSVMASAKLKDEKAKKSEESLRTVMYLSCWGPN

SEQ ID NO: 4556 - protein, 101 aa, Zea mays
MEAARLPGLSITVEKNPPEARLLQLGVKSWPKWGCPPGRFPLKFDAALTCYLVKGRVRAAVKGSRECVEFGAGDLVVFPKGLSCTWDVVVGVDKHYNFDPS

SEQ ID NO: 4557 - protein, 396 aa, Thermococcus kodakarensis KOD1
MEFLGYLAVLLVVAKSIEWAFEKAEIHPIIAHVITGILLGPFALGIVKPGKEIEVLAQFGLIMMMLYMGLTSNFSAIAQNTKKATFVAVLGVAFSFILGFATVYLFGKGFSAAVFVGVTLGNTAIEVTSGVLVKERVNRRVSAILMGAAFADDILAVYLIGIITGMASGNFNAQSLLILTGKIFAFIVATLLISEYIFKRSRWFYSVVRNLNVFFTFTLILTFALAIISEWVGLNQIIGAYLAGLTISRLRERKDPLVVTRIKLNELIGDLQVVLTEFFMPLFFIYVGLMFNPPIKDINIFLILALYASAVLGKLIGCGLGSKLVGLPWEDSIAVGIGMGGRGSLELAILTFGLSTGLIDQSIFASVIMVSMLTALTTPIFFKAYLKRQRLKAGES

SEQ ID NO: 4558 - protein, 514 aa, Ralstonia metallidurans CH34
MTQPDLGVELERLVAPLPMWHGRLGQDAWQAIACVVANAGGRLVAVWGAERDPDAMATACVAYAMPHGLVWLELQLDGARAIPDLAGVFPCASRMQRAMTDLSGVSVEGAHDTRPWLDHGLWPPGARPLQSSGPGFAVAAGMLPADYAFLRVEGDGVHEVAVGPVHAGIIEPGHFRFSVVGEKVLRLEERLGYTHKGIERRFTELAPEEGYRLAGRVSGDSTVAYAWAYCMALESACRMTLPARAACLRALMLERERVANHLGDLGALGNDAGLAFGLAQFSRLREDWQRLSGQVFGHRLMMDVVVPGGVAIDTSAPALERLGRQCDEIERELHVLRAIYDEHAGLQDRFRGTGQITPQLAARLGLTGLAGRASGQAVDLRCDVAWLSYETLAVRMATQNVGDVAARVAVRFDEVIESLRLIRALCTGLPEGEIRGELRLPSVRAIGAGWVEGWRGEVLVALELGADDRVLRCHCHDPSWQNWPALEHAIIGNIVPDFPLINKSFNLSYAGHDL

SEQ ID NO: 4559 - protein, 174 aa, Brassica napus
MASINLSSSSPSTISLSRSRLSQTSTTTTLLHRITLPSHHPSSSFSIKTTSKVKASVISREDDLLSSYTNGSLVDEDSSSPAPANGFVAEDDDYELDLPTPGFSSIPEAIEDIRQGKLVVVVDDEDRENEGDLVMAAQLATPEAMAFIVKHGTGIVCVSMKDDDLQRLNLPPMV

SEQ ID NO: 4560 - protein, 364 aa, Photobacterium leiognathi
MALSSAKEIIDDIRQGRMVILMDDESRENEGDLIIASEMVTPEAINFMATHGRGLICLTLSKARCKTLNLPLMVQGNNDNFSTPFTISIEAAKYVTTGISASDRAKTVLAAVAPNAKSTDIVMPGHIFPLMAQDGGVLIRAGHTEAGCDVARLAGLEPSSVIVEILNEDGSMARRPQLEIFAEKHGLKLGTIADLIEYRTQQESHIERISEYELNTEYGIFTLVTYRDTIDNQAHFALCKGEIQAKAATLVRVHVKDTLKDILQVGLSQWSLEAAMQRIQTEDGVLVIISQQESPKTLFEKLDMYAKEQPNSPHSGIVQSRNIGLGSQILADLGVKKIRLLSNSNQGYRALSGFGLEVVEYIYD

SEQ ID NO: 4561 - protein, 479 aa, Haemophilus ducreyi 35000HP
MSRKLRRTKIVCTMGPATDRSNNLERIIAAGANMVRMNFSHGVPEDHIERANKVREIAARLGKHVAILGDLQGPKIRVSTFKEGKIFLNIGDKFTLDADLPRGEGDQQVVGLDYKNLPNDVVPGDILLLDDGNVQLKVISVEGAKVHTEVTLGGPLSNNKGINKLGGGLSAPALTEKDKEDIKLAARIGVDYLAVSFPQSSQDLHYARQLAEEAGLDAKIVAKVERAETVATEEAMDDIILGADVVMVARGDLGVEIGDAALVGVQKRLIRRARKLNRVVITATQMMESMIKKPMPTRAEVMDVANAVLDGTDAVMLSGETASGDYPVETVKSMAEVCLGAETMPSINISRHRMQGKFAAIDEAVAMSAMYTANHLESVSAIIALTHSGETAKLMSRISSGLPIYALSRNQQALNRTALYRGVTPVYYNEESRTIEGAKKGIALLKEKGYLMTGDLVLLTQGSESKDGGTNTCRILKVE

SEQ ID NO: 4562 - protein, 418 aa, Fagus sylvatica
MAIETKHPEAVPADETCSAKCSKQGEGLKQYYLQHIHEHQLQVRQKTHNLNRLEAQRNEFNSRVRMLREELQLLQEPGSYVGEVVKVMGKNKVLVKVHSEGKYVVDIDKNIDITKITPSTRVALRNDSYVLHLILPSKVDPLVNLMKVEKVPDSTYDMIGGLDQQIKEIKEVIELPIKHPELFLESLGIAQPKGVLLYGPPGTGKTLLARAVAHHTDCTFIRVSGSELVQKYIGEGSRMVRELFVMAREHAPSIIFMDEIDSIGSARMESGSGNGDSEVQDHMLELLNQLDGFESIKQIKVLMRTNRIDILDQALLRPGRIDRKIEFPNPNRESRFDILKIHSRRMNLMRGIDLKKIAEKMNGASGAELKAVCTEAGMFALTAERRVRLVTQEDFEMAVAKVMKKETEKNMSLRKLWK

SEQ ID NO: 4563 - protein, 789 aa, Fusobacterium nucleatum subsp. nucleatum ATCC 25586
MKFDKEEWKEKLEERLLEKFSVSLKDASPFEVYRALGETVMSFIAKDWYETKQEYSKTKQAFYLSSEFLMGRALGNNLINLGIDKEIQKFFKELGIDYNQIEDEEEDAALGNGGLGRLAACFMDSLATLNLPGQGYSIRYRNGIFNQYLRDGYQVEKPETWLKYGDVWSVMRPEDEVIVNFGHTSVRALPYDMPIIGYGTNNINTLRLWEAHSIVDLDLGVFNQQDYLHATQDKTLAEDISRVLYPNDSTDDGKKLRLRQQYFFVSASLQDIIKKFKKVHGREFSKIPEFIAIQLNDTHPVIAIPELMRILVDVEGVLWEDAWEIVKKTFSYTNHTILAEALEKWWIGLYQEVVPRIFQITEGIHNQFKNELANLYPNDINKQNRMQIIQGNMIHMAWLAIYGSHKVNGVAELHTEILKEHELRDWYELYPEKFLNKTNGITQRRWLLKSNPQLASYITELIGDAWIKDLSELKKLEQFMNDEKVLNKIWDIKIEKKEELVEYLRETQGIDINPKSIFDVQVKRMHEYKRQLLNIFQVYDLYQQLKQNPNMDFTPTTYIYGAKAAPGYKIAKGIIRLINDIAQIINADGDVKEKLKVVFVENYRVTVAEKIFPAADISEQISTAGKEASGTGNMKFMLNGAITLGTLDGANVEIVKEAGEENEYIFGMRVKDIDELRKKGYDPRFPYNNVTGLKQVVDALIDGKLSDLGSGIYREIHSLLMERGDQYFVLEDFEDYRRKQREINRDYKDKISWAKKMLKNIANAGKFSSDRTILEYANEIWNIKETKIK

SEQ ID NO: 4564 - protein, 368 aa, Medicago truncatula
MRLEISYYFLLDYNRETTDSYTIATAPNFVSILRGPSSIYSSFSNRSKSDLDIDGKTPFLSGLDGTTQSTWWEKRSTQNLVGEMPLGYGCSYTQTVFNGINVMAGVGLLSTPYTVKQAGWMGLVLMLIFASVCCYTATLMRHCFESREGLTSYPDIGEAAFGRYGRIFVSIILYTELYSYCVEFITLEGDNLTGLFPGTSLDIGGLHLDSMHLFGVLTALVILPTVWLKDLRVISYLSVGGIAATILIIISVFSVGTTVGFHHTGRVVNWSGIPFAIGVYGFCFAGHSVFPNIYQSMADKKQYTKALITCFVLCILIYGSVAVMGFLSFGDDTLSQITLNMPAGAFASKVALWTTVINPLTKYPFCIY

SEQ ID NO: 4565 - protein, 322 aa, Oryza sativa
MEPMSVDGGGGCGGLDTQIEQLMQCRPLAEQEVKALCEKAKEILMEESNVQIAHSMCTYNSAKTFSKYLHVLFHGNLPVKSPVTICGDIHGQFHDLVELFRIGGKCPDTNYLFMGDYVDRGYYSVETVTLLVALKITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 4566 - protein, 472 aa, Acinetobacter sp. ADP1
MTTKILPVIMAGGSGTRLWPLSRTQYPKQFLKLSPDGYTLLQATLLRLKNLDCADPLLICNEEHRFLAAEQMREIGISAKIILEPEGKNTAPAITLAALYQIQQAQDSDTIMLVLAADHVITEQDKFEQSITQALELAKLDKLVTFGIVPTHAETGYGYIEKGNSELNGFQVQRFVEKPDAATAQEYLESQKFLWNSGMFMFKADIYLNELQQHAQDIYNSCVASMQDTKADLDFIRIDKEAFKQCRSESIDYAVMEQTKDAVVVPLDANWNDVGSWSALWDIQDKDDQGNVIQGDVITVKSQNNYVFSESRLVSLLGVDNLVVIETKDAILVADKSKVQDIKKIVESIKEQGRTEHFCHREVYRPWGKYDSIDHAERYQVKRITVKPGQKLSIQMHHHRSEHWIVVNGTAKIHKGKESFLLTENQSTYIPLGEIHALENPGKVPLELIEVQSGSYLGEDDIVRFEDLYGRC

SEQ ID NO: 4567 - protein, 279 aa, Enterococcus faecalis V583
MITSLADTVTLNNGTKIPGMGLGVFQIPDEETAKVVEEGIINGYRLIDTAQIYGNESGTGAGIKAGLAATGLNREDLFVTSKVWNAHISYDETIQAFNDSLERLGLDYLDLYLIHWPGNNSYKESWQALETLYAEGKVKAIGVSNFQVHHLEDLLSYAKVVPVINQVELHPKLDQKEVRDFCEKHDIKVQAWSPLMQGQLLSNETILAIAENHNKSAAQVILRWDIQQDILLAVKSVHKERMISNAAVFDFELSAEEMAQINQLNESLRVGPDPDTFDF

SEQ ID NO: 4568 - protein, 175 aa, Oryza sativa
MAPSVMASSATSVAPFQGLKSTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4569 - protein, 443 aa, Roseovarius nubinhibens ISM
MTRDLAKYAKEKGIKYYMISFTDLFGAQRAKLVPAQAIADMQEDGAGFAGFATWLDLTPAHPDMLAVPDPEAVIQLPWNPELAWVPGNCVMGGKDLAQAPRNVLRRLIKEAADEGLHIKTGIEAEYFIMTPDGHAISDEYDTAEKPCYDQQAIMRRLHVVQEICDYMLDLGWGPYQNDHEDANGQYEMNWEFDDALATADKHSFFKFMTKSVAEKHGLRATFMPKPVEGLTGNGCHAHISVWDAPGDKAKRNVFATDKGEGPTGELGLSEQGKYFLGGIMKHASALAAITNPTVNSYKRINAPRTTSGATWAPNTVTWTGNNRTHMVRVPGPGRFELRLPDGAVNPYLLQAVIIAAGLDGIRTKADPGKRHDIDMYAEGHKVRGAPKLPLNMLDALREYDKDKQLKSMMGEEFSAAFLKLKHQEWNAYCRHFSEWERANTLDI

SEQ ID NO: 4570 - protein, 954 aa, Bordetella pertussis Tohama I
MSRAPDTHSDFIPRHIGPSDEDQATMLVAIGAASLDALIDEVVPPRIRSRAPLALPAARSETDVLQDLKRIAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMACRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLSLETGAATPAILAAADCARINLRQVDGARLAVSLDETVTLADLQALVNVFAAGLGKDEVALAPPQASLDGIPAAVRRQGPILSHPVFSSVQSETDMLRYLRKLADKDLALDRTMIPLGSCTMKLNATAEMIPITWPEFALIHPFAPASQTPGYRELIEGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDARGRLDPEAKVGPVSAAPYGSAGILPIPYVYIALMGAEGLRRATEVAILNANYIATRLRGHYPVLYAGRNGRVAHECILDVRPLKETSGISAEDIAKRLMDYGFHAPTMSFPVAGTLMVEPTESEGLAELERFIEAMIAIRAEIAQVESGERDRDDNVLRNAPHTAQMLLAEEWHHDYPRQQAAYPVASLRENKYWPPVARVDNAYGDRNLVCACLPVEAYA

SEQ ID NO: 4571 - protein, 371 aa, Acidobacteria bacterium Ellin345
MKKSKANFYPVILAGGRGTRFWPLSRKRMAKQLLPLNSDKSMIQETVERLSALAEKKNFWVVTNDDLLVPIAKQLRALPIKQLIAEPVGRNTAPAIGLAAFILERLDPSAVLGLFPSDHVTSKPEAFKKDIAKAVQIAAAGENIVVLGIKPTRPETGYGYIEVGEQYERGVMRVRRFTEKPNAEKAAEFVESGHYFWNSGVFVWGAKTLANALREHLRETAPFLEKIAASYGTKEFAKTFAKLYPKCENISVDYAVLEPRSAKGEKSSNIFCIPADWGWNDLGSWAALFEHRAAEQQLSEHENVLTSKGAFTHDAGGNFVHSPRKFIAVVGVKDLVVVETDDALLITTRQKSQDVGKVVKFLDEKKLKNLV

SEQ ID NO: 4572 - protein, 6889 aa, Ralstonia solanacearum
MSKNDQTLPRDPDTLVALLESLAATRPDDTAYVFLQDGDEGESRMTYAELHDAARRVAVHLLGNGCGQDDPVLLIFNPGLDYICAFFGCLYAGAIPVPAYPPAHARRLERLQAVAVDAGARFALTVSEELSRIASFETQQGKRLPVERWLAIDRADSDAGDWTDPGLDGSRIAFLQYTSGSTGAPKGVMVTHRNLFANVAAMTAEGRMGRDEVMVYWLPPYHDFGLIGGILQPLVLGCTVVLMRPAAFLLNPYRWLKAITDYRATVAGAPNFAFDLCVRSITPAQRATLDLSRLRVLASGAEPVRPGTLEKFTAAFAPHGFNPAAWFAAYGMAEATLLIAFGWAIRFQGQPRCLPFSRLALQKGMAVAADDEADRIALASHGSALTGHQLAIVDPETLRRCEPGRVGEIWVSGPSVAQGYWRRDEDSRRSFAGEMAEPADGERYLRTGDLGFLHAGELYICGRLKDLIILNGLNIYPQDVELAAFESHARLRENGTIAFAVDRDDTEQLVIVQELEFRQPVEPGMFECMASAVSMNVGVTPDVIVLVKAGAIPRTSSGKIRRQQCRADFLADRLPAMARWDRPVLAASPVPVAPGAPVLAAAREPVAVSAAVVEARLRAELAARLGLDAEAIDREQPFAFYGLDSMSAVQLAEALSVWMRVTVAPVVFWEHPNIARLAGFLAELSAAGQGDRHPAEAAPDAPAQAADAPIAIIGLGCRFPGADDADAFWDALDGQVDAIGAVPQARRAAGTFDEPRAELPSQVRLGGFLDRVDAFDAAFFSISPLEAARMDPQQRLALEVAWQALEDAGIAASGLAGSTTGVFIGISTHDYENLQDRAGSELSVYSATGNAGSIVANRLSYCLDLRGPSLAIDTACSSSLVAVHAACQSLRDGESTLALAGGVNLVLSTLSSEPFARAGMLSPDGRCKAFDASANGYVRGEGCGVVVLKRLSDALRDGDPVRAVILGSAVMQDGRGNGLIAPNGSAQAAVVRQALARARLRPEQIGYIEAHGTGTALGDPIELNALKSVFAHAPEAGRCAVGSVKTNIGHLEAAAGVASLIKVVLALEHETLPANLHYREPNPHCALDGSALSIVSRSQPWPGNAGRRHAGISSFGFGGTLAHMIVAQAPPAATAHGAQWPWHLLSLSAKTAPALEAMTEAVAGQLRDLPDAALADAAYTHQAGRNAFAWRRMLVARDREDAAEALRARDPRRVFTAQVRPAVPAPVVFMFPGQGAQQVGMARELYQEIAAFRAVVDRCAQVLRERAGFDLIQSLYGDGDPEASHLALTRTEAAQPALFVIEYALARLWMDWGMKPAALIGHSVGEYVAACLAGVFSLDDALVLVAERGRLMQSLPAGAMLSVALDEASLRAQLDGTLALAAVNGRQRCVVAGETTAVAALERRLDAQGISHRRLATSHAFHSHMTEPILPAFADSVARLTLRAPAIPFVSNLTGAWIEPAQATDPGYWAAHLRGTVRFADGLQTLMQGGPHAWIEVGPGQTLSALARPCAGDALVLPSLGGGEGPKSDLAVLLGSAGQLWLAGQALDWRALYAGQQRRTLRLAPYPFQRERHWLDAPAAPQQDAQASVEPSRAVTSMPVAAAMSSSVSNSASRAQAIQGALRGMVAKMLHADVARVDPDLPLLELGADSLMMVQAIGSIEQTYGVTVTVRQLFEELTTIAAIADYVDRQMPREARLEAAAEAPATVPAAAVMPMPAPAPAAPVAAIAVDARPDAVPPLAAIPALPQSSLERLLSQQLDALSQLTARQLALFQGGTVAATAGGPASVAGETSPVVPTVMPAAVPVVAPAPASTAAPGGTHKPYVPYQPVRVTAKADPFRDLSARQRAYLDGFVARYTERTRGSKALVQRYRPVLADNRVSAGFRFSTKEMLYPVVSERSEGAYLWDPDGNVYIDLTMGFGVNLFGHRPAFVQEALDAQLKTGLELGPQTRLAGEVAELVTRLTGLERVAFCNSGTEAIMLALRLARTVTRRDKIVVFAGSYHGWSDDTLMVADGAGTVAMAPGLQPGASAHTIVLDYGAPESLARIREHAHELAAVLVEPVQSRRPHWQPREFLHALRELTREHGIALIFDEIIMGFRLHPGGAQAWYGIEADMATYGKVIGGGMPAGMVAGSAAYLDAVDGGQWRYGDASYPQADTTFYAGTFCKHPLMLVAARAVLQRLAQEGPALQETLNARTAELVRRLNGVFADARVPVRAVHCGSSFRLLEASPSIDLLYYHLLAGGLYIWEGRGMFLSTAHSDADVDRVVEIFADSVRAMLDGGFFEDGAPTPPSGGGGRSPFAAARVGGPASTDAPVAPALAEAAVARLSAAPVPPATGGGIRFGISFFGHYASGYDAQKYRLLFEAARYADAGGFSSLWLPERHFHAFGGLSPNPSVLSAALARETSHIQLRAGSVVLPLHHPVRVAEEWSMVDNLSQGRVGIACASGWHPNDFVFAPEAFGSHRELMFQRIEQIQALWRGEPLRVRDGSSREIEVKLFPMPRQPELPIWITIVGNPDTYRRAGEIGAGILTNLMGQTVEALECNLALYRQALVEHGHGVERSRVSVLLHTFVCEDAAEARAVARAPFIHYLRSSVGLFQNMVDSLGLQADVSTLSEDDRDYLLSVAYERYVEHSALIGSPATCRALVERLQAIGVDEIGCFIDFGVDPDTVLGRLDQLALLKQSFETAAVDDDAAERYPLVPAQKGIWFECQISHEAALSYNTTTVLGLRGALDHAALARALQQVVDRHAALRSVVEADGEHQRVLPAVEVGLPLVDFSREADRDAAIGQWFVDNNHRPMDPGHGPLVRACLLRKGEAEHLLAITFHHVIIDGYSQEIVLQELAACYRAACRGGAPGLPAASPFREQVERHQAYLRSDRYQQDRAYWRGQFGSLPPSLELSGRHARPSAPSHRARRHHLTIDGERYARLQQLSRKLGGTLFMTMLAGVAVLLQRLSGQAQMVIGVPMVVGRAEGSEASLVGCTLNLVPVRCDGSGDPSFAEFLGRIKRSVLEAHAHADYPFGHLLRDLDLRASQRRPLAPVLFNLNRSLALPQFDALQAWLEQSPISFSPDDLTIDVMQLPDRLQVMFQYQEVLFEHEAIERMAAQFVQLLDGIVADPACSIGRLALLSAEERRQIVDVWNAGEPVPEPSETLHAVFEAQVRRTPEAIAVEHEGWRVSYAELNARANRVAHALIGLGVGPDARVGLCAERSVELVIGLLGILKAGGGYVPLDPSYPRDRLAYMLEDSAPVAVLAQSNTREPLGALSVPVLDLENPLEGEAEHDPQVTGLEPNHLAYVIYTSGSTGQPKGVLVEHRQVARLFTSTQPWFGFGAEDVWTLFHSFAFDFSVWELFGALLHGGRLVVVPKLTARSPQAFYALLCEAGVTVLNQTPSAFRQLMAAQQEAPAARHRLRQVILGGEALEVGALRPWYERAENAGTQLANMYGITETTVHVSYRALEAADAQGTGSPIGRRIPDLRVYVLDAHGEPVPVGVTGEMYIGGAGVARGYLNRPELTAERFVVNPFHGEGRERMYRTGDLGRWLPDGSLEYQGRADAQVKLRGFRIELGEIEASLSQCAGVREAVVTVREDVPGEQRLVAYYVSGEAIEAQALREQLQGSLPAYMVPAAYVRLAHLPLTSNGKLDRKGLPAPEGHAYASTAYEAPQGEVEQTLAGIWQTLLGVERVGRHDDFFALGGHSLQAVRLVTQVRVQLGAELGLTALFAQPSLSAVAQAIVRGQGSALQAITAADRSEALPLSFAQQRLWLLAQMEGGSEAYHIPVGLRLKGELDEDALGRALDRIVARHEALRTRFEVREGQAIQRVASADVGFALDRVDLQGQADREQTLAALSEREANTPFDLEQGPLIRGCLVKLGEQEHVLLITMHHIVSDGWSQGVLARELGALYEAYRSGGEDPLPALPIQYADYAVWQRRWLEGGELQRQGAYWEQALAGAPTLLSLPTDRARPAQQDYAGGSVEVVFDETLSADLKRLSQRHGTTLFMTVLAGWSALLSRLSGQEEVVVGSPVANRTRSEVEGLIGFFVNTLALRVNVGSATVSELLDRVKAKVLEAQAHQDLPFEQVVERVKPVRSLSHSPIFQAVFSWHNTEAVDLSLRALSLESLARENATAKLDIQLELAEADGRIVGTLNYATALFERSTAQRYADYLQRMLQAMVADDGQQVGRIALLGEAERAQVLQAWNATERAWPAATLPALFEAQVMRTPDAVALKHADQQVSYRELDARANRLAHHLRELGVAADVLVGLCVDRSIEMIVGLLGILKAGGAYVPLDPDYPQARLAYIFQDAMLSVLVSKRALAQRLPIAWTQVVELDDAEPAWADYPPTPPQVQGEPGQLAYVIYTSGSTGQPKGVAVTHQGVASLVYSQCERFGVSSQSRVLQFASISFDAAVSEIGMGLLCGACLVLAPAQALMPGAALTHLLDRERITHVTLPPAVLALMPEQALPADCHLIVAGEACPPSLVRLWSEGRTMINAYGPTEATVCATMSRALTAQDAPSIGGPIGNVRVYVLDAYLQPVPVGVTGELYIAGSGLARGYWQRAGLTAERFMANPFALGERMYRTGDLGRWLPDGSLEYQGRADAQVKLRGFRIELGEIEARLSQCAGVSEAVVTVREDAPGEQRLVAYYVSGEAIEAQTLREQLQSRLPEYMVPAAYVRLEHLPLTPNGKLDRKGLPAPEGQAYASTAYEAPQGEVEQTLAGIWQTLLGVERVGRHDDFFALGGHSLQAVRLVAQVRTQLGAELGLTELFAQPSLSAVAQAIVRGQGSALPAITVADRSGPLPLSFSQQRLWFLAQMEGGSEAYHIPVGLRLKGELDEDALRRSLDRIVARHEALRTRFVTEEGQAVQRVASADVGFALDCVDLQGQADREQALATLSEREANTPFDLAHGPLIRGRLVKLGEQEHVLLITMHHIVSDGWSQGVLARELGSLYEAYRAGNADPLPALPIQYADYAVWQRRWLEGGELQRQGTYWEQALAGAPTLLSLPTDRARPPQQDYAGGSVEVVFDAELSTGLRTLSQRHGTTLFMTVLAGWSALLSRLSGQGEVVVGSPVANRTRSEVEGLIGFFVNTLALRVEVGGATVSELLERVKAKVLEAQAHQDLPFEQVVERVRPVRSLSHSPVFQAALSWLNTEAVGLSLELEGLTIEGVDAGQAAAKFDLTLELRETSEGLAGSLDYATALFDRATIERYLGYLHRLLKAMAADDSQEVNRIALLDEGERTQLLESWNETKAPYPRASTIHGLFEAQVRRTPEAIAVVHEGQQVSYAELNARANRVAHALRRLGVGPDARVGLCAERSVELVVGLLGILKAGGGYVPLDPSYPQDRLTYMLEDSAPVAVLTQSNTREQLGALSVPVLDLDGPLEEAEHDPQVTGLEPHHLAYVIYTSGSTGRPKGVMNEHRGVVNRLWWAQQTYRLDASDRVLQKTPFGFDVSVWELFWPLLAGARLVMARPEGHKDPAYLAATIEQAGITTLHFVPSMLQLFLDQVEAGRCQGLRRMLCSGEALSHALQQRSLARFPHSELHNLYGPTEAAIDVTAWRCNAEIHPGVVPIGRPIANTQMYVLDGHQQPVPLGVTGEIYIGGIGVARGYLNRPELTAERFVVNPFHGEGRERMYRTGDLGRWLPDGSLAYQGRADAQVKLRGFRIELGEIEARLSQCAGVSEAVVAMREDVPGEQRLVAYHVSDEAIEAQTLREQLQASLPEYMVPAAYVRLEHLPLTPNGKLDRKGLPAPDGQAYASAAYEAPQGEVEQTLAGIWQTLLGVERVGRHDDFFALGGHSLQAVRLVAQVRTQLGAELGLTELFAQPSLSAVAQAIVRGQGTALPAITVADRGEALPLSFAQQRLWFLAQMEGGSEAYHIPVGLRLKGELDEDALRRSLDRIVARHEALRTRFEVQEGQAVQRVASADVGLTLDWADLSAEAASEHQLGLLAEAWARAPFDLEQGPLIRGRLVKLGEQEHVLLITMHHIVSDGWSQGVLARELGALYEAYRAGNSDPLPALPIQYADYAVWQRRWLEGGELQRQGTYWEQALAGAPTLLSVPTDRARPPQQDYAGGSVEVIFDETLSAGLRKLSQRHGTTLFMTVLAGWSALLSRLSGQEEVVVGSPVANRTRSEVEGLIGFFVNTLALRVEVGSATVSELLGRVKSRVLEAQAHQDLPFEQVVERVRPVRSLSHSPVFQAALSWLNTEAMVLKLDGLTIEHLADESYTAKFDLSLALREHDGRIAGSLDYATALFDRETIERYLGYLHRLLAAMVENDSQQVSRIGLLDEGERAQLLESWNETKAAYPDASTIHGLFEAQVRRTPEAIAVEHEGQQVSYAELNARANRVAHALRRLGVGPDARVGLCAERSVELVVGLLGILKAGGGYVPLDPSYPQDRLAYMLEDSAPVAVLAQSNTREQLGALSVPVLDLDRPLLEEAEHDPQVTGLEPHHLAYVIYTSGSTGRPKGVMVEHRGLSNLLDWYLEDLGLRSDDTVLLVSSYSFDLTQKNILGPLLAGGRLHLAGPFVPDALVAQIRREGITHINLSPSAFHALIDAAGAEGLGGLRRVVLGGEPIQPARLQGLPEPRPRFINSYGPTECSDVVAWHALDAELDRYRAASVPLGRSVRNVRLYVLDAHRQPVPTGVAGEIYVGGAGVGRGYRNLPELTGACFLADPFHGEGQARMYKTGDLGRWLANGSLEYLGRSDDQVKLRGFRVELGEIGASLARCDGVREAAVLAREDAPGEPRLVAYYVAEPGAAVEASALRRHMQAQLPEHMVPAAYVRLEHLPLTPNGKLDRRALPAPAADAYARRRYVAPQGDVETMLAELWQDLLGVERVGRHDDFFELGGHSLLAMSLMARMDELGLSADVRVLFTQPTLAGLAAEVEPMEIVL

SEQ ID NO: 4573 - protein, 390 aa, Lactobacillus plantarum WCFS1
MMNTNIRIQQIQVSGIRRFDEAISQIPDIIRLTVGEPDLPTPSHVKKAAIQSIHNDWTHYSPLMGFAALQDAASHYFQQKYQLTYAPEQIIATVGASEAVATTLLTLLNPGDTVLLPTPAYTNYQPVVDIANAQLAPIDTTATGYKLTPSALQAALDDHRHDHVKALILNYPTNPTGVTYTDDELWALQAVIATAGIYVISDEIYSELTYEQPHTAFATLYPSKTITINGLSKSHAMTGWRLGFIMAPSNLITEMKKTHQYLVTSTSSITQAAGIEALTHGLDDGSEMRGVYQTRRDYVVKRLSEIGFNYIYPTGAFYIFVQLPQDFQGTSWDFATRLAHEAQVAVVPGSAFGTSGEGWFRISYAASQSALREGLNRLALWRAQTTTQED

SEQ ID NO: 4574 - protein, 475 aa, Prunus armeniaca
MSTLKARSVQARASDGDLENLVPSKPQGKSSGTVFPFVGVACLGAILFGYHLGVVNGALEYLSKDLGIAENAVLQGWVVSALLAGATVGSFTGGALADKFGRTRTFQLDVIPLAIGAFLCATSQSVQTMIVGRYLLAVGIGITSAIVPLYISEISPTEIRGALGSVNQLFICIGILGALVAGLPLAANPLWWRTMFGVAIVPSVLLALGMAASPESPRWLFQQGKISEAEKAIKTLYGKERVSEVMHDLTSATQGSVEPEAGWFDLFSSRYWKVVSVGAALFLFQQLAGINAVVYYSTSVFRSAGITSDVAASALVGAANVFGTAVASSLMDRQGRESLLLISFGGMAASMLLLSLSFTWKVLAPYSGPLAVAGTVLYVLSFSLGAGPVPALLLPEIFASRIRAKAVSLSLGMHWISNFVIGLYFLSFVTKFGISSVYLGFAGVCLLAVLYISGNVVETKGRSLEEIERALSVST

SEQ ID NO: 4575 - protein, 268 aa, Glycine max
MVTKLVQPPMTDSHVSPLIYRTMNVMKLQNFVPARNHPRINTSRFGERPLWFRPITIIKVAEHNSGSGLVELEALAQKKRELYQAVEGINRGIFGIPSTKKSEIESLVKQLESLNPTPFPTLELEKVAGCWRLVYSTISILGSKRTKLGLRDFISLDDFFQSIDISKSKAVNVIKFSARGLSLLSGQLSIEASFRISSSTRVDINFENSTITPDRLMNVFRKNYDLLLGVFNPEGWLEITYVDETMRIGRDDKSNIFVLERFDDNNNM

SEQ ID NO: 4576 - protein, 525 aa, Lolium rigidum
MATRALQMLREASPWSLAGAAAAMALLWLAAWIVEWAWWTPRRLRRALQAQGLRGTQYRLFTGDVPENARLNREARSKPLPLGSHDIIQRVQPMFSNVIKENGKFAFTWFGPTPRVMIPDPELVREVLSNKFGHYGKQKSSRLGKLLANGLANHQGEKWAKHRRILNPAFHNEKIKRMLPVFATCCEEMITRWDNSMSTQGSSEIDIWPEFQNLTGDVISRTAFGSNYQEGMKIFQLQGELAERLIMAFQTIFIPGYWFLPTKNNKRMRAIDCEIRTILRGIIGKKDKAIKNGEAISDDLLGLLLESNMRESNGKADLEMSTEEIIQECKLFYFAGMETTSVLLTWTLILLSMHPEWQEKARDEVLYHFGRTTPDFEHLSRLKIVTMILYEVLRLYPPITILTRRTYKAMELGGIKYPAGVNLMLPILFIHHDPNLWGKDASEFNPERFADGISNAAKHPGSFFPFGGGPRICIGQNFALLEAKMALSTILQHFSLELSPSYTHAPYTVITLHPQHGAQIRIKKI

SEQ ID NO: 4577 - protein, 298 aa, Zea mays
MAAAPSSLASSHLSPIAAVSTPAVPHQLRIGCSRRRAQRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 4578 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKVWVIGSYGGRARQDLPKVVKLAESGIFNLTNAVSSKYKFEDAGKAFQDLNEGKIVSRGVVEIL

SEQ ID NO: 4579 - protein, 164 aa, Clostridium perfringens
LEDAQSIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAYRN

SEQ ID NO: 4580 - protein, 151 aa, Clostridium ramosum
IAETKAFVEAVDAKVSDSADWGIATPYLALQAAKEGTKKLLVAAENCHFKDSGAYTGEVSVEMLKEIGVEWVILGHSERRQYFGETDETVNAKMLQVLKNDMTPIVCVGETLEEYEAGTTKDVVKTQTVAAFKDVCPKCAGRTVIAYEPIW

SEQ ID NO: 4581 - protein, 453 aa, Mycobacterium sp. MCS
MKTLHDKQDDHARLAAELADDGVQFAMAAWVDVTGRPKSKVVPIGHLPDMLAGSERYTPRGIGRLGEMNPAEDECVGLPDPDTMRILSWDPRIALFHADLVLGDAGEPFENCPRSALKGVIAKARDMGFAMNLGVETEFYLFRTSALPELTPRFASSVIEPTPAYDARAVIDSLEFFSEVSAHMEAAGYGLYSFDQEGGEGQYELDFSYTDVLSMCDRLTYMRLMLPALAQKVDATVSFMPRPETRSWGSGAHMNMSLVSTTTGDNVFVDPDGSWSKTAMSFAAGVLRHAPALSALTCPTVNSYKRLTPKLADGSVSWAPVWARYGTNNRSCMLRLPGNRPAIENRSVDMMANMYLASAFTLAAGLEGIELGLDPGEPVTDDASDWEASAGGAGERLPRTLLEAIDAFATDPLVATTFPAGFVRDYLAMKVDEWNGYHSVVTQWEVDRYLLDV

SEQ ID NO: 4582 - protein, 157 aa, Triticum aestivum
MQASRARLFKEYKEVQREKSADPDIQLICDDSNIFKWTAVIKGPSETPFEGGVFQLAFSIPEQYPLLPPQVRFITKIFHPNVHFKTGEICLDILKNAWSPAWTLQSVCRAIIALMAHPEADSPLNCDSGNLLRSGDIRGYQSMARMYTRLAAMPKKE

SEQ ID NO: 4583 - protein, 129 aa, Zea mays
GRGFLALVVSDFWSGGPPAAQAPPLHGSTNAPFCQPQPTPLNGRRSPPTPSRRTVADQRGGAGAGRRADDPGLLKRAFDRVFRFVRLAEFEIFFVLFFLIAFFLFKDLMARPQYNQLFVKKPDLDDSWP

SEQ ID NO: 4584 - protein, 376 aa, Roseovarius nubinhibens ISM
MSEIVQVSEAARAMRDAGHDVIALSTGEPDFPTPPHVVEAAHRAAVNGDTNYTPTGGTAKLRATVAEGAGVEPANVVISTGAKQSIANAMLATLDPGDEVVMPVPFWTSYADIVRMAGGVPVLVDCPMEAGFRLTPAQLETAITSRTRWLMLNAPSNPSGAVYSAEDYAGLAEVLERHPHVWIMADEIYEHLSFVPFVSFRETVPGLRDRTLVINGVSKAYSMTGWRVGWGIGPAPLIKAMTAVQGQVTSGGSSISQAAAVAALTGDQSLLAERNAAMKARRDRVVAALDAMPGVSCLVPDGAFYAFPNIEGAIKAGGFDEDGVFCKALLEAEALALVPGRAFGMPGHLRLSFAYADALLDEGLARMGRFVAGLGA

SEQ ID NO: 4585 - protein, 233 aa, Pisum sativum
MASHLCKSASRAARSLLSASFHSQGRAVAAAAAVASIRKVPVFAPNYRRTGSGNGPSSWIAGALALPAAAYMLQDQEVHAAELERTFIAIKPDGVQRGLISEIISRFERKGFKLVGIKVLIPTKQFAQQHYHDLKERPFFNGLCDFLSSGPVIAMVWEGEGVITYGRKLIGATDPQKSAPGTIRGDLAVVVGRNIIHGSDGPETAKDEIKLWFKPEELVSFTSNSEKWIYGDN

SEQ ID NO: 4586 - protein, 470 aa, Yersinia pestis biovar Medievalis str. 91001
MKKTKIVCTIGPKTESEEMLTNLLNAGMNVMRLNFSHGDYAEHGQRIKNLRAVMAKTGKKAAILLDTKGPEIRTMKLEGGKDAALVAGQTFTFTTDQSVVGNDKIVAVTYPGFAADLKIGNTVLVDDGLIGMEVIEVTEHTVVCKVLNSGDLGENKGVNLPGVSIQLPALAEKDKGDLIFGCEQGVDFVAASFIRKRSDVLEIREHLKAHGGEHIQIISKIENQEGLNNFDEILEASDGIMVARGDLGVEIPVEEVIFAQKMMIEKCNRARKVVITATQMLDSMIKNPRPTRAEAGDVANAILDGTDAVMLSGESAKGKYPLESVTIMATICERTDRVMPSRIESLNDNRKMRITEAVCRGAVETAEKLEAKVIVVATGGGKSAKSVRKYFPTATILALTTNEMTAHQLILTKGVITQLVDEIASTDDFYRLGKEAALASGLAQKGDVVIMVSGALVPSGTTNTSSVHVL

SEQ ID NO: 4587 - protein, 525 aa, Lolium rigidum
MATRALQMLREASPWSLAGAAAAMALLWLAAWIVEWAWWTPRRLRRALQAQGLRGTQYRLFTGDVPENARLNREARSKPLPLGSHDIIQRVQPMFSNVIKENGKFSFTWFGPTPRVMIPDPELVREVLSNKFGHYGKQKSSRLGKLLANGLANHQGEKWAKHRRILNPAFHNEKIKRMLPVFATCCEEMITRWDNSMSTEGSSEIDIWPEFQNLTGDVISRTAFGSNYQEGMKIFQLQGELAERLIMAFQTIFIPGYWFLPTKNNKRMRAIDCEIRTILRVIIRKKDKAIKNGEAISDDLLGLLLESNMRESNGKADLGMSTEEIIQECKLFYFAGMETTSVLLTWTLILLSMHPEWQEKARDEVLYHFGRTTPDFEHLSRLKIVTMILYEVLRLYPPITILTRRTYKAMELGGIKYPAGVNLMLPILFIHHDPNLWGKDASEFNPERFADGISNAAKHPGSFFPFGGGPRICIGQNFALLEAKMALSTILQHFSLELSPSYTHAPYTVITLHPQHGAQIRMKKI

SEQ ID NO: 4588 - protein, 344 aa, Helicobacter pylori 26695
MILKRVTEALEAYKNGEMLIVMDDEDRENEGDLVLAGIFSTPEKINFMATHARGLICVSLTKDLAKKFELPPMVSVNDSNHETAFTVSIDAKEARTGISAFERHLTIELLCKDTTKPSDFVRPGHIFPLIAKDGGVLARTGHTEASVDLCKLAGLKPVSVICEIMKEDGSMARRGDKFLSDFALKHNLKTLYVSDLISYRLENESLLKMFCQEEREFLKHQTQCYTFLDHQQKNHYAFKFKGAKTHDLAPLVRFHPIKEDFDFLTTDAFEVFFKALEYLKHEGGYLIFMNTHSKENNVVKDFGIGALVLKNLGIKDFRLLSSCEDRQYKALSGFGLKLVETISL

SEQ ID NO: 4589 - protein, 453 aa, Bacillus cereus G9241
MIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGRLEDLKFKTPLYPLVPILGFGLYDIILISLIFIPEQRLGIYCTVPFIIFCYTYYHFKVKKRISTNTQSETKISETM

SEQ ID NO: 4590 - protein, 473 aa, Prochlorococcus marinus str. MIT 9313
MGKSPQDVLRQIKDEGIELIDLKFTDLHGKWQHLTVCSDLIDEEAFANGLAFDGSSIRGWKAINESDMDMVPDASTAWIDPFYRHKTLSLICSIREPRSGEPYARCPRALAQKALGYLAGTGLADTAFFGPEPEFFIFDDVRYNSGEGGCFYSVDTIEAPWNSGRIEEGGNLAYKIQLKEGYFPVPPNDTAQDIRSEMLLLMGQLGIPMEKHHHEVAGAGQHELGMKFAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSQGNRSAAVRIPLTGPNPKAKRLEFRPGDALANPYLAFSAMMMAGVDGIKNQIDPGDGFDEDLFELPEERLASIPTVPASLNGALEALNADKNYLMEGGVFTEDFIDNWIDIKYEEVQQLRQRPHPHEFTMYYDA

SEQ ID NO: 4591 - protein, 546 aa, Staphylococcus aureus subsp. aureus NCTC 8325
MSKEIDWRKSVVYQIYPKSFNDTTGNGIGDINGIIEKLDYIKLLGVDYIWLTPVYESPMNDNGYDISNYLEINEDFGTMDDFEKLIKVAHQKDLKVMLDIVINHTSTEHEWFKEARKSKDNPYRDYYFFRSSEDGPPTNWHSKFGGNAWKYDSETDEYYLHLFDVSQADLNWDNPEVRQSLYRIVNHWIDFGVDGFRFDVINLISKGEFKDSDKIGKEFYTDGPRVHEFLHELNRQTFGNTDMMTIGEMSSTTIENCIKYTQPERQELNSVFNFHHLKVDYVDGEKWTNAKLDFHKLKEILMQWQRGIYDGGGWNAIFWCNHDQPRVVSRFGDDTSEEMRIQSAKMLAIALHMLQGTPYIYQGEEIGMTDPHFTSIAQYRDVESINAYHQLLSEGHAEADVLAILGQKSRDNSRTPMQWSDDVNAGFTAGKPWIDISENYHQVNVRQALQNKESIFYTYQKLIQLRHTHDIITYGDIVPRFMDHDHLFVYERHYKNQQWLVIANFSASAVDLPEGLAREGCVVIQTGTVENNTISGFGAIVIETNA

SEQ ID NO: 4592 - protein, 526 aa, Dehalococcoides ethenogenes 195
MKKVLVSDALSATGLSPLKEIAQVDVKTGLKPEELVSIIGEYDALLVRSQTQVTADIINAGKKLQVIGRAGVGVDNIDLKAATGNGIIVVNAPTGNTISATEHTLALMLSMARHIPRANASLKSGQWKRNEFVGSELKGKTLGIVGLGNIGSEIAKRALALEMRVIGYDPFISMERAKKLQVELVPFEDLLKQADFITLHVPMTGQTKGLIGPKELEMMKPTVRLINTSRGGIIDEEALAAAIREKRIGGAAIDVFSKEPCTESCLFECDNIIVTPHLGASTAEAQELATSDVVKQVIDVFEGRPARYAVNAPYISAESLPVVGPFMPVARTVGSLVSQLTDGHMKNVTIKYCGELAAYDTTALKALVLGGILEHISEERVNVVNADIVAAQRGLGVTEQKESACQNFSSLITVTIDTDNGKSNTVAGSLVRGDVHIVRLNDYWIDIVPTGGYFLFADHIDRPGLIGAAGKITGDADINISYMHLSRQKARGQALMILALDEPLPEKQRQQLLSLPDVQTVQVVKI

SEQ ID NO: 4593 - protein, 149 aa, Clostridium difficile
WKMHKTIKEALEFVNEVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLKDDL

SEQ ID NO: 4594 - protein, 152 aa, Clostridium butyricum
KMHKTVDEAVKMIEELKALVKDATCDVVVCPTFVCLDAVKKAVAGSNIKVAAQNMHFEESGAFTGEVAPGMLEAMGIDYVVLGHSERREYFNETDEALNKKVKAAFAHNITPILCCGETLEQRENGTTNAVVGAQIKADLEGLSKDLAEGVV

SEQ ID NO: 4595 - protein, 99 aa, Triticum aestivum
MAGKLYQLMARLHLAKGRASADVPKGHFAVYVGEQRKRFVIPTAYLRHPSFLVLLKRVEDEFGFDHRAGGGLTIPCSEGDFADIVGGCSSSSSPAVDYH

SEQ ID NO: 4596 - protein, 1239 aa, Ustilago maydis 521
MSSSQRPVVQPIPPFKGAPLQATDVQNRRPTAAEAYVALANRKAGANVVSTRATGCENHRPSQHQPTSHHASQRQQPAPAADRRVQQSQPSERPKPASRLEREKKRHHNDPKNIGHWRLDKLIGQGASGRVRLAIHDQTGQKAAVKIIPRTLINASRMSLRDADVKANKMILGIEREIVIMKLIEHPNLLGLWDVYETSKDLFLIMEYVAGGELFDHLVAQGKLSPRDARGYFRQIIFGMDYCHRFNICHRDLKPENLLLDETKKIVKVADFGMAALQPTEKMLETSCGSPHYASPEIVSGKRYKGTASDIWSCGIILFALLCGRLPFDDPNIQQLLGKVRAGKFIMPEWLEPASKDLIWRMLEVDPEKRIKMADIMRHPWFTNNGTESSVNPVSTSLDSLQMEELTLDTIDIDILGNLKTLWFELSEQDIIKELLAPGPSWQKTFYTLLVAHRENHSADDEDDMNDDILDEQIVTASAVPAHALLSTTSAAKTLEKPRPRRTSDAAGATSAPASPRLESVEMDRRHSTPEKGSVYHTTSRRPDNVTPPKVASPHVRPANPSPRLRPSPLDSPASTLDSAFVSASKLKVASPTKPRALGSSHGADKSGYVLPQISLQTASPQRNERPAVDLQRRNTSPTKPNTVGVTAPLSARIALANMYDAPTLSHTATASCGSTSSTASSTVSVSAARNRANRGSGSEMMPPLALPGRASSRPVSPTKSTFGAQATLPPQTAPQPAPPRPSTSRAYTTQPTPCIQVPQVGDATMQRFFQEIADELASIRATGEKPDALQSKLDQLKNSMAWQQQQQQQQLQSQPMAVTASAPSARTRNSEMNQFEDAEDDVSEGESMRSVSQASSHQQTYTPSTPMTPLSPVELIAPLALTDKSGAGARSSVASSSASASARNSVRSARSGTEASSSGTTSRPTSVFSNISTGSTGLGRKRSLLGLRRADKHAQQQHATATEANTIRSIAYESTPTPTALASVFAAPASGRFVPNGGATTASSVRMQRLNPGLGLDIGASSAAGIISPPSTPQSPNTATLSPAPAASASAIASASAPGKKDSWFAGLFNWKPATFTLMSSENFSETLTECIRRLQSYGVRVAMDDSSDVHHTTLKCSINEYRESNGVVTAAKPLRFRVDVHILAVGSPATNSAYMGGGLGLSLHGGAVGTNVNATSIMTHGLPSPALSTYSRASTPGGVTFATSVLVVQEKGALSTFKLIHARLRREWMLDLGSAII

SEQ ID NO: 4597 - protein, 339 aa, delta proteobacterium MLMS-1
MSRPIGITVSRHIMDSQRLHPEATGELTGLLYELIVAAKTISAEVNMAGLADILGMSGKTNIQGEHVQKLDEFANNTIKRRMARCGYLAAMTSEEEADIIPVVEGYEGKYTLAFDPLDGSSNIDVNVSIGTIFSVHRRLTPEDGPGEESDLLQAGRQQVAAGYVIFGSSTMLVLTTGDGVHGFTLDPSVGEFYLSHPNIRVPEKSKYFSVNEGNHCYWQEPVRRFLEHLKEEDKASGRPYSGRYIGSMVADFHRNLIAGGVFLYPRDSKDPTKPYGKLRLLYEAAPMALLIEQAGGRAITDDGREILDITPEDLHQRVPLVIGSRHDVALFEEFMNGHR

SEQ ID NO: 4598 - protein, 150 aa, Clostridium sporogenes
NWKMHKTVKEAVELVKELKPLVKDAKCDVVVCPTYVCLPAVLEEVKGSNIKVGAQNMHFEESGAYTGEIAPKMLEELGVHYVIIGHSERRQYFNETDETVNKKVKKAFEHNLIPIVCCGESLEEREGNITEKVLEGQIKVGLKELNKEQV

SEQ ID NO: 4599 - protein, 436 aa, Zea mays
  misc_feature (110)..(110): Xaa can be any naturally occurring amino acid
  misc_feature (179)..(179): Xaa can be any naturally occurring amino acid
  unsure (1)..(436): unsure at all Xaa locations
MPPALLACLLILLVAAPRPWSVAGEPGGAKPRAFPLRARQVPAGALPRPPSKLRFHHNVSLTVSLAVGTPPQNVTMVLDTGSELSWLLCATGRAAAAAADSFRPRASATXFAAVPCGSARCSSRDLPAPPSCDAASRRCRVSLSYADGSASDGALATDVFAVGDAPPLRSAFGCMSAAXDSSPDAVATAGLLGMNRGALSFVTQASTRRFSYCISDRDDAGVLLLGHSDLPFLPLNYTPLYQPTPPLPYFDRVAYSVQLLGIRVGGKPLPIPPSVLAPDHTGAGQTMVDSGTQFTFLLGDAYSAVKAEFLKQTKPLLPALEDPSFAFQEAFDTCFRVPKGRPPPSARLPPVTLLFNGAQMSVAGDRLLYKVPGERRGADGVWCLTFGNADMVPLTAYVIGHHHQMNLWVEYDLERGRVGIAPVKCDVASERLGLML

SEQ ID NO: 4600 - protein, 307 aa, delta proteobacterium MLMS-1
MGAKQVLSLPLAAEMAERRRQFAAEPASMVEEVLAYGAVVGSRVEFCGRRPSCLDYARKLIRAEEEAGRSFASGLVLIASELKAGRGRFARPWHAPAGGLWLTVVLVNTLLPQHARFYPLAAGVAVAETLRSFGLPAQIKWVNDILVDGRKIAGMLLETDYGRRRREEYVLLGIGLNVNNHDFPPELDGLAVSMGQVAGRRFDLDQVAACLLAKLRWQIGLLHWVEARQLAMEGDSGEPPADHPLLASWRELSDCLKRRVLFGFNVQQKTQYEAVVEDIDPAGGLVMRLAADGRMVTEYAGEIIYLS

SEQ ID NO: 4601 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALRYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 4602 - protein, 463 aa, Leuconostoc mesenteroides subsp. mesenteroides ATCC 8293
LFGYDTGVISGAMLFIGKELEIQTGSFEDGFITASVLLGAILGAAIIGPMSDKLGRKKLLLSAAIIFFVGALGSGIGFNYTLLVTSRVLLGIAVGAASALIPTYLAELSPADKRGGIGTLFQLMIMTGIFLAYVSNEWLSPSGWLGLNQNVGWHWMLGLAAVPAALLFIGGLSLPESPRFLVKQGKMSEAQKVLSTMNPNAKLVEEELYDIKLQANTPSGGFKELFGPMARPVLIMALGLAIFQQVMGCNTVLYYAPKIFISAGFSEHFALQSHIVIGLFNVIVTAIAVKIMDKIDRKKMLTYGAIGMGASLLTMSTAMLVLRAGNGNVGSWICVIALTLYIAFFSATWGPVMWVMIGEAFPLNIRGLGNSFGAVINWTANFAVSQSFPMLLIAFTPDHAINAEGQGIAKLFIIYGVLCFVAIWFIAKFTIETRNRSLESIESDLRSKAHAKGYLESDYVGIK

SEQ ID NO: 4603 - protein, 123 aa, Gloeobacter violaceus PCC 7421
MDPFACVFLPMPYQEISVAELQRKLASQAEGTQFVDVREPEELEQSRLDGFINLPLSHYQEWSMRLGEILDPQKETIVLCHHGMRSADMCSFLLRRGYENVKNVQGGIHAYSLYVDPNVPRYM

SEQ ID NO: 4604 - protein, 266 aa, Mesoplasma florum L1
MKRVLFIGLGHMGSSLVKGVLKNSNNKIEVFGYDVIKEVQDKAIKNIQGLRPLKDISEIELKKIDYIVIGTRPIDVEPLCKNMDQLNIDGKTIICMANAVTIEDVQNNFVKNKKVSVIRMMPNMNASIQKSVTALATKNASNETMKFVSEMFELCGIVENIDEDKFGTLTAISGCSPSYIISFFKAMTDYAIDKGFEKEQAFRIIEEAIIGSVMNASKSEVELRTMVDQICVPNGSTIEGQKILDNKNFEKIIQEALTAATKKATK

SEQ ID NO: 4605 - protein, 341 aa, Shewanella sp. MR-7
MKALSKLKAEKGIWLVDAPKPEMGHNDLLIKIKKTAICGTDMHIYNWDEWSQKTIPVPMVVGHEYVGEVVDIGQEVRGFKIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQENLKDVMKELGMTEGFDVGLEMSGVPSAFHAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 4606 - protein, 372 aa, Arabidopsis thaliana
MFAQLAPSPSPSPANVSHFVHHRTFRQCTYAVSASLPTANSSRPPPIQIVGGKDLNLDVTRKDDSIGFKLEANEDEIDWMNLESDIRLWTRALRPVQWYPGHIMKTEKELREQLKLMDVVIEVRDARIPLSTTHPKMDAWLGNRKRILVLNREDMISNDDRNDWARYFAKQGIKVIFTNGKLGMGAMKLGRLAKSLAGDVNGKRREKGLLPRSVRAGIIGYPNVGKSSLINRLLKRKICAAAPRPGVTREMKWVKLGKDLDLLDSPGMLPMRIDDQAAAIKLAICDDIGEKAYDFTDVAGILVQMLARIPEVGAKALYNRYKIQLEGNCGKKFVKTLGLNLFGGDSHQAAFRILTDFRKGKFGYVSLERPPL

SEQ ID NO: 4607 - protein, 467 aa, Pseudomonas putida KT2440
MQQAQGLKRGLSARHIRFMALGSAIGTGLFYGSASAIQMAGPAVLLAYLIGGAAVFMVMRALGEMAVHNPVAGSFGHYATTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGMSNLFDHGGFMPNGVGGLIASFAVVMFAFGGIEIIGVTAGEAKDPQRVIPKAINAVPLRILLFYVLTLFVLMCLYPWPQIGSQGSPFVQIFSNLGIGSAAAVLNVVVISAAISAINSDIFGAGRMMYGLAQQGHAPRGFSKLSKHGVPWMTVVVMGAALLIGVLLNYLIPENVFLLIASIATFATVWVWLMILLTQVAMRRSMSREQVAQLKFPVPFWPYGPAMAIAFMVFIFGVLGYFPDTQAALIVGVIWVVFLVASYLLWCKPRAGQGQPVAEPAELHR

SEQ ID NO: 4608 - protein, 170 aa, Prochlorococcus marinus subsp. marinus str. CCMP1375
MPRGYIPEDDISILNLFGFMSVERTFLAIKPDGVQRGLVGEILGRFERKGFKLVGLKQLIPSKELAEKHYGVHKERPFFTGLVGFITSGPVVAMVWEGDGVILSARKLIGATKPLEAEPGTIRGDLGINIGRNVIHGSDGPETASFEIDLWFNSSELNNWNPSDQKWRVE

SEQ ID NO: 4609 - protein, 601 aa, Escherichia coli K12
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTDFAWQAAVVGGIGLAMSSTAMALQLMREKGMNRSESGQLGFSVLLFQDLAVIPALALVPLLAGSADEHFDWMKVGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 4610 - protein, 510 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNVNLPGVVVDLPTLTEKDKEDILQWGVPNKIDMIALSFVRKGSDLVNVRKVLEPHAKTIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 4611 - protein, 182 aa, Triticum aestivum
YTYIVQSLVPTVMASLATSVAPFQGLKSTAGLPVSRRSNGASLGSVRNGGRIRCMQVWPIEGIKRFETLSYLPPFSTEALLKQVDYLIRSKWVPCLEFSKVGFIFREHNASPGYYNGRYWTLWKLPMFGCTDASQVINEVEEVKKEYPDAYVRIIGFDNMRQVQCVSFIAFKPPGCEESGKA

SEQ ID NO: 4612 - protein, 515 aa, Burkholderia xenovorans LB400
MRIEAFGLPNQTRLSAFAGRSSAFLARVDPDTWMRTARTARENGGRLISLWGNEEATGTFAISAAYALEDGILWLEAPVAAQGYPDLSTVFPCAARMQRAVFDLLGLRAIGAADSRPWLNHGNWPRDYHPLQKLSSGAERFQSGEEDYPFVRVDGDGVHEIAVGPIHAGVIEPGHFRFSVVGEKVLRLEERFGYAHRGIEKLFERTPLLLGYRLAGRIAGDTTVAFSWAYCMAVERALDGRIPPRAQWLRALLLERERIANHLGDLGALGNDAGFAYGLAQFSRLKEDWLRVNDQAFGHRYLMDRIVPGGVSKDIDSRFITAIQTQCERIDTEVRVMQRIYEDQSGLQDRFAGSGILSAEVAEHFSVCGLVARASSRKTDVRVDHPYAPYHEVPVQMVSDARGDVAARVAVRFGEIYESIRLIQTLLAGLPEGDIVTVLEQRGSPARGVGWIEGWRGDVFVALETGAGGTLSRCHCHDPSWQNWPALEHAIIGNIVPDFPLINKSFNLNYAGHDL

SEQ ID NO: 4613 - protein, 246 aa, Zea mays
MHKLGRGSRDKVQQFMAITGASEKAALQALKASDWHLEGAFDVFYSQPQIAVANTRHLEELYNRYKEPDADMIMVEGISQICNDLQVDPQDIVMLVISWHMKASTMCEFTRQEFIGGLQSIGVDSIEKLQAKLPSLRAELKDDQKFHEIYNFAFAWAREKGQKSLALETAIGMWQLLFAERSWPLIDYWCQFLQVRHNKAISRDTWAQLLEFVKTIDPQLTNYDEEGAWPYLIDEFVDYLKENGLA

SEQ ID NO: 4614 - protein, 635 aa, Nanoarchaeum equitans Kin4-M
MPFNAFHQIFIKYKSIASTFMELLEEIFKYIDKNKIIGYRFEGPKVVLFTRDKELLVKAPQILQEIAKKVRRRIHIRYDPRLLKEEPEKIEKLIPKEAGLQRIYFEKGRGIVNIEVLFPEKIDLNTINKIKEETLWFPRIYRSPLIRSKTIDMVRAYMFQHSNERIKLLHEIGKNISEKWSIQKGQTWVRVSFLGGASQVGRSALLLQTKESRILLDFGVDLSLPPNNKNAYPIVELPEFDVKELDAVVITHAHLDHVGFVPFLYKMGYKGPVYLTPPTLDIATLSLLDYLRIANENNVKLFSGDDIRNFVKHSITIEYGQTTDIASDVKLTFYNAGHILGSALAHLNIANGYSNVLYTGDYKVKPTFLFDGAQIPQAKVNIAITESTYGDTYHKPREEVEKEFLSFVKEVIKRKGKLLIPVLGVGRAQEILYLLVKSIRANKLDEVPIYLDGVVWEITAIHTAYPEYLKEEIRNKILAGKNPFIDKFVHRAPRNREEIVYSTEPSIILATSGMLVGGPSVQYLKLMAEDPKNAIAFVSYQGPNTLGRQIQSGVREVEIDGQLIKINLEVRSFEGFSGHADKGEIESFLRRVRPGRVVINHGERSKVLHLASYLRKKLNVETNAPRNMDALALRI

SEQ ID NO: 4615 - protein, 430 aa, Mycobacterium avium subsp. paratuberculosis K-10
MDSDGTIGGVTTHQLPVHSSAHHRQQRTFAQSSKLQDVLYEIRGPVHQHAARLEAEGHRILKLNIGNPAPFGFEAPDVIMRDMIQALPYAQGYSDSQGILPARRAVVTRYELVDGFPRFDVDDVYLGNGVSELITMTLQALLDNGDEVLIPSPDYPLWTASTSLAGGTPVHYLCDETQGWQPDIADLESKITERTKALVVINPNNPTGAVYSGEILSQMVDLARKHELLLLADEIYDKILYDDAKHINVASLAPDMLCLTFNGLSKAYRVAGYRAGWLAITGPKDHAGSFIEGINLLANMRLCPNVPAQHAIQVALGGHQSIEDLVLPGGRLLEQRDVAWSKLNEIPGVSCVKPAGALYAFPRLDPEVYDITDDEQLVLDLLLQEKILVTHGTGFNWPAPDHLRIVTLPWARDLAAAIERLGNFLVGYRQ

SEQ ID NO: 4616 - protein, 140 aa, Roseovarius nubinhibens ISM
MAVERTLSIIKPDATKRNLTGKINAKFEDAGLRIVAQKRIQLTPAQAGKFYEVHAERPFYGELCDFMASEPVVVQVLEGEGAIAKNREVMGATNPADAAPGTIRAEFAESVGENSVHGSDAPETAAQEIAFFFSGLELVG

SEQ ID NO: 4617 - protein, 140 aa, Glycine max
  misc_feature (19)..(19): Xaa can be any naturally occurring amino acid
  unsure (1)..(140): unsure at all Xaa locations
LDAIKPIADAHFKRFFKYXEIALRDYKAQLEEDPIVPRPLSSLYDSLMEQNLWRLIEPYARVEIAHIAELIKLPVDHVEQKLSQMILDKKFVGTLDQGAGCLVIFDDPKTDAIYPATLETIFNIGKVVDSLYVRSAKIVA

SEQ ID NO: 4618 - protein, 526 aa, Yarrowia lipolytica CLIB122
MIQSVFLALAILIAYLGFAEWFSRFQHRRISKKKGCGMPPMANGGFLGWYGLYKTYQITSERTYPHSMRMGLEAFGHTFVYPVPGTDMLQTIHPDNIKAILATQFKDFSLGTRHKIMLPTLGDGIFTLDGEGWTHSRALLRPQFARDQVSHVASLERHIQVLFKTIKKENKECDPAKGFDIQELFFMLTLDTATEFLCGDSVDSLTDYLADPTAPQLDHSGIDENVRRAFPEAFNTAQWFCSIRAKLMKLYFFAGTVFYRKKYADANKIVHDFTDFYVSKALAARKEKFQELDQEGKYIFLYELAKETRNPKVLRDQMLNILLAGRDTTASLLSWVMFRMARQPETWKKLRQAVINDFGDTPDELSFESLKRCEYLRYVLNEGLRLYPSVPMNFRVATRDTTLPKGGGPDLDQPIFIPKGGIVVYSVYHTHRAEEYWGKDTEEFIPERWDPAEGYQIARGWEYLPFNGGPRICLGQQFALTEAGYVLARLAQEFETVTSCDDKPLPPKYNTHLTMSHDDGVWLKME

SEQ ID NO: 4619 - protein, 468 aa, Bacillus halodurans C-125
MDLYINGEWMRSGKTLDVTNPATGEVIDTVPFAGKKEAELAVSAAYEAFPQWSSQTASERSRYLMRWFQLIDEQQDEIGEIMTKEQGKPLREAIGEVQYANSFIQWYAEEAKRIYGDTIPASAINKRILVQKQPVGVIAAITPWNFPAAMITRKVAPALAAGCTAIVKPAEQTPLTALKLAQLAEEAGIPAGVLNVITGNAQDIGEAWLEDSRVRKITFTGSTEVGKLLMRGAAQTVKKISLELGGHAPFIIMDDANLEEAVDQVIASKFRNAGQTCVCANRIYVAREIAEAFTEKFAAKVNELKVGNGLEEGVTIGPLIDKAAVEKVEAHIHDALKKGGQVTVGGRWTNHFFEPTIITGATDEMLCMNEETFGPLAPVATFDTEEEVIERANHTPYGLAAYVFTENIGRAIRLSEKLEYGIVGVNDGMPSVAQAPFGGWKESGLGREGGKYGIEEYLEVKYVSVAFK

SEQ ID NO: 4620 - protein, 148 aa, Clostridium bifermentans
TIAEAVEFVNEIKGKVNNTDVEAVICAPFTLLKDLKEATKGTPIKIGAQNMHYADNGAFTGEISAPMLKELDIDYVVLGHSERRQYFNETNETVNKKVLKALEAGIDPILCIGETLEEREADKTKDVCKVQTEKALENVTAEYMKKVV

SEQ ID NO: 4621 - protein, 706 aa, Fusarium oxysporum
MAPRGFEDEELTISLSSSHVRRPQQQQQQQSQQQQQHASSDAPTPGSRPADAPLKERIKTEQRIGAYKVLRTLGEGSFGKVKLAIHNGTGQQVALKIIARKKLISRDMAGRVEREIEYLQLLRHPHIIKLYTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPAGAANLIKKMLVVNPVHRATIEDIRADPWFTTDLPAYLQLPVEEFFNTGVDPNKAIKKNDIAPNASEKVQERLHNEVTEKISKTMGYGKSDVEEALQAAEPAAIKDAYMIVRENKMMQVNHNPEALLAEPEGSSPMLSMSSARSTTSQATTTPRPYVSKVGILPSSLPAYHKDYMEREKAGSVENSPPKVLINDEPPSNRTDAEKEETARRLRPHSRSQLRMDEANTRPQGMTPINPPKKNKPVRWQFGIRSRNSPWEALLCIHKALHKLGATYIPDEDYESRTAEERAEASGEGSFADSHDNNRGSSSSIDPKKRYNLPADPWHINVRWDTSAIKKKAASVPGTPSSPSTPEGQHHPKEPFVALHMDIQIYEMEHGVYLVDFKCSGYETAHGRLLEEKDVTSPFPFLDMAAKLIMQLAEAD

SEQ ID NO: 4622 - protein, 317 aa, Gibberella zeae PH-1
MSFHPDNLPSLNGKVFIVTGGNAGMGYYTVLHLAAHGAHVYMCCRSLEKGNAAIAEIKKEHPSANIDLLQMDLMDFSSTVAAAKHFLTRETSLHGLINNAGIMATPFDMTKDGHEAQWQTNYLSHWVFTEHLIPVMQRTAKTLPPGSVRIVNLTSSGHLGAPKTGINFDDLTLKDQGVWERYGQGKLANILHTKSLHNKYGPGSENKDGEIWVTAVHPGLVETNLATTVDPTEKGMLTLVSALRCFRMLWTADKGSWNSLYCAASQDMKAEQSGQYMEIFHRFGEPWWASSAAKDEELAKKLDVWTRETMGKEGWVQ

SEQ ID NO: 4623 - protein, 204 aa, Yarrowia lipolytica CLIB122
MSQFSAIPEALEAFKNGEFLVVMDDESRENEGDLIIAAAQTTTEKMAFLIRHSSGFVCVPLSNELANKYELPYMVENRTDRHGTAYTVTCDAIEGTTTGISAHDRALTARCLADKNTTAASFMRPGHVVPLRAVDGGVLARRGHTEAAVDLCKLTGQPAAGVICEIVRDEDGLMARTDDCLEFAKTHGIKAITIDALVKYIEQQ

SEQ ID NO: 4624 - protein, 153 aa, Clostridium sordellii
WKMHKTIAEAVEFVEEIKGKVNNTDVEAVICAPFTLLKDLKEATKGTDIKIGAQNMHYADNGAFTGEVSAPMLNELNIDYVVLGHSERRQYFNETNETVNKKVLKALEAGIDPILCIGETLEEREADKTKDKCRLQVEKALENVSKDDMKSCY

SEQ ID NO: 4625 - protein, 153 aa, Clostridium septicum
NWKMHNTPEEAVKVITELKPLVKDANCDVVICPTFVCLDAALKAAAGSNIKIGAQNMHFEEKGAFTGEVAPGMLEAMGVDYVVLGHSERREYFNETDEALNKKVKVAFAHNLTPILCCGETLEQRENGTTNAVVGAQIKADLEGLSKELAEKL

SEQ ID NO: 4626 - protein, 276 aa, Oryza sativa
MVAMADAGEDGMMDMGDGGGCVGRGYNGEMDAGDGGGRGGRGRQLRQMWARTEGGMPATVATVKEEDSAMEHHRHRGAVVLVVAAAAMAMAMSAVRGDFAADRAECADKLMALSTCLTFVQDGASGGAAAPTPDCCSGLKAVLAASRKCLCVLIKDRDDPNLGLKINVTKALSLPQLCNAPANISDCPRLLNLPPNSKDAQIFEQFAKQQAAMQGSPSASPGGSSAPAAGAQKSGAAVLRWLGVDGVGGGGARAVALLLFLLSSAVAVAAPLLLVF

SEQ ID NO: 4627 - protein, 147 aa, Bacillus halodurans C-125
MERTYLMIKPDGVQRNLIGEIVSRFEKKGFTLIGAKLMTVTKEQAETHYAEHKERPFFGELVDFITSGPVFAMVWEGENVIATARKMMGATNPADAEPGTIRGDFGVQVAMNVIHGSDSPESAKREIDIFFDSSELNEYDKVVNRWV

SEQ ID NO: 4628 - protein, 154 aa, Clostridium cadaveris
NWKMHNTVDETVKVINELKPLVKDAKVDVVLCVPFTSLDAALKAVKGSNIKIGAQNMHFEEKGAFTGEIAPGMLEAMGVDYVVLGHSERRQYFNETDEALNKKVKAAFAHNLLPILCCGETLEERENGTTNAVVGAQIKADLEGLSKELAEKVV

SEQ ID NO: 4629 - protein, 352 aa, Triticum aestivum
PRVRLSAHKGVNLPNTPVDLPALSEKDKADLRFGVEQKVDFIFASFVRRGQDVRDIRKVLGPDGKNIKIISKIENHQGVENFDDILAETDGVMVARGDMGIEIPLERVFIAQKMMITKCNLAGKPVICATQMLESMTYNPRPTRAEVSDVANAVLDGADCVMLSGETAKGNYPVDAVKTMHDICKLAESVLCYPAIFNELRNLTELPTETTETVACAAVAAAHEQNAGCIIVLTTSGNSARLISKYKPNAPIVVVTRNPQTARQIHLYRGCFPFLYPKASSAITSLLNSSSQGHLSPVENAPWQEDVDHRIRWGMEQAMKYGLLSRGQPVVAVQGWRGGLGNTNTLRIIYAP

SEQ ID NO: 4630 - protein, 143 aa, Shewanella sp. MR-7
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAQSIDENAAHGSDSLESAAREIAYFFSAEELCPRTR

SEQ ID NO: 4631 - protein, 139 aa, Clostridium tertium
KVIEELKPLVKDATCDVVVCPTFVCLDAVLKAVEGSNIKVAAQNMHFEEKGAFTGEVAPGMLEAMGVNYVVLGHSERREYFNETDEALNKKVKAAFAHNLTPILCCGESLEQRENGTTNEVVGAQIKADLEGLSNELAE

SEQ ID NO: 4632 - protein, 478 aa, Colwellia psychrerythraea 34H
MTSSEPDNSIQKLHDTEEVQTSFLYVLFISSVAAIGGFLFGFDSGVINGTVTALGNAFNASDVASGFNVASVLLGCAVGALMAGPISDRFGRKPIMIITAIIFAISAFGSGISSSSAEFIFYRLIGGLGIGAASVLAPAYIAEVAPAALRGRLATLQQLAIVLGLFAAFLSNFLIASVSGGAEAMLMLDIAAWRWMFWVELLPAVLFLVGVIFIPESPRYLVAQGKIEEARTIFKRIATGVENEQIEEVKKSLHGDKKPSIRDLFIDGKKKIHPIIWIGIGLSVFQQFVGINVVFYYGAELWQAAGFDESQSLFINLIAGTTNIISTFIAIALVDKIGRKPLLLVGSVGMFISLGALTFIFGTGGLDEAGKLALSDTTGTVALIMANLFVVFFGLSWGPIVWVLLGEMFNNRIRGAALAIAASAQWLANFAITMTFPILLGSFGLAGAYGLYTVSALLSIFFVIKYIKETRGIRLEEM

SEQ ID NO: 4633 - protein, 233 aa, Zea mays
LDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 4634 - protein, 336 aa, Pseudomonas putida KT2440
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 4635 - protein, 393 aa, Amborella trichopoda
MTVPATRNDLMIVNMGPHHPSMHGVLRLIVTLDGEDVIDCEPILGYLHRGMEKIAENRTIIQYLPYVTRWDYLATMFTEAITVNAPEELGNIQVPRRASYIRVIMLELSRIASHLLWLGPFMADIGAQTPFFYIFRERELLYDLFETATGMRMMHNFFRIGGVAADLPHGWIDKCLDFCDYFLPEVAEYQKLITRNPIFLERVEGVGFIAEEEAINWGLSGPMLRASGIPWDLRKVDHYECYDEFDWEVQWQKEGDSLARYLVRISEMIESVKIIQQALEGIPGGPYENLEARRFDRVRNIEWNDFEYRFISKKPSPTFELSKQELYVRVEAPKGELGIFLIGDNSVFPWRWKIRPPGLINLQILPQLVKRMKLADIMTILGSIDIIMGEVDR

SEQ ID NO: 4636 - protein, 816 aa, Pseudomonas putida KT2440
MSQEPKARDAEVADFRAAVLNKLTYAVGKDPEHAFDHDWFEAIALAARDHMVDHWMDHTRQAYRRSQKRVYYLSLEFLIGRLLYDSLSNLGLLDVARDALEGLNVDLERIRLLEPDAALGNGGLGRLAACFMESMSTLGIAAHGYGIRYEHGLFRQAVVDGWQQEQTENWLDFGNPWEFERAEVIYPISFGGSVETVHDASGTQRQVWWPGETVRAVAYDTPVVGWRGSSVNTLRLWRARALEELHLERFNAGDHLGAVAEVARAESISRVLYPADSTEAGQELRLRQEYFFVSASLQDLLRRHLNMHKDLLNLPDAAAIQLNDTHPSIAVAELMRLLVDQHEVPWEKAWELTVGTLAYTNHTLLPEALETWPVALMERMLPRHMQIIYLINAYHIDALRAKGLHDFDVLRAVSLIEEDNGRRVRMGNLAFLGSHSVNGVSALHSKLMKSTVFSELHKLYPQRINNKTNGITFRRWLYQSNPQLTDMLVEALGPELKDDPQTLLAGLVPFADKPGFRKQFAAQRLHSKRALASIIQDRIGVTVNPEALFDVQVKRIHEYKRQLLNLMHTVALYQAIRNEPGTNWVPRVKIFAGKAAASYHQAKLIIKLANDIARVVNNDPTVRGLLKVVFLPNYNVSLAESIIPAADLSEQISTAGYEASGTSNMKFGLNGALTIGTLDGANVEMCEQVGADNMFIFGLTSQQVEARKRAGDFGANAAIAASNRLTDVLQAIRSGVFSPDDPSRYTGLIDGLVAYDRFLVCADFDDYWDAQRRVEDLWHTPQEWWRKAVLNTARMGWFSSDRTIREYATEIWKALD

SEQ ID NO: 4637 - protein, 88 aa, Triticum aestivum
MAAPAKASWMVAMSVGAVEALKDQAGLCRWNYALKSIHRAAKANVCGGISQGTKQLLASASAVAERRRAEKAEEGLRTVMYLSCWGPN

SEQ ID NO: 4638 - protein, 247 aa, Geobacter sulfurreducens PCA
MRTLVLIRHGESVWNRENRFTGWTDVGLTDKGAAEALRAGRTLKNEGFAFDEAFTSVLKRAIKTLWIVLEEMDQMWIPEHRHWRLNERHYGALQGLNKAETAERHGMEQVHVWRRSYDIPPPPLAAGDPRNPARDPRYAELDPADIPLTESLKDTVARFLPYWHETIAPRILAGRRLLIAAHGNSLRALVKYLDGIGDDAIAGLNIPTGIPLVYELEDDLHPIRSYYLGDPDEVARATQSVADQVKR

SEQ ID NO: 4639 - protein, 476 aa, Mycobacterium avium subsp. paratuberculosis K-10
MRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 4640 - protein, 515 aa, Escherichia coli CFT073
MEYPSHNDMSQQFNPYLCYFRPDTCVSCSRIFSLCLTLCWQEKMVTINTESALTPRPLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 4641 - protein, 607 aa, Medicago truncatula
MASMKLGSKPEAFRREGQTWVCTTGLPSDVTIEVGEISFLLHKFPLLSRSGLLKKLIAESTSEDGSSSILQLHDVPGGAKTFELITKFCYGVKLEITALNVVSLRCAAEHLQMTENYGADNLIGYTESFLNEVFSNWPDSIKALETCEEVQNFAEDLHIFSRCIDSLAMKACSDPDLFNWQVTGRNDAKNQEEHELLNGMSCESKPQSVGDNWWFYDVSLLSLPLYKRLILAIESKGMKSETIAASLIYYLRRFLPLMNRQSSFKDTNHATIPTTSEADQRGLLEEIVELIPNKRGVTSSKHLLRLLRTAMILRASPSCKENLEKRVGAQLDQASLVDLLIPNMGYSVETLYDIDCIQRILDHFMSIYQPASLSASPCITEIGTLIAGVDTLTPMTMVANLVDGYLAEVASDANLNLSKFQALAVAIPDYARPLDDGIYHAIDVYLKAHTWLTDSEREQLCRLMNCQKLSLEGSSHAAQNERLPLRVIVQVLFFEQLRLRTSISGWFFVSENLENSQNPRGNIGPSGSCQVDSAETTENVRERLLELEKECSSIRKELQKLTKTKKSWSIFPKRFGFRRKSGSSNPNESNNVNTSSSVNKNPNNESS

SEQ ID NO: 4642 - protein, 459 aa, Acinetobacter sp. ADP1
MQRKLSNRHLQLIAIGGAIGTGLFMGSGKTISLAGPSILYIYMIIGVMFFFLMRAMGELLLANLQYKSFVDMAHDLIGPGAGYYLGWTYWLGWVLVGIADLAAIINYLNFWLPDGTVFTPMGQALISAGCVLLVLGLNLLTVRLFGEIEFWFALIKILAIVGLIGVGGYMVFSHFQAPAGTVAAISNVWSEGGMFPKGVTGFLAGFQIAVFAFVGVELVGTTAAETRDPQKNLPKAINAIPVRIILFYVLALFVVMSVTPWNHISADKSPFVELFLHAGIPTSAIIMNLVVLSSVMSSMNSGVFSTSRMLFGLSRDGQAPQAFAHLSRRAVPANGLLFSCFFIMAGAALQYFVPNTMEAFTLASSLCVILFISVWGMIMVCYLRYRKLRPELHAQSTFKMPGGIWMSYIVLAFLMFTLVILALEPDTLKALYISPLWLILLALTYQFMYKPRLKRLMHN

SEQ ID NO: 4643 - protein, 177 aa, Arabidopsis thaliana
  misc_feature (153)..(153): Xaa can be any naturally occurring amino acid
  misc_feature (169)..(169): Xaa can be any naturally occurring amino acid
  misc_feature (171)..(171): Xaa can be any naturally occurring amino acid
  unsure (1)..(177): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAXIRIIGFTTPASPVHQXIXYKPPAY

SEQ ID NO: 4644 - protein, 145 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 4645 - protein, 69 aa, Glycine max
  misc_feature (44)..(44): Xaa can be any naturally occurring amino acid
  unsure (1)..(69): unsure at all Xaa locations
CRNATSAVPAGASMVAPFTGLKYIAVLPTRNTILDFAYIASNGXRAQCMHVWPPIGKKKVETLSYLPDL

SEQ ID NO: 4646 - protein, 292 aa, Glycine max
  misc_feature (202)..(202): Xaa can be any naturally occurring amino acid
  misc_feature (248)..(248): Xaa can be any naturally occurring amino acid
  unsure (1)..(292): unsure at all Xaa locations
MAATFKHHPTGLHGWGAPRSSRNLPSFFSMRFPCSTRHHHIRASVSHHSSTEAESALILIRHGESLWNEKNLFTGCCDVPLTNRGVEEAIEAGQRISYIPIDMIFTSALIRAQMTAMLAMTQHSQKKVPIIIHDESEQATTWTQVYSEKTTKQSIPVITAWQLNERMYGELQGLNKQETAERYGKEKVHEWRRSFDIPPPKXEPQLKSGKHVMVAAHGNSLRSIIMYLDGLTSQEVTSLEISTGIPLXLYIYKEGKFNSRGSPVGPTEAGVYAYTQSLAVYRQQLDDMSSCY

SEQ ID NO: 4647 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 4648 - protein, 148 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLP

SEQ ID NO: 4649 - protein, 237 aa, Arabidopsis thaliana
MSSQICRSASRAARSLLSSAKNARFFSEGRAIGAATVVHATGKVPQYASNFGKSGSGFVSNSWITRLLALPAAAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTSNAEKWIYGQN

SEQ ID NO: 4650 - protein, 743 aa, Yarrowia lipolytica CLIB122
MSFRQQFQQGGNPNGQMGFNNMNMSPNMNNAKIGGMDMGAQMGQMGQMGQMPQMAQMGQMGQMGGMPQMGGPMGGQMNGMNMGGMSGAGGMPNVGGMPNMAGMPNMGQGMNMGQGMNPQVGRGGPMGPQGMMGQQGMGGMQQGGQVQMGGGPQMQPPQRQPQPQQQQQQQQQQQQHHHQQQQQQVPMPQSQLIPQQGGIPVMAGGQPQKNFDFPPPGQTMMQPGLTVPPVQSHLGLVSSDDARQQETPLVNPPSAAESLAEMPTLFNGQGITDLTEIMKNKRDPKTAQELNLRRFVSKDLNESSTLPKKLKQEADKLNAKRYEISFYHSFGPIRSQEPQSIFQDGYLGYGNGWTGLNTRFVYPRDRKKHNRNTRDLVLSRQQMNQQAAEPELLVPIRLDFDLGRLRLRDTFMWNLNEKTYPVHFFVENMFEDFHFPHQYIQSVTNSITEQLQDFQPHQYPQDPRHVIGNGDATRNEDMRVVVRLDITVGQHNLIDQFEWDINDSLNSPEEFAATMCAELSLSGEFATAIAHAIHEQTQVFSKSLLLLGHTFDQRPVDDEDIRREICAPIPDGSVMRPKNSVNEYSPALFEISEAELSRLDKDKDRDSRQKRRQGRAGRRGAPSLPDFKKVVRTFRTPVYSAVLPGAVDRKVELAKQALQAEEEEEEEDSDGNVVVRPAKRQRTTGRHVPVRAAAANAAVAVAAQSQELETNYVEELADPTSFWVTLKVPPQQLARLMMIPRFG

SEQ ID NO: 4651 - protein, 145 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYD

SEQ ID NO: 4652 - protein, 377 aa, Helianthus annuus
MAHEGEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYKGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 4653 - protein, 244 aa, Haematococcus pluvialis
MATERELALYSAKLSEQAERYPDMVSEMKKIAAGAQDQELSVEERNLLSVAYKNLVGARRASWRILQSVEQSELAKGNEKRVKLIQKYRTVVEKELDEVCGEILSLLDTYLVPSASSVEASVFYLKMKADYHRYLAEFKVDEDRRSAAEKTLEAYKAAQNKATSELPSTNPIRLGLALNFSVFYYEVLNQPDQACSLAKQAFDEAISDLDTLGEDSYKDSALIMQLLRDNLTLWTSEMQDSKPE

SEQ ID NO: 4654 - protein, 614 aa, Xanthobacter autotrophicus Py2
MHGDEHALFGAALAFLAAAVVSVPIAKRLGFSPVVGYLLVGIAIGPVGFNVADPGVVSTVAELGVVMLLFLVGLELKPSSLLSMGHFIFGLGTAQLMLTALAFALLAYFGLGFGAAAAVVSGLALSISGTAIALQLLGERGDLASPYGQRTFSILLFQDIAVVPLLALVPLLAPGGEAEVARDPKATLLAAAIAVAAIAVIVVSGRYLLNPLFRVLARSGAREAMTAAALLVVMGAAGLMEAAGLSAALGAFLAGLLLSESTFRHELEANVDAFRGLLLAVFFMSIGMSLNITVVLGHIPSLLVGTLAVAVVKSVIVYLVFRADNIAPQDSMRAAVALMSAGEFAFVLFPLGLDNRILKSEQADLLIALAALTMILGPLLFAALSRLLPRFARPAAEPPADDFADADGSVLVIGFGRFGQIVSQCLLAQEVTVTIIDKDVEMIQSAGRFGVHIYYGDGTRLDVLRAAGAETVEVICVCVDNKEDANRIVEIVRASIPNARLFVRSFDRVHSMELARLGVDFELRETLESALSFGARTLEALGVPQNAAAARIADVRVRDRARLERQLEEGIFAGGEVFSGHKVEPEPLTQPEKPARPLNPEAQDILSHETEFSG

SEQ ID NO: 4655 - protein, 248 aa, Mycoplasma pulmonis
MKKLLIIGNWKMNKTYDEARDFINAFSNAYALNGAKISENIEYGIAPSFTNMSLFNKELLEKTNINLVAQNINENRSGAFTGEISAQMLKSINAKYVIVGHSERRQNYRETNKIVNQKAKAAIENGLIPIICVGESLEEYEAGKTKAVIKKQIKQSLEALDLSKIVVAYEPIWAIGTGKVATAEVAQQICKFIRSITSKDLIIQYGGSVSPSNIENLMKQEDIDGALVGGASLEVDSFFELITFNALK

SEQ ID NO: 4656 - protein, 505 aa, Mycoplasma pulmonis
MENKKNKKVILVVIDGLGLRKEKIGNAFELAKTPFFDKMFKEFPWSFIQASGKFVGLPEGQMGNSEVGHLNIGAGQIVYTGLSLINKDLEEKNFINNKAFLEVIEDVKKNNSTLHLMGLVSPGGVHSLEDHLFEIIDVAYQKGLKKVSVHVFGDGRDVAPRSIKSSFEKLEKITNKYNYDIASISGRFYSMDRDKIFERTEKAYEALLGNSNSKFDNWSEFLNKQYSQEISDEFFIPSINASKNVNFVKDGDSIIFFNFRPDRARQLTHLLIGSSLYDFKPKKPVKINKFCSMMKYEGIETLIAFEEMEIKNPIGKVAEKAGLKQLRLAETQKYAHVTYFMDGGVDIEYKNSKRIMVESQKVRSYADHPEMSAKGITDELIKNAKDFDLTILNYANPDMVGHTGVLTSTIKAVEILDYELSRLVDFAQKNNITVFITADHGNAEVTEDDKGNPQTKHTSNPVMLITSDKNLKLKDGKLANISPTILDYLDIEKHEDMNEESLIIK

SEQ ID NO: 4657 - protein, 229 aa, Leuconostoc mesenteroides subsp. mesenteroides ATCC 8293
MNKQKKHAGEFAATLIEDGMVVGLGTGSTIAYFLEALAKRIQDEKMTIIGVTTSTKTARCAEELGIPIRDIDLVPMIDLTIDGADEVDQHLNGIKGGGAAFLMEKIVARYSRRVIWIIDEQKLHSKLGQFPLPVEVVAFGSGKLIAELKERHLHPKLRLDNHQQPLVTDLGHYIVDLDLEQIDQPFELGRYLDGQIGIVEHGLFLNVADQVIIGQDEGYRIMNNLQKEM

SEQ ID NO: 4658 - protein, 468 aa, Pseudomonas putida KT2440
MSKSVQLIKDHDVKWIDLRFTDTKGIQHHVTMPSRDALDEDFFEVGKMFDGSSIAGWKGIEASDMILMPVDETAVLDPFTEEPTLIITCDIVDPSSMQGYDRDPRAIAKRAEEYLKSTGIGDTVFAGPEPEFFIFDEVKFHSDISGSMFKIFSEQGSWMTGADVEGGNKGHRPGVKGGYFPVPPFDHDHEIRTAMCNALEEMGQTVEVHHHEVATAGQNEIGVKFNTLVKKADEVQALKYVVHNVADAYGRTATFMPKPLYGDNGSGMHVHMSIWKDGKNTFSGEGYAGLSDTALYFIGGIIKHGKALNGFTNPSTNSYKRLVPGFEAPVMLAYSARNRSASIRIPYVGSPKARRIEARFPDPSANPYLAFAALLMAGLDGIQNKIHPGDAADKNLYDLPPEEAKNIPQVCGSLKEALEELDKGRAFLTKGGVFSDDFIDAFIELKSEEEIKVRTFVHPLEYELYYSC

SEQ ID NO: 4659 - protein, 645 aa, Pyrococcus furiosus DSM 3638
MYKLVSFRDSEIFGRVAEVEFSLIREGSYAYLLGDFNAFNEGSFRMEQEGKNWKIKIALPEGVWHYAFSIDGKFVLDPDNPERRVYTRKGYKFHREVNVARIVKSDDLVFHTPSLLYLYEIFGRVHVLLRTQKGVIKGATFLGEKHVPMRKKASDELFDYFEVIVEGGDKRLNYSFEVLTMEGAKFEYGQFKARPFSIEFPTWVIDRVFYQIMPDKFARSRKIQGIAYPKDKYWGGDLIGIKEKIDHLVNLGINAIYLTPIFSSLTYHGYDIVDYFHVARRLGGDRAFVDLLSELKRFDIKVILDGVFHHTSFFHPYFQDVVRKGENSSFKNFYRIIKFPVVSKEFLQILHSKSSWEEKYKKIKSLGWNYESFFSVWIMPRLNHDNPKVREFIKNVILFWTNKGVDGFRMDVAHGVPPEVWKEVREALPKEKYLIGEVMDDARLWLFDKFHGVMNYRLYDAILRFFGYEEITAEEFLNELELLSSYYGPAEYLMYNFLDNHDVERFLDIVGDKRKYVCALVFLMTYKGIPSLFYGDEIGLRGINLQGMESSRAPMLWNEEEWDQRILEITKTLVKIRKNNKALLFGNFVPVKFKRKFMVYKREHMGERTIVAINYSNSRVKELGITIPEYSGVIINEDKVKLIKY

SEQ ID NO: 4660 - protein, 399 aa, Clostridium perfringens SM101
MKKFNLVEEAIEDIKNGKMVIVIDDEGRENEGDLVMAGELVTGEKINFMATYGKGLICAPVSESIAESLGLNPMVSHNTDNHETAFTVSIDYKNTTTGISAFERAHTIKELINEESKAEDFRRPGHVFPLIAKNGGVLKRAGHTEAAIDLAKLAGLKEVGVICEIMKDDGTMARTDELLEFAKIHNMKIITIEDLIAYRTERDNFVYRVVETNMPTKYGEFKAIGFIDKLTGEHHVALVKGEIKSEEPVLLRVHSECLTGDVFGSRRCDCGEQFHRAMEKINEEGKGILLYMRQEGRGIGLINKLKAYKLQDEGLDTVEANIALGFPEDLRDYGVGAQILKELGVREIRLMSNNPKKITGLEGYGLKIVERVPIEIKCNEENEFYLKTKKEKMHHLIMQ

SEQ ID NO: 4661 - protein, 367 aa, Glycine max
MEKELVELYEAAKKAADAAISGDVEHEESRCIDALEQLKKFPVNYKILVNTQVGKHLKVLTKHPRQKIKSFAIDLIEIWKGIIIKETSKNKNGGSDSKDESANREKSKAGKMQKSPSVKIEKGETVKVEKIERNGTSKSSFENMKKVQNDVKNERTDRAASVKMEKIAEEKPISGAKKMSSSSTAPPKLKTMIKSNDATRDKIREILHEALSKVTREADEDLVAVVNDSDPIRVAVTVESVLFEKWGPSNGAQKVKYRSLMFNLKDSNNPDFRRKVLLGVVEPEQLINMSTAEMASEQRKQEYQKITEKALFECERGGQPKATTDQFKCGRCGQRKTTYYQMQTRSADEPMTTYVTCCVCNNRWKFC

SEQ ID NO: 4662 - protein, 547 aa, Candida glabrata CBS 138
MVDENSNNENGLDQEEEIDVYSDLYSTYTQVTSLTTNDVDNTTYPMTWKTVALFGSSTVGGLLFGYDTGVISGVLLSLKPQDLGRATISDWDKELITSITCLGCFVGSLLGSPLADKYGRRITLAIFCVLFIVAALWMALASNLVLLVFGRFVVGIAVGTAAQCTPVYLCEISPAKIRGQILALNSIAVTGGQFLSYIFAYELYDVNGSWRILFGLSAVPAIIFLSMLDFIPESPRWLVSMSKYDSAKAALRMIYPTASPGQINLKFNELVINLSKLKHYQDEQTSLMVPLSVRSSRVTINSADYGSVANLRSLHSLMNEPSGTNHSNKTVHHRMEPRTKRALLIGCVLMFFQQITGFNAFMYYAPLIFSKLNSHNPLLPAMSIAFTNFLFTFLAVYLVDLVGRRSMLLNTIWIMTVGLLLSTIGFQHENVVVLLFAVSIFVAAYASAMGTIPWSSVEFLPLNRRSFGASCISCTNWLTNFVITASYLSVMNKIGTEDTMLFFALFSVMAWFFVYFWYPEVKGLSLEEIGKVFENGIDVHYVYRNYY

SEQ ID NO: 4663 - protein, 324 aa, Candida tropicalis
MSTTPTIPTIKLNSGYEMPLVGFGCWKVNNETAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKSIADKHGKSPAQVLLRWATQRNIAVIPKSNNPERLAQNLSVVDFDLTKDDLDNIAKLDIGLRFNDPWDWDNIPIFV

SEQ ID NO: 4664 - protein, 398 aa, Cafeteria roenbergensis
MFIKRKLKETEIKDFTLNFGPQHPAAHGVLRLILELNGETIKNADPHIGLLHRGTEKLIENRNYLQALPYFDRLDYVSMMVQEHAYSLAVERLYGINIPQRAQWIRVLFSEITRILNHLLAIGCHSMDVGAMTPLLWGFEEREKLMEFYERVSGARMHASYIRPGGVAQDLPSGFVEDVYSFILDFSVRLDEIEELLTNNRIWKQRLVNVGIVTAKQAIQNGFSGVLLRSTGIPWDLRRSQPYEIYDKVPFRIPVGTRGDCYDRYLIRMQEMRQSLRIMMACLKYLPGGSIKSDDKKFVPPLRWEMKNSMESVIHHFKYFTEGFKVPAGQTYAAVEAPKGEMGVFLISDGSNQPFRCKIKAPGFFHLQNLPEMTKHHMIADVVTIIGTQDIVFGEVDR

SEQ ID NO: 4665 - protein, 961 aa, Nocardioides sp. JS614
MGDRLQGRRPRRDPPRPRHLRRLRRVRREGPVPRPRGRARPRTPGGARPPVGDHPPGVVHDPRRRHHRVRREPAEEVPGHLPDQLRQRPDRHLPGGAADRPAVDVARRAHLPGRQPAHQAGGVLGVAAQGDPAHRPRRDLPGRGVHPAGDDARPRRDRLPPVLHVLHLAQREVGARGVPPRAVPRDRPPDAAELLREHAGHPARLPAVRRARGVQDPRRDCRDRVAQLGRLRRLRAVRARRGPPRQRGVPRLGEVPDPDPRLGRRRARAPHARAVPDAPQRDPPPAPGAPAAAQRVDPLERRREHPGVQQAAGAPRRPRRCRDRGRQRRPARSSRDHGPPRPGRTRAVADRLVPGARRDHRRRLELGRAQLRAARPVPRAGAHLEREEAPVTQGLTPDPPENNPDWFKSAVFYEVLVRSFRDSNADGTGDFRGLVEQLDYLQWLGVDCLWIPPFFPSPLRDGGYDVADYTGVLPEIGTIEDFRYFLDEAHQRGLKVIIDFVMNHTSDQHPWFQASRSDPQGPYGDFYVWSDTDELYEEARIIFVDTEPSNWTWDPVRQQYFWHRFFSHQPDLNFDNPAVHDAMLDAIRFWLNMGLDGFRLDAVPYLYERPGTNGENLPETHEMLKKVRKVVDDEYPGRILLCEANQWPQDVVEYFGDFAVGGDECHMAFHFPVMPRIFMAVRRESRFPISEILEQTPAIPENCQWGIFLRNHDELTLEMVTDEDRDYMWGEYAKDPRMKANIGIRRRLAPLLDNDTNQMELFNALLFSLPGSPVLYYGDEIGMGDNIWLGDRDGVRTPMQWTSDRNAGFSSANPGKLDLPLIQDPVFGYQSVNVEAQLENTSSLLHWMRRMIHARRNHPAFGLGTFHDLGGSNSTVLSYVREYTTEDGSEDIILCVNNLSRFPQPVELDLRRFEGRRPVELIGGVPFPEIGELPYLLTLAGYGFYWFRLTAPETSEEGLLL

SEQ ID NO: 4666 - protein, 325 aa, Magnaporthe grisea 70-15
MADQHDVDLDSIIDRLLEVRGSRPGKQVQLLEAEIRYLCTKAREIFISQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPAEKKQKYVQRLGGRSSNASSRITSSKP

SEQ ID NO: 4667 - protein, 240 aa, Medicago truncatula
MATSNGTDDGTPPSESALIFLGTGCSSMVPNVLCLINPSDPPCSVCAQSLSIPPEKNPNYRCNTSMLIDYCGSGSNHNYILIDVGKTFRETVLRWFVHHRIPKIDSIILTHEHADAVLGLDDVRAVQPFSPTNDIDPTPIYLSQHSMDSIEEKFPYLVQKQRKEGQEIRRVAQMAWNIITDDCNQPFFASGLKFTPLPVNCTIFFLILRILYSFYTRTLLCFVDVGNAWRGLHLFGISFW

SEQ ID NO: 4668 - protein, 141 aa, Salmonella enterica
PKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4669 - protein, 503 aa, Mycoplasma gallisepticum R
MKKALLMILDGYGISSTTHGNAVKNAKTPHLDNLMNNNPTIMLQASGEAVGLPKNQIGNSEVGHLNIGAGRIIYTGLSLINKEIENKKFFTNQALLNAIDHAKKNNSKLHILGLVSNGGVHSHINHIYAIMELANQHNVPAILHIFGDGRDVPPTQLLADLDQLIKKAETTKTKIGTISGRFYAMDRDQRWDRIDLAYNNLLSNTGKSFADLKTYVKDSYQQNITDEFIVPAYNNNYKSDEITIQDNDSVVFANFRPDRARQLSHYVFGSNYYDHHPQLRRKNLYFVIMMQYEGINPSAICYPPKIEKNTLGEVLKNANKKQLRIAETEKYAHVTFFFDGGVEVEYQNEDKVLVPSRKDVKTYDLAPEMSAAAIVDQLLKVYTKYDLTVLNFANPDMVGHTGNYEATLKGLEALDHEIGRLLADAKKNNITVFFTADHGNAEEMIDENNQKVTKHTTNVVPFSITDPNVKFTKKEGILANVAPTILKYLEIQIPEEMDQEPLI

SEQ ID NO: 4670 - protein, 506 aa, Oryza sativa (japonica cultivar-group)
MAAMMASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWPPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 4671 - protein, 252 aa, Mycoplasma gallisepticum R
MNSMKRYIFGNWKTYKTTQEVKEFFSVLNQTKLTKNPDVVFGVAPVFVHLGLANQLERNECLVLAQDANYVMNKANTGTVSYEQLKDIGVNYVIIGHSERRKLFHESDELINQKVKTLLENKMRPILCIGETLEEYEANKTKAVLKDQLEKDLKGIDSSLLKDLIIAYEPVWAIGTGKTASSQTAQDAIAYIRTVLGLLSSKTIANELPILYGGSVTPDNVSELLAQKDINGALVGGASLDPHKFIQLIEAK

SEQ ID NO: 4672 - protein, 129 aa, Triticum aestivum
  misc_feature (3)..(3): Xaa can be any naturally occurring amino acid
  misc_feature (8)..(8): Xaa can be any naturally occurring amino acid
  misc_feature (10)..(10): Xaa can be any naturally occurring amino acid
  misc_feature (26)..(26): Xaa can be any naturally occurring amino acid
  misc_feature (87)..(87): Xaa can be any naturally occurring amino acid
  unsure (1)..(129): unsure at all Xaa locations
MSXYCGKXKXDELIKNAAYIGTPGKXILAADESTGTIGKRFASINVENVEDNRRALRELLFCTPGGLQYLSGGGFLFEETLYQSTKXGKPFVEILQGGAMSSPCIKGGTAPSSLNQRRPRAFDDLGAVK

SEQ ID NO: 4673 - protein, 149 aa, Triticum aestivum
MEQTFIMIKPDGVQRGLIGDIISRFEKKGYYLKAMKFMNVEKSFAQQHYADLSAQPFFAKLVDYIISGPVVAMVWEGKDVVLTGRRIIGATRPWEAAPGTIRGDHAVEVSRNVIHGSDSVENGKKEIALWFPGGLAEWKSNLHPWIYEN

SEQ ID NO: 4674 - protein, 311 aa, Glycine max
MDSVPSNSHGNLDEQISQLMQCKPLSEQEVRVLCDKAKEILMEESNVQPVKSPVTICGDIHGQFHDLAELFRIGGKCPDTNYLFMGDYVDRGYYSVETVTLLVALKVRYRQRITILRGNHESRQITQVYGFYDECLRKYGSANVWKIFTDLFDYFPLTALVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 4675 - protein, 566 aa, Listeria monocytogenes str. 4b H7858
MTNLRKRLSRLYAEDVVDSLAARIEARVQQTQQRKLTRKDQWDEKDIVLITYGDQFKEESKKTLKTFKKMYDSYLKSTFEVVHFLPFYPYSSDDGFSVIDYKAVNPELGDWEDIKEMEQSARLMFDFVCNHMSAKSDWFKRYLAGDEEFRNFFVEMDPKMDLSSVTRPRATPVLTPFQFDSGKVGHIWTTFSEDQIDLNFASPEVLYKMIDVLMFYLEEGAEYVRLDAVGFMWKVPGTSSIHLEETHEIVKLFRDLVDIAAPGTIIITETNVPHVDNISYFGNGEKEAHMVYQFPLPPLVLHAIHHGNAEFLRNWAKNLELPEGKRTFFNFLASHDGIGLNPVRGIIPEAEILALVNDLEEEGALVSYKQNPDGSKSPYEINVTYMDALSKQADTDDLRMSRFLVAHAVLMSIPGVPAVYVQSILGSRNDYSGVETTGHNRSINRKKYDLAEITAELEQRGSLRKATYDALTKLISTRKAESLFHPEIPMEVLESTAELFVVKRSSDVESIILIHNLSEKEVSYSLDSGVYTNLYTGSTVTGSDSIKLSGYEFCWLKTKNYREEQK

SEQ ID NO: 4676 - protein, 739 aa, Arabidopsis thaliana
MGTSVQVTPLCGVYNENPLSYLVSIDGFNFLIDCGWNDLFDTSLLEPLPRVASTIDAVLLSHPDTLHIGALPYAMKQLGLSAPVYATEPVHRLGLLTMYDQFLSRKQVSDFDLFTLDDIDSAFQNVIRLTYSQNYHLSGKGEGIVIAPHVAGHMLGGSIWRITKDGEDVIYAVDYNHRKERHLNGTVLQSFVRPAVLITDAYHALYTNQTARQQRDKEFLDTISKHLEVGGNVLLPVDTAGRVLELLLILEQHWSQRGFSFPIYFLTYVSSSTIDYVKSFLEWMSDSISKSFETSRDNAFLLRHVTLLINKTDLDNAPPGPKVVLASMASLEAGFAREIFVEWANDPRNLVLFTETGQFGTLARMLQSAPPPKFVKVTMSKRVPLAGEELIAYEEEQNRLKREEALRASLVKEEETKASHGSDDNSSEPMIIDTKTTHDVVGSHGPAYKDILIDGFVPPSSSVAPMFPYYDNTSEWDDFGEIINPDDYVIKDEDMDRGAMHNGGDVDGRLDEATASLMLDTRPSKVMSNELIVTVSCSLVKMDYEGRSDGRSIKSMIAHVSPLKLVLVHAIAEATEHLKQHCLNNICPHVYAPQIEETVDVTSDLCAYKVQLSEKLMSNVIFKKLGDSEVAWVDSEVGKTERDMRSLLPMPGAASPHKPVLVGDLKIADFKQFLSSKGVQVEFAGGGALRCGEYVTLRKVGPTGQKGGASGPQQILIEGPLCEDYYKIRDYLYSQFYLL

SEQ ID NO: 4677 - protein, 223 aa, Neisseria gonorrhoeae FA 1090
MTTQDELKRIAAEKAVEFVPENEYIGIGTGSTINFFIEALGKSGKKIKGAVSTSKKSGELLARYDIPVVSLNEVSGLAVYIDGADEVNHALQMIKGGGGAHLNEKIVASASEKFVCIADESKYVSRLGKFPLPVEAVESARSLVSRKLLAMGGQPELRIGYTTFYGNQIVDVHGLNIDQPLTMEDEINKITGVLENGIFARDAADVLILGTEEGAKVIYPCQG

SEQ ID NO: 4678 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 4679 - protein, 350 aa, Bacillus anthracis str. 'Ames Ancestor'
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNSLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKILVSPK

SEQ ID NO: 4680 - protein, 954 aa, Sinorhizobium meliloti
MSMPKDFTFTDYKPYDFANRRHIGPSPAEMDEMLKVVGYPSLDALIDDTVPPSIRQRTPLAWGAPMTEREALDKLRETANRNRKLVSLIGQGYYGTITPPVIQRNILENPAWYTAYTPYQPEISQGRLEALLNYQTMVCDLTGLDVANASLLDEATAAAEAMAIAERVAKSKAKAFFIDENCHPQTIALLKTRAEPLGWQIVLGDPFEDLDAAGVFGAIFQYPGTYGHVRDFSGLIAKLHGQGAIAAVAADPLALALLKSPGEMGADIAIGSTQRFGVPVGYGGPHAAYMAVKDAYKRSMPGRLVGVSVDARGNRAYRLSLQTREQHIRREKATSNICTAQVLLAVMASMYAVFHGPDGIKAIAQSVHQKTVRLAMGLEKLGYTVEPDVFFDTITVEVGKLQGIILKAAVAEEVNLRKIGTTRIGISLDERSRPVTLEAVWRAFGGDFKVEEFEPDYRLPQELLRTSAYLTHPIFHMNRAESEMTRYMRRLADRDLALDRAMIPLGSCTMKLNATAEMLPITWPEFSEIHPFVPADQALGYQHLIEDLSQKLCAITGYDAISMQPNSGAQGEYAGLLAIRAYHIANGNEHRDVCLIPTSAHGTNPASAQMAGMKVVVVKVSDAGEIDMDDFRAKAEQYADTLSCCMITYPSTHGVFEENVREVCEVVHKHGGQVYLDGANMNAMVGLSRPGDIGSDVSHLNLHKTFCIPHGGGGPGMGPIGVKSHLAPFLPGHPQTDGHEGAVSAAPFGSASILPISWSYCLMMGGEGLTQATKVAILNANYVAARLKGAYDVLYKSAKGRVAHECIIDTRPLAESAGVTVDDVAKRLIDCGFHAPTMSWPVAGTLMIEPTESETKAELDRFCDAMLAIREEARAIEDGRMDKVNNPLKNAPHTVEDLVGDWDRPYSREQACFPPGAFRVDKYWSPVNRVDNVYGDRNLVCTCPPIESYAEAAE

SEQ ID NO: 4681 - protein, 235 aa, Pyrococcus horikoshii
  misc_feature (1)..(1): Xaa can be any naturally occurring amino acid
  misc_feature (44)..(44): Xaa can be any naturally occurring amino acid
  misc_feature (143)..(143): Xaa can be any naturally occurring amino acid
  misc_feature (176)..(176): Xaa can be any naturally occurring amino acid
  misc_feature (186)..(186): Xaa can be any naturally occurring amino acid
  unsure (1)..(235): unsure at all Xaa locations
XLGLKTSIIGRRVIYFQEITSTNEFAKTSYLEEGTVIVADKQTXGHGRLNRKWESPEGGLWLSIVLSPKVPQKDLPKIVFLGAVGVVETLKEFSIDGRIKWPNDVLVNYKKIAGVLVEGKGDKIVLGIGLNVNNKVPNGATSXKLELGSEVPLLSVFRSLITNLDRLYLNFLKNPXDILNLVRDNXILGVRVKILGDGSFEGIAEDIDDFGRLIIRLDSGEVKKVIYGDVSLRFL

SEQ ID NO: 4682 - protein, 335 aa, Leptospira interrogans serovar Lai str. 56601
MTRIAINGFGRIGRLVFRAGIKDPNLEFVAINDLVTPDNLAYLLKYDSTHGRFQGTVEHTEKELIVDGKKILCVSERDPEKLPWKDLKVDYVIESTGLFTDRVGAEKHIKAGAKKVVISAPAKDKDIPTFVMGVNNEKYNPSNDHIVSNASCTTNCLAPIVKVVLDNWGIEEGLMTTIHATTATQPTVDGPSKKDFRGGRGAMQNIIPASTGAAKAVGLCIPEVNGKLTGMSFRVPTPDVSVVDLTVRTTKETSLKEISAKMKAASEGAMKGILGYTEDMVVSNDFVSSTLSSIFDMDACIELNSRFFKLVSWYDNEMGYSNRVLDLIRYMAKKG

SEQ ID NO: 4683 - protein, 511 aa, Pseudomonas putida KT2440
MTSTPKPLVLIILDGFGHSDIPEHNAIFAANKPVYDRLCATQPHGLISGSGMDVGLPDGQMGNSEVGHMNLGAGRVVYQDFTRVTKAIRDGEFFENPVLTGAVDKAVGAGKAVHILGLLSDGGVHSHQDHLVAMAELAAQRGAEKIYLHAFLDGRDTPPRSAQSSIELLDATFAKLGKGRIASLIGRYYAMDRDNRWDRVSAAYNLIVDSAAEYTADTALAGLEAAYARDESDEFVKATRIGEAVKVEDGDAVIFMNFRADRARELSRAFVEPDFTEFARARLPKMAAYIGLTQYSAKIPAPAAFAPSSLNNVLGEYLAKNGKTQLRIAETEKYAHVTFFFSGGREEPFEGEERILIPSPKVATYDLQPEMSAPEVTDRIVEAIEQQRFDVIVVNYANGDMVGHTGVFEAAVKAVEALDTCVGRIVDALDKVGGEALITADHGNVEQMEDECTGQAHTAHTTEPVPFIYVGKRNVKVREGGVLADVAPTMLKLLGLEKPVEMTGTSILVDA

SEQ ID NO: 4684 - protein, 476 aa, Sulfolobus tokodaii str. 7
MSSYEDLLKVLDSRKVTRLYWIITILAAIGGFLFGYDTAVIGTAAEFAPYHYSGFLLGYEIASASLGAAIGAIIAYFYTDRYGRKSLLILDAGIYTAAAVLSALTINGIMLLVMRTIIGIAIGADSAVATAYITEYAPKDKRGSLAIMQQWMITIGILGSYLVGSAILYFLPSLAYVFDWRLILGLAAVPALIGLIFRFMMPESPRWLIYTGQFDKLKRELAKFGISVSDDVLERTRTEIQSEMSIKLDTAAKKALLLVGLWLVFQQITGINVPFYYGPILLSKLHIFSSTTNPVYSAIDGVLESTILAVINVAATYIAFRYIDKIGRRTLGISAYIGMAIFDLIGGISTLFGFDIGLLISFAGFIIFFAYGVGGTGWLIQAEYFDTRIRGRMAAIGALIDWLANFALIEVFPVMLSTVGLGGSMFIFFILDLVALVFVYFFIPETKGMSLEDVVKMFSSVPISKIKNGREIVLSK

SEQ ID NO: 4685 - protein, 299 aa, Magnaporthe grisea 70-15
MSAPDRLTFIGGGHLAQAVLSGIYSSGTAWKDSCAVAVTARRPEHAAQLRRRYPLALATTDNLHPRIWAADDRGADPDHHHHHVVFICTRPAEVPQVCREIAGALAALRAAARPTVVTMCPGVSVAQLLSWLPRGTPVVRSMPNLPVTRRQGATALFPSADAVGGSVELVAAVLGLVSPAVSVLPEESLLDVAASVSGSAPAYFYYLIESLVSAAEARGMSAETARSLVVQSCLGSGVLARDSDKPVRVLREEVCVPGGSTEKAVAHLMDKGLPDIVLGAVDRSLKANREMGCVRDEQV

SEQ ID NO: 4686 - protein, 325 aa, Cryptococcus neoformans var. neoformans B-3501A
MSLGRTLKLNNGVVAPQIGFGTWQAAPGEVEKAVEEAIKVGYRHIDCALIYRVFDATGVYGIVAQGIKASGVPRKDLFLVSKLWNNSHRPEKVEADLDTSLKQLGTDYLDVYLIHWPVPFAPGDNLFPKTEDGKVAIDWDGPSVVDTWKELIRISKETKKVKAIGVSNFNVELLEKLIKETGVVPTMNQIECHPSLIQPELFKYCKEKNIVITAYSPLGNNTTGKPRIIDQPQIIDIAKKLNKEPAQVLINWAAHQGFAVIPKSVTPSRIKSNFEDFKLNDDVFEEINKVGKANAARANIPAEYNPSWPINVFGEKSEEQYKKVW

SEQ ID NO: 4687 - protein, 357 aa, Rubrobacter xylanophilus DSM 9941
MPEKKMMRAAVYRGPRELRVEPVPVPEIGPSDVLVRVHSCGICGSDLHSYKAGMYIRPGQIMGHEFMGTVAAAGEDVEGVEEGDRVTGFSIGVCGSCYWCSRQQYILCPELFRNSTGYGLPGGFAEYVPIRNAVVGQSIHPVPSELDDETAATTEPVSVGVGAIEAAGVRPGDRVVVLGAGMIGNACMQAARAAGAGQVAVIDVSPVRLEAARSLGADAVFDARTGDALSWVKELWGVGRYHFNEGGMADVVVEAAGAPVTVQQAFEMVRSGGAIVFVGLPEEPAPIDVTKIVHKQPRIVGSLGGDFARAIELMASGSIRTKELITHRFPLEDAAEAFETQLRTGEAMKVMIQPREG

SEQ ID NO: 4688 - protein, 400 aa, Xanthobacter autotrophicus Py2
MSLISSALKRIKPSQTIAISNKARELKAAGRDIVALSAGEPDFDTPENIKEAAIAAIRRGETKYTAVDGIPELKAAICRKFKRENDLDYKPSQVTVGTGGKQVLFNALVATVDAGDEVLIPAPYWVSYPDIVEFCGGKPVPVMTTIEDNFKLRPDVLEAAITPKTKWLIFNSPSNPSGAAYSFDELKALTDVLVKYPQVWILTDDMYEHLVYDDFKFVTPAQVEPKLYNRTLTMNGVSKAYCMTGWRIGYAAGPEALIKAMGTLQSQSTSNPSSIAQWAALEALDGPQDFIAANNKVFKERRDLVVSMLNQAKGLHCPKPEGAFYVFPSCAGTIGKTTPGGVTIASDEDFATQLLEAEGVAVVHGSAFGLGPAFRISYATATSDLEEACRRIQRFCGSLS

SEQ ID NO: 4689 - protein, 483 aa, Mycoplasma mobile 163K
MNVLEKEKGVNLTDKRSKMIATIGPSSQNKEILKQMMLKGMTTVRANFSHGDHAEQLNKFVLAKEVAKELNLPMSLMLDTKGPEIRVGKMKDGSQKIEVGKIITVLTDEVSYKTFEGIPTKFTVSHRMDKDVKVGSYILFDDGKLTTIVTGVKSGIVEVKTINSHVLKSNKRINIPGAQLSLEFLSKKDKEDIIFGIKNDVNYIAASFVNSKQDVLDLRKLLKDNNGEHIQIISKIESVFGIENIDEIIEASDGIMIARGDLGLEIPYFEVPFYEKQIIRKCRNVGKPVIVATQMLDSMEKLPQPTRAEVSDVYWATELGADATMLSGESANGDFPVESVEVMSTINRRAEKEFYNKLYYPAHLETLIQNPVGVHSKLASEVALKVMNGDYKFSVILSETGRLLKEIARFRPNTVIIGVINNDKLIHGFGITHSVFMSVDSKAVKSEIEKNLTKAREVLKPFFPKKGDKYLVVENNKISEYIY

SEQ ID NO: 4690 - protein, 543 aa, Candida tropicalis
MSSSPSIAQEFLATITPYVEYCQENYTKWYYFIPLVILSLNLISMLHTKYLERKFKAKPLAVYVQDYTFGLITPLVLIYYKSKGTVMQFACDLWDKKLIVSDPKAKTIGLKILGIPLIETKDPENVKAILATQFNDFSLGTRHDFLYSLLGDGIFTLDGAGWKHSRTMLRPQFAREQVSHVKLLEPHMQVLFKHIRKHHGQTFDIQELFFRLTVDSATEFLLGESAESLRDESVGLTPTTKDFDGRNEFADAFNYSQTNQAYRFLLQQMYWILNGSEFRKSIAIVHKFADHYVQKALELTDEDLEKKEGYVFLFELAKQTRDPKVLRDQLLNILVAGRDTTAGLLSFLFFELSRNPEIFAKLREEIENKFGLGQDARVEEISFETLKSCEYLKAVINETLRIYPSVPHNFRVATRNTTLPRGGGEGGLSPIAIKKGQVVMYTILATHRDKDIYGEDAYVFRPERWFEPETRKLGWAYVPFNGGPRICLGQQFALTEASYVTVRLLQEFGNLKQDPNTEYPPKLQNTLTLSLFEGAEVQMYLIL

SEQ ID NO: 4691 - protein, 1007 aa, Oryza sativa (japonica cultivar-group)
MALAGSMAAAAATSTLLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNLRVLDFYNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPVPVGIGGLVGLQKLLVAGNRLSGELPREIGKLQQLSKADLSGNLISGEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHELTHVFYVAMLCVAEQSVERPTMREVVQILTDLPGTAAATAMDAPSHGSGKEQDRSAEMQQQDGSRESPPQQDLLSI

SEQ ID NO: 4692 - protein, 348 aa, Arabidopsis thaliana
MKATLAAPSSLTSLPYRTNSSFGSKSSLLFRSPSSSSSVSMTTTRGNVAVAAAATSTEALRKGIAEFYNETSGLWEEIWGDHMHHGFYDPDSSVQLSDSGHKEAQIRMIEESLRFAGVTDEEEEKKIKKVVDVGCGIGGSSRYLASKFGAECIGITLSPVQAKRANDLAAAQSLSHKASFQVADALDKPFEDGKFDLVWSMESGEHMPDKAKFVKELVRVAAPGGRIIIVTWCHRNLSAGEEALQPWEQNILDKICKTFYLPAWCSTDDYVNLLQSHSLQDIKCADWSENVAPFWPAVIRTALTWKGLVSLLRSGMKSIKGALTMPLMIEGYKKGVIKFGIITCQKPL

SEQ ID NO: 4693 - protein, 143 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4694 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDFTLIMQLLRDNLTLWTSDAEYSAAAAGGNTEGAQENAPSNAPEGEAEPKADA

SEQ ID NO: 4695 - protein, 238 aa, Synechococcus sp. WH 7805
MSELQNQMKQAVADAAVEQFQDGMVVGLGSGSTAALMIKGLGERLAAGQLNDIVGVTTSFQGEVLAAELGIPLRSLNAVDRIDLAIDGADEVDPSFQLIKGGGACHVQEKLVAARADRFIVVVDSTKLVERLNLGFLLPVEVLPGAWVQIRQQLNAMGGEAELRMATRKAGPVVTDQGNLVLDVRFEGGIADPVSLEKDINNIPGVLENGLFVNLADEVLVGQVDDGVASARSLERAR

SEQ ID NO: 4696 - protein, 366 aa, Sinorhizobium meliloti
MSYDQKRVVEAIRAFEAGEIVVVTDDGGRENEGDLIVAAVHCTPEKMAFIVRHTSGIVCTPMPREEAKRLNLNAMVAENDSAHTTAFTVSVDFKHGTTTGISADDRTLTVRNLANPNVGPTDFVRPGHIFPLVAREGGVLMRSGHTEAAVDLCRLASLPPIGVICELVNDDGTVMRGPQVEAFAETHGLKQVSVADLIAYRQRKETLIEQGHSFEMDTPYGKAKGHTYSLPWDTMQHLAVVFGDIRDGVDIPVRLHLENVGADVFGRGRQIDEIMKRIAAEGRGVIVYLREGSVGVGISQTARKGKHEREVHSEAQERESEWLEIGLGAQILKDLGITSIRLLSSRERHYVGLEGFGIKIAATEIL

SEQ ID NO: 4697 - protein, 375 aa, Nicotiana tabacum
MSVTELKERHMAATQTVSDLREKLKQKRLQLLDTDVSGYARSQGKTPVTFGPTDLVCCRILQGHTGKVYSLDWTPEKNRIVSASQDGRLIVWNALTSQKTHAIKLPCAWVMTCAFSPSGQSVACGGLDSVCSIYNLNSPIDKDGNHPVSRMLSGHKGYVSSCQYVPDEDTHLITSSGDQTCVLWDITTGLRTSVFGGEFQSGHTADVQSVSISSSNPRLFVSGSCDTTARLWDNRVASRAQRTFYGHEGDVNTVKFFPDGNRFGTGSEDGTCRLFDIRTGHQLQVYYQPHGDGDIPHVTSMAFSISGRLLFVGYSNGDCYVWDTLLAKVVLNLGGVQNSHEGRISCLGLSADGSALCTGSWDTNLKIWAFGGTEV

SEQ ID NO: 4698 - protein, 376 aa, Photobacterium profundum SS9
MSDQFIKSKAAIAWGPKQPLSIEEIDVMLPRAGEVLVRIVATGVCHTDAFTLSGDDPEGIFPVVLGHEGGGIVEQIGEGVTSVQVGDHVIPLYTAECGECKFCKSGKTNLCQAVRETQGKGLMPDGTTRFYKDGQPLFHYMGCSTFSEYTVLPEISLAKVSKEAPLEEICLLGCGVTTGMGAVLNTAKVEKGDTVAIFGLGGIGLSAIIGAKMAGASRIIGVDINESKYKLATKLGATDCINPTKFDKPIQDVIVEMTDGGVDYSFECIGNVNVMRSALECCHKGWGESVIIGVAGAGQEISTRPFQLVTGRVWRGSAFGGVKGRSELPEIVERYMAGEFALDDFITHTMGLEGINDAFDLMHEGKSIRSVIHFDK

SEQ ID NO: 4699 - protein, 255 aa, Humulus lupulus
MASSAPATALRTISSSSPKLHNTRSPFSSSLSPPKSSLSFTKVLSPALISTPKLQITSNPSSKTYITCRSQASPSESEKPIKVHELRVYEINERDRSSPAYLRLSQKEVNSLGDLVPFSNKLYTGCLQKRIGITAGICILIQNKAEKKGDRYEAIYSFYFGDYGHLSVQGSYMTYEDTYLAVTGGSGIFEGAYGQVKLQQLIFPFKLFYTFYLKGIKEDLPEELLGVHVEPSPSVEPSPAAKACEAHAVIQSFTD

SEQ ID NO: 4700 - protein, 451 aa, Nocardioides sp. JS614
MVDQATLEVPAQLRSDRGLPLVGRLFDYTRDPIGFFRHQWETYGPVSPFDSALDHAVVLLGPDACEQVLRNKDKAFANEPAWGKIVGPFFKRGLMLLDFDEHHAHRRIMQEAFTRDRLETYATRMHPAIAEGTASWDTERRFRSYPALKQLTLGIAADIFMGGAGDTSRAEMDRVNRAFIACVQAAAGIVRADVPFTRWGRAYRGRKVLEEFLRHYLPAKRATRTEDIFSVLCHIETEDGQRFSDEDVVNHMIFLMMAAHDTSTITTSTILQLLGQHPLWQERCRAEALALGPEPTLAELEGLQALDWVMKEALRLHAPVPILVRRTVKDTVVQGHLIPADTDVMVGVQFSHVMEDYWTDPMVFDPERFSPERREDRSHRYAWEPFGGGVHKCIGLYFAGIEVKAILHRLLRNHRWSVDPGYAAPYDNHSLPFAKDGQPIDLVRTDPRGES

SEQ ID NO: 4701 - protein, 498 aa, Leuconostoc mesenteroides subsp. mesenteroides ATCC 8293
MNMTEQNKRPYQKSRNNNGKKPYYGKNFDPRKSGAPRGNTSEGVNVRVGQNFPLTIKRLGINGEGIGYFKRKIVFVPGALPDEVAVVKVTEVEPKYIAAKVLKIREKSPDRVKPLDEFADSVGGFELEHMNYPAQLRFKKDVLVQSLEKFQPKGWSNYDIRDTIGMDHPYEYRNKAQFPVRKIGDKLSVGMYKRGSHDLVDLPVVHTQTPATMKVMRTVRELLDKLSVSIYNEDKNRGTVKTIVARVSQTTSEVQLTFITNTDGFPGDTALIEAINQALPEVTGIFQNYNPGRTSLVWGEETLKLWGKDYIEEKVLGKTFQLSPRAFMQLNHTQMSVVYNQALAALDLTHADKLVDAYAGVGTIGLSLADKAGEVRGMEIIPEAVDDANQNATLNHISNAHYEVGTAEKLFPKWQSEGWIADALVVDPPRTGLDTALRREILRTQPEKFVYISCNASTLARDLVDLSKAYQVDYIQSIDMFPQTARWEGVVKLTKRQK

SEQ ID NO: 4702 - protein, 254 aa, Humulus lupulus
MASAGPATALRTISSSSPKLHNTRSPFSSSLPPPKSSLSFTKALSPSLVSTPKLQITSNPSSKTLFTCRSQASPSESETPTKVQELHVYEINERDRSSPAYLRLSKKEVNSLGDLVPFSNKLYTGCLQKRIGITAGICILIQNKAENKGDRYEAIYSFYFGDYGHLAVQGSYLTYEDTYLAVTGGSGIFEGVSGQVKLHQLIFPFKLFYTFYLKGIKDLPEELLGVHVEPSPAVEPSPAAKACEDHAAIKSFTD

SEQ ID NO: 4703 - protein, 275 aa, Alkalilimnicola ehrlichei MLHE-1
MSNNTLCFIGGGNMARSLIGGLLADGFDPQAVRVADPDAGKRDDLANRFGVRVYADNLEAAADADTVILAVKPQVVRTACEQLVAGSGDAGRLFISIAAGVREPDLTRWLGGQAAVVRTMPNTPSLVGTGATALYANDRVKERQRELAESLMRAVGLVVWLDDEAQMDTVTAVSGSGPAYFFLLMEAIEDAARDLGLPGETARLLTIETALGAAKMALESDESPAQLRQRVTSPGGTTEHALHVLEDGEYRALMTRAVQAAAKRAQELGQMLGEQ

SEQ ID NO: 4704 - protein, 400 aa, Mesorhizobium loti MAFF303099
MAFLADTLSRVKPSATIAVTQKARELKNAGRDIIGLGAGEPDFDTPDNIKNAAIEAIRRGETKYPPVSGIVPLREAIAKKFKRENNLDYKPEQTIVGTGGKQILFNAFMATLNPGDEVIIPRPYWVSYPEMVAICGGTSVFADTSIENGFKLTAEVLEKAITPKTKWLLMNSPSNPSGAAYTQAELRALADVLLKHPHVWTLTDDMYEHLTYGDFAFKTIAEVEPKLYERTLTMNGVSKAYAMTGWRIGYAAGPVQLIKAMDMIQGQQTSGACTIAQWASVEALNGPQDFIARNKAIFQGRRDLVVSMLNQARGITCPSPEGAFYVYPSCAQLIGKKTKAGKVIDTDEAFCSELLEAEGVAVVFGSAFGLGPNFRISYATSDALLEEACTRIQRFTASLT

SEQ ID NO: 4705 - protein, 510 aa, Mycoplasma mobile 163K
MKKTVILSVIDGLGLREEKQGNAFKLAKTPNFDKLFNEYPNSVIQASGDYVGLPDDQMGNSEVGHLNIGAGQIVYTGLSLINKDIKDNKFKQNAKFIAAFNAVKKNNETNTLHLMGLLSDGGVHSHEEHLFKLIEAAHENGLKNVSVHVFGDGRDVAPRSILTSIKKLEAITKKYNYAIGSIMGRFYAMDRDQIFTRNEQALEVMMGKTTNYFTNASEYIKAQYQKDISDEFFIPAINKDYLAKKLNLKDNDAVIFYNFRPDRARQLSHLLIQSNLYNYQSKNQVKLSNFTSMMKYEGLDTNIAYEEMKITNPLGNILAKNGLSQLRIAETQKYAHVTFFFDGGNDVLYENEERILIDSVKADSFADYPEMSAAGITDTLIANLGKYDVIILNYANPDMVGHTGNLKATIKALEFLDFQYGKILKAIEKTNHTLFITADHGNAEITEDENGNPATKHTTSPVMLIVTDKNLKLNSGTLANIAPTILDYLKIPKPKNMLDSLIMNNKRTSK

SEQ ID NO: 4706 - protein, 851 aa, Brassica napus
  misc_feature (304)..(304): Xaa can be any naturally occurring amino acid
  misc_feature (837)..(837): Xaa can be any naturally occurring amino acid
  unsure (1)..(851): unsure at all Xaa locations
MKGVRNIYDHHSYTFLLVFVVMILFHPALSIYINTLSSTESLTISNNRTLVSPGDVFELGFFKTTSSSRWYLGIWYKQLPEKTYVWVANRDNPLPNSIGTLKISNMNLVLLDHSNKSVWSTNLTRRNERTPVMAELLANGNFVMRDSNNNDASEFLWQSFDYPTDTLLPEMKLGYNLKKGLNRFLISWRSSDDPSSGDYSYKLEPRRLPEFYLLQGDVREHRSGPWNGIRFSGILEDQKLSYMEYNFTETSEEVAYTFRMTNNSFYSRLTLSSTGYFERLTWAPSSVIWNVFWSSPANPQCDMXQMCGPYSYCDVNTSPSCNCIQGFDPRNLQQWALRISLRGCKRRTLLSCNGDGFTRMKNMELPETTMAIVDRSIGEKECKKRCLTDCNCTAFANADIRNGGTGCVIWTGNLADMRNYVADGQDLYVRLAAADLVKKSNANGKIISLIVGVSVLLLLIMFCLWKRKQNREKSSAASIANRQRNQNLPMNGIVRSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFERDETEANTMKVVGTYGYMSPEYAMGGIFSEKSDVFSFGVMVLEIITGKRNRGFDEDNLLSCAWRNWKEGRALEIVDPVIVNSFSPLSSPFQLQEVLKCIQIGLLCVQELAENRPTMSSVVWMLGNEATEIPQPKSPGCVRRSPYELDPSSSRQRDDDEXWTVNQYTCSVIDAR

SEQ ID NO: 4707 - protein, 388 aa, Oryza sativa (japonica cultivar-group)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 4708 - protein, 363 aa, Oryza sativa (japonica cultivar-group)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 4709 - protein, 320 aa, Oryza sativa (japonica cultivar-group)
MSGRRDDSAKMAKLKELLHRSENCICADCSAPDPKWASANIGVFICLKCSGVHRSLGTHISKVLSVTLDQWSDNEIDNVIEVGGNSHANAIYEAFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQAFDHDMLSKDDLMGEAEIDLQPMINAAAAFGDPGLLGDRQIGRWLKSGDNALVRDSAVVVPGGEVRQELALKLQFTESGEVELEMQWFPLNM

SEQ ID NO: 4710 - protein, 384 aa, Oryza sativa (japonica cultivar-group)
MASATLLKSSFLPKKSEWGATRQAAAPKPVTVSMVVRAGAYDDELKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 4711 - protein, 205 aa, Oryza sativa (japonica cultivar-group)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGGHVRQELRLLIRSNPIKTVNLLLLLLRTTATAILLVPRGHCSQCVVTVTG

SEQ ID NO: 4712 - protein, 78 aa, Ralstonia solanacearum
MLPTPEQIKQYIEAGLPCEHLEVEGDGQHFFATIVSAQFEGKRLIQRHQLVYAALGDRMRAEIHALSMKTLTPAEWRP

SEQ ID NO: 4713 - protein, 315 aa, Haemophilus influenzae 86-028NP
MKIVFLDSTAIPKHISIPRPSFEHTWTEYDHTSSAETIERAKDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKDLINTETLSKMKKGAFLINTGRGPLIDELALVDALKTGHLGGAALDVMVKEPPEKDNPLILAAKTMPNLIITPHIAWASDSAVTTLVGKVMQNIEEFVQQLHQK

SEQ ID NO: 4714 - protein, 142 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 4715 - protein, 334 aa, Brassica napus
MEIMPRENENALSAPTPMELGPGPYGKQRTSSLEAPIMLLTGHPSAVYTMKFNPSGTLIASGSHDREIFLWRVHGDCKNFMVLKGHKNAILDLHWTSDGSMIVSASPDKTVRAWDPPTRPQVKKMAEHSSFVNSCCPTRRGLPLIISGSDDGTAKLWDLRQRGAIQTFPDKYQITAVSFSDAADKIFTGGVDNDVKVWDLRKGEATMTLEGHQDTITGMSLSPDGSYLLTNGMDNKLCVWDMRPYAPQNPGVKVFEGHQHNFEKNLLKCSWSPDGTKVTAGSADRMVHIWDTTTRRILYKLPGHKGSVNECVFHPSEPIIGSCSSDKDIYLGEI

SEQ ID NO: 4716 - protein, 272 aa, Amycolatopsis mediterranei
MTKPTPNEIGKGYDAFADLLDQFWGENLHHGYWDDESATLEEATTRLTDRLAGMLPLRAGDRLLDIGCGNGEPAIRMATANDVMVTGISISEKQVERANDRAYKADVDDRVVFEYADAMELPYPDASFDVVWALESLHHMPDRWHVIRQAARVLRPGGRLALGDFLLVPSPAGLEADAERVREVGKGVVAVVSLDEYQAHLREAGLEPESAEDVSQYTRPSWTKAAERFEGLREQALQHIEAAQFEVTLGRFRAFSEEPSLGYVLLTARKPD

SEQ ID NO: 4717 - protein, 337 aa, Nicotiana tabacum
MAKVKIGINGFGRIGRLVARVALQRDDVELVAVNDPFISVEYMTYMFKYDSVHGQWKHHELKVKDDKTLLFGEKAVTVFGFRNPEEIPWGQTGADYIVESTGVFTDKDKAAAHLKGGAKKVIISAPSKDAPMFVVGVNEKEYKPELNIVSNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEATYDEIKAAIKEESEGKLKGILGYTEDDVVSTDFVGDNRSSIFDAKAGIALSKNFVKLVSWYDNEWGYSTRVVDLIKHMASVQ

SEQ ID NO: 4718 - protein, 599 aa, Zea mays
MASAKESYRAELRASSRQLGERCLYSAAKWAAELLVGVELDGTPVPSAATDSPSSSSAASAGRLLHLHRSGGSSFRHRPRPGGGSSSEAGTPLGGVSYVSTPIPDDDAFDSGGDKYLLAKTYFDCREYRRAAHVLQNQVGRKAVFLRCYALYMAGEKRKEAEMIELEGSLGKSNAVNQELVALEKELSTHRRTGSIDSFGLYLYGIVLRDKGCEGLARTILVESVNTYPWNWSAWSELQSLCTSSDILNNLNLKNHWMKDFFLASAYLELKMHEEALKRYERLMGVFRCSGYIQAQIATVQYSMRDLDEAEMIFEELLRTDPFRVDSMDIYSNLLYAKESLTALSFLAHRVFLTDKYRPESCCIIANYYSLKGQHEKSVLYFQRALKLNRKYLSAWTLMGHEYVELKNSPAAIDAYRRAVDINPRDFRALYGLGQIYEMMGMPFYALYYFRKSSYLQPNDARLWIAMAQCYESDPLQMIEEAIKCYERAANSNDTEGIALHQLAKLHGMLGQSEEAAFYYKKDLERMEVEERQGQNFVEALLFLAKHYKSIGRFEDAEHYCTRLLDYTGPEKETAKNMLQGIKRLQSGFPSMDIDHFAL

SEQ ID NO: 4719 - protein, 406 aa, Coxiella burnetii RSA 493
MQKPFDNIETAIVALRQGKMIILVDDESRENEGDLIIAAEHATPEHINFMTLYGRGLICLPMCSSDFERLNIPMMTSRNGSRYETPFGVSIEAAYDVTTGISAHDRARTIQIAIDEKSTPEDIIMPGHMFPLKANDAGVLARAGHTEGSVDLCRLAGLKPAAVLCEILNKDGSMARLPDLQLLAKQFRLPLVSIQDLITYRINHETLIDEVSESLLPIKNRGRFTIKTFRSRVDHLEHVALVNQKIEEDKPCLVRVHSECLTGDVFGSARCDCGGQLEAALDEIATQGGVLLYLRQEGRGIGLANKIKAYALQEAGLDTVEANHHLGFGADLRDYGLAAQMLRVLGIREIRLLTNNPNKVESLTRYGISVAERVALETAPTCDNIRYLKAKREKLGHLLNLIGEAK

SEQ ID NO: 4720 - protein, 408 aa, Bacillus subtilis
MSPMDHLVFEVGTALVLVAIASVIANKIKFSIIPFLIVLGMLVGPHAPKMGIIDLTFIQSSEIIEFFGRMGVLFLLFYLGLEFSVGKLIKSGKSIAVGGTIYILINFSLGLLYGFITGFSFLEVLILAGVITISSSAIVAKVLVDLKRTANPETELILGIIMFEDIFLAVYLSVVSGLILGDATSVGSALLSILIAFGYMLLFFIAARKLPPLLNKLLDIRSNEVFIIVIFAALFFIAGFSETIHVAEAIGALLLGLVFSETEHSDRIEHLVVPFRDFFGAMFFFSFGLSIDPFSLGEAVWLALGAVILTILGNFIAGMVAGRRAGLSHKASSNIGLTIVSRGEFSIIVANLGIAGGLSATLKPFAALYVLILAILGPLVTKESKRIYRLLNKVFKWKPEVQPAKKQG

SEQ ID NO: 4721 - protein, 463 aa, Bacillus anthracis str. 'Ames Ancestor'
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNRQKLSYKMPLYPLSSYFSLAFLVLVLGIMAYSEDTRIALIVGPIWLIGLAIVYYMKGFHKIDETPNSKIS

SEQ ID NO: 4722 - protein, 218 aa, Triticum aestivum
  misc_feature (140)..(140): Xaa can be any naturally occurring amino acid
  unsure (1)..(218): unsure at all Xaa locations
MSAFVGKYADELIKTAKYIATPGKGILAADESTGTIGKRLASINVENVESNRQALREMLFTAPGALEYLSGVILFEETLYQTAADGTPFVDILKGRNVIPGIKVDKGTVDIAGTVGETTTQGLDSLGARCAKYYEAGARXFAKWRALLKIGAGARALRNSPVEQKPPGAWPRYPPPLARRTGWGPLRGTPKSSTDGPATKFKGLGPPPPRRGVLPRPV

SEQ ID NO: 4723 - protein, 255 aa, Xanthobacter autotrophicus Py2
MAHYEFQGSTVPIVRFTQIGSTNAEGMARLGRSETFPVWLVADIQTAGRGRRGRPWTSELGNLFASLVLPNPAPVANLAQLCFVAGLALRDAVLAAAPQIRPDALRLKWPNDLLLDGGKVAGILVEGGADPSGRPAAVIGFGVNCLHHPDDLPYRATSLEESGAPTAPDRLLEALDLAMAVRLNQWNAGAGFPAIRSDWMRYALGMGDQVSVKIGEREVVGRFENIDTRGAMMLRRKDGIAEIITAGDVSLGKSD

SEQ ID NO: 4724 - protein, 475 aa, Streptomyces coelicolor A3(2)
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 4725 - protein, 409 aa, Pseudomonas aeruginosa PAO1
MSKTSLDKSKIKFLLLEGVHQNAVDTLKAAGYTNIEYLKTALSGDELKERIADAHFIGIRSRTQLTEEVFDCAKKLIAVGCFCIGTNQVDLNAARERGIAVFNAPYSNTRSVAELVLAEAILLLRGIPEKNASCHRGGWIKSAANSFEIRGKKLGIVGYGSIGTQLSVLAEALGMQVFFYDTVTKLPLGNAVQIGSLHELLGMSDIVSLHVPELPSTQWMIGEKEIRAMKKGGILINAARGTVVELDHLAAAIKDEHLIGAAIDVFPVEPKSNDEEFASPLRGLDRVILTPHIGGSTAEAQANIGLEVAEKLVKYSDNGTSVSSVNFPEVALPSHPGKHRLLHIHANIPGVMSEINKVFADNGINVSGQYLQTNEKVGYVVIDVDAEYSDLALEKLQQVNGTIRSRVLF

SEQ ID NO: 4726 - protein, 228 aa, Leuconostoc mesenteroides subsp. mesenteroides ATCC 8293
MSSSQDLQKIIAGRRAADFVQDGMVVGIGSGSTIAQVITALGERVANENLKIVGVPTSEKTRRNAAKLGIPMYNVDDVDKIDLTIDGADQISDDFSAIKGGGAALLWEKIVAFNSRENIWVVDSSKRVSKLNQYLPVEIIPYGSDQLFKRFTADGFHPTWRLDQNGNPVRTDSANYLIDLHVPVIEDPRDLGQELINMVGVVEHGLFTDVVNRVVIGSDDGVEIIEAP

SEQ ID NO: 4727 - protein, 306 aa, Pyrococcus furiosus DSM 3638
MKVLVAAPLHEKALNILKDAGFEVIYEEYPEENRLLELVRDVEAIIVRSKPKITRKVIENAPKLKVIARAGVGLDNIDVEAAKEKGIEVVNAPAASSRSVAELAVGLMFAVARKIAYADRKMREGKWAKKECMGIELEGKTLGIIGFGRIGYQVAKIARALGMKLLLYDPYPNEERAKEVGGKFVDLETLLKESDIVTIHVPLIPETYHLINEERLRLMKRTAILINTSRGAVVDTQALIKALEEGWIAGAGLDVFEEEPLPENHPLTKFDNVVLTPHIGASTYEAQERAGVEVAEKIVEILKKSS

SEQ ID NO: 4728 - protein, 455 aa, Deinococcus radiodurans R1
MPSPRFASLRNMTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 4729 - protein, 512 aa, Clostridium perfringens SM101
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKEFIVELENAMKEIGVGEIATISGRYYAMDRDNRWERVELAYNAMVLGEGEKASSAVEAIEKSYHDNKTDEFVLPTVIEEDGHPVSRIKDGDSVIFFNFRPDRAREITRAIVDPEFKGFERKQLHVNFVCMTQYDKTLECVDVAYRPENYTNTLGEYVASKGLNQLRIAETEKYAHVTFFFNGGVEQPNTNEDRALIASPKVATYDLKPEMSAYEVTDELIKRLDEDKYDMIILNFANPDMVGHTGVQEAAVKAIEAVDECLGKVADKVLEKEGTLFITADHGNAEVMIDYSTGKPMTAHTSDPVPFLWISKDAEGKSLKDGGKLADIAPTMLTVMGLEVPSEMTGTCLLNK

SEQ ID NO: 4730 - protein, 131 aa, Oryza sativa (japonica cultivar-group)
MGMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 4731 - protein, 462 aa, Xanthomonas campestris pv. vesicatoria str. 85-10
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQVVVVIAAEAVGAAGLLATVWPALPVPLLALLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLDVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILGVIFVLLASSADTRAQFLSMVALTAVIAAVSEVARRLRARM

SEQ ID NO: 4732 - protein, 231 aa, Oryza sativa (japonica cultivar-group)
MVPRSRRPCLARGGILPAGRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 4733 - protein, 145 aa, Oryza sativa (japonica cultivar-group)
MAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 4734 - protein, 482 aa, Xanthobacter autotrophicus Py2
MSSDVTYPDVQLHIDGVWRDADGGKRIPVINPATEEEIGSVAHCSIADLDEALAATERGFATWSRTSAFERSKLMRKAADILRERANSIARLMTLEQGKPLPEARMETLAAADVIDWFAEEARRAYGRVIPARAPGVYQLVIKEPVGPVAAFTPWNFPINQVVRKLCGALAAGCSIIVKAPEETPASPAELIRAFVDAGVPKGVIALVYGVPAEVSEYLIPHPVIRKITFTGSTPVGKKLAALAGAHMKRVTMELGGHSPVIVFDDADVQAAAKQIATAKFRNAGQVCVSPTRFLVQEKVYEQFVDTFVTVAKAVKVGNGLDEGTTMGPLANDRCIPAMEALIADARQKGAEVKTGGSRIGNKGYFFEPTVVTGVTREMRMMNEEPFGPLAMLLPFADFDEAITEANRLPYGLASYAYTSSAKTAQAVAHQVQAGMMTINHLGLALPEVPFGGVRDSGYGSEGGSEAIEAYLNPKFVSQAGV

SEQ ID NO: 4735 - protein, 569 aa, Magnetococcus sp. MC-1
MARRAKIVATLGPACSSVEQITRLIEAGLDVARLNMSHGDHKAHLELIHNVREASRIAKREVALLCDLQGPKIRVGHLDEPLRLEKGQQWAIIPEGSHPPKLKCDGIIPCTYAGLAKDAVPGCRILFDDGYLQARAIGTEEGALLVNIEHGGLLKSHKGINMPDASISAPSLTTKDQQDLFFGVKHDVDYVALSFVRSAKCVQNVKFMLHRRKIYKPIIAKIERPEAIRNIDEIIKVVDGIMIARGDMAVEIGNHRVPSVQRQIIQKCRAKGKPVITATQMLESMIQNPSPTRAEASDVANAIWDGTDAVMLSAETSVGVDPINTVLTMGRIVEEAERNPRGPRLDAESHSISSASMMAAARVAEQVSARWIIALTVTGSSALSLARFRPEVPVLGAARTQGGVRRMNLYWGITPRLFNYSIEEREDIEPEVIQWMREQSMLQVGEKIVVVKGGGLLSNHSTSSSIRVDLVRDTRNIDEGVSQITQESVAGKGIITLDAARCVACGNCVNICPYGIWVAAASNTRSVSFNRDQVDNCSLDQECVRVCSSHAITITDAKDMHEWVEKEEL

SEQ ID NO: 4736 - protein, 220 aa, Oryza sativa (japonica cultivar-group)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQVHIKLDYRTKTART

SEQ ID NO: 4737 - protein, 425 aa, Streptomyces lavendulae
MDTEQVTAVVIGDVALIVVASWLLGALARRLGQPTVIGQIVAGIALGPTLLGRLPGDPTKTLFPPEVLPFLTVLSQVAVVIFMFLAGYEINYRQLRSGGRSVLAVAALALLVPAGLSTGAVTLLEGMFTAVEPDAGGRTFVMFMAVACSVTALPVLVAIVRERGMAGTSTGTVATTAAGVMDVAAWLVLAAAFAGTAHSSGPSWLQALVLIVLFSAVMFLVVRPLLDRLLRRSESRLLSPVPLALGLALGSAWVTSMLGLHPVFGGFLAGLVMPRRNEVPDAEVLQPMEQTAAVLLPLFFVTTGLKFDIGTLDTDGLVLLALILGIAVLGKLGPAYAACRFTGLGPHQSARVAALVNTRGLTELIVLNVALEAGVIGPGLFTVLVLMALITTFMTGPLLTLIGRKERPEKEIGRVDEPVGRIQAQ

SEQ ID NO: 4738 - protein, 178 aa, Glycine max
  misc_feature (83)..(83): Xaa can be any naturally occurring amino acid
  misc_feature (86)..(86): Xaa can be any naturally occurring amino acid
  misc_feature (98)..(98): Xaa can be any naturally occurring amino acid
  misc_feature (113)..(113): Xaa can be any naturally occurring amino acid
  misc_feature (137)..(137): Xaa can be any naturally occurring amino acid
  unsure (1)..(178): unsure at all Xaa locations
MASSMISAPAGTTVNRAGAGMVATFTGLKFMAGFRTRKTNSVITCIASNGGRVQCMQAWPPVGTKKTETLSYLPDLDDAQLAXKYXYLLRKGWIPCLXFELEHGLVFRDHNRXPRYYDGLYWTMSNLSIYSFADAFXVLNELHDAKTAYPNSFIHIIGFYNIHQLHYISFISYIPAVF

SEQ ID NO: 4739 - protein, 191 aa, Momordica charantia
FDSFWFVQQWPPAVCSFQKSGSCPGSGLRTFTIHGLWPQGSGTSLTNCPQGSPFDITKISHLQSQLNTLWPNVLRANNQQFWSHEWTKHGTCSESTFNQAAYFKLAVDMRNNYDIIGALRPHAAGPNGRTKSRQAIKGFLKAKFGKFPGLRCRTDPQTKVSYLVQVVACFAQDGSTLIDCTRDTCGANFIF

SEQ ID NO: 4740 - protein, 585 aa, Pseudomonas aeruginosa UCBPP-PA14
MHAVDFIQDLAVIMLVAGVVTILFHRLRQPVVLGYIVAGFIIGPHTPPFGLIHDEDTIKTLAELGVIFLMFCLGLEFSLRKLFQVGATAFIAAFLEIVLMIWIGFEIGRFFEWSTMDSLFLGAILAISSTTIIVKALGDLKMKNERFAQLIFGVLIVEDILGIGIIALLSGIAVSGSVETGEVFSTVGKLSLFMIVALVVGILLVPRLLAYVAKFESNEMLLVTVLGLCFGFCLLVVKLEYSMVLGAFLIGAIMAESRQLVQIERLIEPVRDMFSAIFFVAIGLLIDPKILVEYAWPIALITVAVVLGKMFSCGMGAFIAGNDGRTSLRVGMGLSQIGEFSFIIAALGMTLKVTSDFLYPVAVAVSAITTLLTPYLIRAADPLSQHLANAMPQRMARIFGHYGDWLRSIQPQGDRAVLAAMIRRILLQVGVNLALVIAIFLAGGYFADTLSAWMSQWVAYDGLHKALIWGGALLVSLAFLIAAYRKLKALSMLLAELGVKPEKAGRHTARVRRVISEIIPLLSLAGMMVLLAALSSSILPPGELLIVVALVAGLVIAVLWRWLIRVHSRMQIALMETLDQEKGSH

SEQ ID NO: 4741 - protein, 377 aa, Vigna radiata
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHAVPIYEGYALPHAILRLDLAGRDLTDALMKILTERGYSFTTSAEREIVRDMKEKLAYIALDYEQELETAKTSSAVEKSYELPDGQVITIGAERFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 4742 - protein, 219 aa, Chromobacterium violaceum ATCC 12472
MLTQDQLKLAVAKKALEFVPEDAIIGVGTGSTVNLFIEELAGIKGRIKGAVSSSEASTARLKAHHIQVFDLNEVEKLSVYIDGADEINHHLHMIKGGGAALTREKIVAGVADEFICIADEKKYVTMLGAFPLPIEVIPMARSYVARELVKLGGHPELRQGVTTDNGNVILDVHGLQIMKPVELEETINHIAGVVTCGLFARRRADVLLLGKQDGVEVLR

SEQ ID NO: 4743 - protein, 137 aa, Geobacter sulfurreducens PCA
MERTFAIIKPDAVERNIIGKILEKVETAGFRIVGMKKILLSKCEAEGFYYVHKERPFFNDLCSFMSRSPVVVMVLERENAINTWREVMGATNPANAEAGTIRKDFGLSIEENSVHGSDSPESAAYEIPYFFSQLELL

SEQ ID NO: 4744 - protein, 412 aa, Treponema denticola ATCC 35405
MIELSDFSKPIRDPIWKHIWMNDELYAVTKTDSFMRLYNIKQLGPTELVYPGAGHTRAVHSIGVYNIALKMLNILLKKGADSWVSKEGSMSFLAAALLHDLGHFPFTHSLKELKLKEHEELTGELILKEPLRSVTAKTGAVPEQTAAIITGKGKEDSETVFFQKLLSGVLDPDKLDYLNRDAFYCGVPYGIQDTDFILSQLLPDKKNGIKIESKAILSVESILFSKYLMYKSVYWHKDVRIATAMMKKAIFTGLERSEFSPQDLYHQDDDGIFRLLEKSNYPEKKLAEDLRLGKIYRIIAEEAFQSDNPRHRSLEDLHKRRAAEETLAEYFSNKTGSKIGSEDIIIDIPERISFESDLFIEDEKKIFSESSTVFSKEFIKTLVPSLRKIRIAVSDKIYKKVINLKQTTLPIF

SEQ ID NO: 4745 - protein, 234 aa, Helicobacter pylori 26695
MTKIAMANFKSAMPIFKSHAYLKELEKTLKPQHFDRVFVFPDFFGLLPNSFLHFTLGVQNAYPRDCGAFTGEITSKHLEELKIHTLLIGHSERRTLLKESPSFLKEKFDFFKSKNFKIVYCIGEELTTREKGFKAVKEFLSEQLENIDLNYPNLVVAYEPIWAIGTKKSASLEDIYLTHGFLKQILNQKTPLLYGGSVNTQNAKEILGIDSVDGLLIGSASWELENFKTIISFL

SEQ ID NO: 4746 - protein, 469 aa, Vibrio parahaemolyticus RIMD 2210633
MSVENVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDYMRSTGIADTVLVGPEPEFFLFDDVKFSNDMSGSFFKIDDIEAAWNTGSDIEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARAINAFANPSTNSYKRLVPGFEAPVMLAYSARNRSASIRIPVVPSPKARRIEARFPDPAANPYLAFACLLMAGLDGIKNKIHPGEAMDKDLYDLPAEEAAEIPKVAESLEVALNALNEDREFLTAGGVFSDDFIDSYIALKSKDVERINMATHPLEFELYYSV

SEQ ID NO: 4747 - protein, 127 aa, Zea mays
  misc_feature (35)..(35): Xaa can be any naturally occurring amino acid
  misc_feature (40)..(40): Xaa can be any naturally occurring amino acid
  misc_feature (54)..(54): Xaa can be any naturally occurring amino acid
  unsure (1)..(127): unsure at all Xaa locations
MPIQIHPADPNNLQAPSDMSSYCGTNSVELVTNAXYIASXGKGVLAAHKSTGTXIGKRLSTINVDNLDDNRRALRELLFCCPGALQFISGVILFDETLYQKTKDGKPFDDVLTEGGDLPGINVNKDT

SEQ ID NO: 4748 - protein, 259 aa, Neisseria gonorrhoeae FA 1090
MKEHKARKRFGQNFLQDTRIIGDIVNAVRPQADDVVIEIGPGLAAITEPLAKKLNRLHVVEIDRDIVCRLKTLPFADKLVIHEGDVLQFDFNGISGKKKIVGNLPYNISTPLLFKLAEVADDVADMHFMLQKEVVERMVAAPKSNDYGRLGVMLQYFFDMELLIDVPPESFDPAPKIDSAVVRMIPVKHRIGKADDFDHFAKLVKLAFRQRRKTIRNNLKELADDDDLQAVGISPQDRAEHIAPEKYVALSNYLADKAV

SEQ ID NO: 4749 - protein, 398 aa, Ralstonia solanacearum
MSNNRGVVYLGPGKVEVQKIDYPKMVDPSGRAIGHGVILKVVSTNICGSDQHMVRGRTTAPAGLVLGHEITGEVVEIGRDVETLKIGDLVSVPFNVACGRCAMCKEQHTGVCLSVNPARAGGAYGYVDMGGWIGGQAEYVLVPYADFNLLKFPDRDQAMAKIRDLTCLSDILPTGYHGAVTAGVKPGSTVYIAGAGPVGMAAAASARLLGAACTIVGDMNPARLAHAKAMGFEVVDLSKDATLGEQIAEILGTPEVDCAVDCVGFEAHGHGSGHTEEAPATVLNSLMEITRPAGAIGIPGLYVTDDPGAKDVAAKHGGLSIRFGLGWAKSHSFHTGQTPVLKYNRNLMQAILHNRLPIAEIVNVSVISLDQAPEGYKQFDGGAPRKFVIDPHGLLAAA

SEQ ID NO: 4750 - protein, 502 aa, Oryza sativa
MEAAAKLKRSISRQLSSGAARVWRQLSLEPVYTPRRAGAVGGGGGGGGGGGGGGGGARPTRFGLARQSSLDPTPREGGGAAEDGSGAAAMLAVPENLDATMRLLFAACQGDVAGVEELLRDGVDVDSIDLDGRTAMHIAACEGQGEVVRLLLSWKANMNARDRWGSTPAADAKHYGHFEVYNLLRARGAKTPKQKKTPMTVSNPKEVPEYELNPLELEFRRGEEVTKGHYVARWYGSKVFVKILDKDSFSDANSINEFKHELTLLEKARHPNLVQFVGAVTQNVPMMIVSEYHQKGDLASYLETKGRLQPYKAIRFSLDIARGLNYLHECKPEPIIHGNLSTKSIVRDDEGKLKVAGFGSRSLIKVSEDNPQMDQTTSKFNSVYTAPEMYRNGTFDRSVDVFAFGLILYEMIEGTHAFHPKPPEEAAKMICLEGMRPPFKNKPKYYPDDLRELIQECWDPTPSVRPTFEEIIVRLNKISTSFTKQTRWRDTFKLPWKQASER

SEQ ID NO: 4751 - protein, 137 aa, Helicobacter pylori 26695
MKQRTLSIIKPDALKKKVVGKIIDRFESNGLEVVAMKRLHLSVKDAENFYAIHRERPFFKDLIEFMVSGPVVVMVLEGKDAVAKNRDLMGATDPKLAQKGTIRADFAESIDANAVHGSDSLENAHNEIAFFFAARDL

SEQ ID NO: 4752 - protein, 150 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPN

SEQ ID NO: 4753 - protein, 490 aa, Helicobacter hepaticus ATCC 51449
MKTILVITDGIGYSDKTQYNAFYHAKKPTYDYLFKNVPYGMIDTFGLSVGLPQGQMGNSEVGHMCIGSGRVLYQDLVRISRAIEYDEIKDNPALVEVTQQSAVVHLCGLLSDGGVHSHIVHLKALAQILSTQGKRVYLHLITDGRDVLPKSALNYLADIESICEDNVSIASVSGRFYAMDRDKRWDRVQKAYESIALGKNPTNLSPKEYIQSQYDEGIFDEFLTPVSFGGFQGMNDDESFVFVNFRSDRAREIVDCLGNPQFKEFKRERYVKLHIATMTEYDATFPYPILFPKQNVQNTLAEVISSHRLKQFHTAETEKYAHVTFFLNGGREEAFIGEERVLIPSPNVKTYDLQPQMNASAVGDAVIKAVEQGYDFVVVNFANGDMVGHTGNLEAAIKAVEAVDKELGRIVESAQKHHYALFITSDHGNCEEMKDEKGNMLTNHTVGQVWCFGMIEGVSKIENGGLNNIAPSVLKAMNLPIPPEMDKPLF

SEQ ID NO: 4754 - protein, 90 aa, Oryza sativa (japonica cultivar-group)
MASAAAAVAAKAWWTAAMSVGAVEGLKDQSGLCRWNYALRSLHGAAMDTLMLQVHGGAGASSPAAAMAAERPEEEGMRRVMYLSCCWGPS

SEQ ID NO: 4755 - protein, 185 aa, Glycine max
  misc_feature (58)..(58): Xaa can be any naturally occurring amino acid
  misc_feature (116)..(116): Xaa can be any naturally occurring amino acid
  misc_feature (132)..(132): Xaa can be any naturally occurring amino acid
  misc_feature (144)..(144): Xaa can be any naturally occurring amino acid
  unsure (1)..(185): unsure at all Xaa locations
PRVRLCGGKASEGVFVGAFLSMCSTAEVLKFLMEKNTTNALDGQVTIGTLILQDCAVXGLLFALVTDLGGASRGFQGERSMTKLLVTIIAFLSGLSILPRTCLTWVLNLMISLSSXTIELYQSASGALCLLXSWCSDKTGLSLXLRSFAAGVMIANTDLAHHTLEQIEPIGRLFADLFLGRVGML

SEQ ID NO: 4756 - protein, 409 aa, Pseudomonas aeruginosa UCBPP-PA14
MSKTSLDKSKIKFLLLEGVHQNAVDTLKAAGYTNIEYLKTALSGDELKERIADAHFIGIRSRTQLTEEVFDCAKKLIAVGCFCIGTNQVDLNAARERGIAVFNAPYSNTRSVAELVLAEAILLLRGIPEKNASCHRGGWIKSAANSFEIRGKKLGIVGYGSIGTQLSVLAEALGMQVFFYDTVTKLPLGNAVQIGSLHELLGMSDIVSLHVPELPSTQWMIGEKEIRAMKKGGILINAARGTVVELDHLAAAIKDEHLIGAAIDVFPVEPKSNDEEFASPLRGLDRVILTPHIGGSTAEAQANIGLEVAEKLVKYSDNGTSVSSVNFPEVALPSHPGKHRLLHIHANIPGVMSEINKVFADNGINVSGQYLQTNDKVGYVVIDVDAEYSDLALEKLQQVNGTIRSRVLF

SEQ ID NO: 4757 - protein, 367 aa, Photobacterium profundum SS9
MGLSTAKEIIDDIRHGKMVILMDDEDRENEGDLIIAAEKITPEAVNFMAMFGRGLICLTLTHARCKQLSLPLMVQDNTEQFSTNFTVSIEAAVGVTTGISAADRATTVQAAVAPNASFSDIVMPGHIFPLMAQEGGVLSRAGHTEAGCDIARLAGLEPSSVIVEILNEDGTMARRPQLEVFAEKHGLKLGTIADLIEYRNNNETTIERIAECRLPTEFGEFDMITYRDTIDNEIHYALRSGDVKENAETLVRVHLQDTFKDVLHSGASQWTLPTAMQRIASEGGVLVVLSKQENHDTIITKVKNLAANDNGQPKVKLNPKDQSRQVGVGSQILSDLGVSKMRLLASSTQRYHSLSGFGLEVVEYICE

SEQ ID NO: 4758 - protein, 146 aa, Alexandrium tamarense
SAAGKQKGSSSKKAGKPVQGEKKKHQSLSSKAGLVFPVQRFAKALRKGGYCKRLAAGGSIYLTAVIEYITAEILELAGNSAKEARKQRIIPRHIQLAIRNDEELNKYLSRVTITGGGVLPNIHTVLLPPKVMPAKEGASGSFSQEF

SEQ ID NO: 4759 - protein, 159 aa, Brassica napus
SLSLTSIIQTCSNQRARLFKEYKEVQREKVADPDIQLVCDDTNIFKWTALIKGPSETPYEGGVFQLAFAVPETYPLQPPQVRFLTKIFHPNVHFKTGVIFICLDILKNAWSPAWTLQSVCRAIIALMAHPEADSPLNCDSGNLLRSGLVSSGYNSFSDM

SEQ ID NO: 4760 - protein, 180 aa, Triticum aestivum
  misc_feature (69)..(69): Xaa can be any naturally occurring amino acid
  misc_feature (126)..(126): Xaa can be any naturally occurring amino acid
  misc_feature (137)..(137): Xaa can be any naturally occurring amino acid
  misc_feature (146)..(146): Xaa can be any naturally occurring amino acid
  misc_feature (150)..(150): Xaa can be any naturally occurring amino acid
  unsure (1)..(180): unsure at all Xaa locations
MAPTVMASSATSVAPFQGLKSTAGLPVSRRSNGASLGSVSNGGRIRCMQVWPIEGIKKFETLSYLPPLXSTEALLKQVDYLIRSKWVPCLEFSKVGFIFREHNASPWGTNEWAGTGTMWKLPMFGXATDATQVINEXVEEVKKEYXDAYXRIIRFDNMRQVHASAHRLKQRAARSGKAKH

SEQ ID NO: 4761 - protein, 223 aa, Pseudomonas aeruginosa PAO1
MNQDQLKQAVAQAAVDHILPHLDSKSIVGVGTGSTANFFIDALARHKAEFDGAVASSEATAKRLKEHGIPVYELNTVSELEFYVDGADESNERLELIKGGGAALTREKIVAAVAKTFICIADASKLVPILGQFPLPVEVIPMARSHVARQLVKLGGDPVYREGVLTDNGNIILDVHNLRIDSPVELEEKINAIVGVVTNGLFAARPADLLLLGTADGVKTLKA

SEQ ID NO: 4762 - protein, 143 aa, Triticum aestivum
MKTESPRHLRNPLLALLFLAAAAAAGSAAPAVQIAMAAEPEQAPAAQEAAVHIVYVDRPEDADPEEFHIRTLAPVLGSEEKARGAVLYHYKHAASGFSAKLTTEQVEDLKKQPGVLQVVPSQTYQLHGHEGGHASTTRTMGLM

SEQ ID NO: 4763 - protein, 366 aa, Rubrobacter xylanophilus DSM 9941
MPFSPVEEIIEEIRAGRMVIVCDDEDRENEGDLTVAAELVTPEHINFMAKYGRGLICLPMAQELIERLEIPEMVRHNSSRMGTAFTVSIEAREGISTGISAADRAHTCRVAVSDEAGPEDIVMPGHVFPLKARKGGVLQRPGQTEAAVDLARLAGLKPAGVICEVMKDDGTMARVPDLERFSAEHGIKMVTVAQIIEYRLASDPHVRCLGEEALPTRFGEFRLRSYAGVSTGLIHRALLAGEPGENGPPLVGVRAACPTGDALHSLRCDCGERLRDAMERVAAEGEGVILYLHPGPGAPLHPLPGGEDEDLAPYRAGVEILRDLGLGRVRLLMAGGEEPLDLESGPGPALAGRLLRAKAGVAAPSL

SEQ ID NO: 4764 - protein, 234 aa, Brassica napus
  misc_feature (153)..(153): Xaa can be any naturally occurring amino acid
  misc_feature (199)..(199): Xaa can be any naturally occurring amino acid
  unsure (1)..(234): unsure at all Xaa locations
VDPRVRQFGFFGSLLNCGAKLKAFSMVNCLGIRDLATGLPASSHRSGLRSLSVRNCPGFGDANLAALGKLCPQLEDIELCGLKGVTESGFLHLLQNSLVKVNFSGCSGLTDRVVSAISARNGLTLEVLNMDGCSKISDASLVSIAANCQILSXDLDLSKCSVSDFGIQALASSEKLKLQILSMAGCAMVTDKSLPSIVXLGSTLLGLNLQQCRSVSCSTVDFLVERLYKCDILS

SEQ ID NO: 4765 - protein, 527 aa, Magnetococcus sp. MC-1
MAKVLIADKMSPMAEEVFRARGLEVDVKVGMSPDELLACIDQYDGIAIRSATRLPAQAIAAASRLKVIGRAGIGVDNVDTPAASQKGIIVMNTPFGNAITTAELGVTLAMAAARHIPAATASTKAGKWEKSRFMGRELAGKTAGVIGLGNVGRLVAQRLAGLDMKVVAYDPFINKDRAISLGLEMVDKLEDLWPRVDLLTVHTPLNDHTRNLVDAKVVAQMKEGVILVNCARGGIYNEDALYDGLVSGKIYAAGLDVYVQEPAYSHKLFELDNVVATPHLGGSTKEAQTRVAIQIAEQISDYLVSGVVKNALNIPSVTEAELPTLRPYLALVEKLGTTLGQIVETGVLKLEVIYQGEVARIKRAPITTALLKSFLSPMMDGVVNMVNANLVAEQRGIQVVESSTSGTGSFTSLVRVVVTTERRSRCVTGTLFNGTEPRLISMDEIPIEAQPEGLLLFVANDDTPGLIGRVGTLLGEAGVNISSFHLGREQAGGRAIAFINVDSEVPAPLMQQLHETANVREVKLIRY

SEQ ID NO: 4766 - protein, 256 aa, Crocosphaera watsonii WH 8501
MAEAILTRLLESQLYQANTLLVSEPQTSRREFLAQTYGVNVTDSNQETLQATEALLLAIKPQILDKVISQLTLDGVENYPLVLSILAGTPLSRLETAFENFPVIRVMPNTPATVGVGMTAIAAGTRVKPSHLTLATSLFEAVGEVVEVPESLMDGVTGLSGSGPAFVALMIEALSDGGVASGLPRAIANKLAIQTVLGTATLVKDTGLHPGQLKDQVTSPGGTTIAGVAKLEEKGFRSAVIEAVKAAYRRSQDLGK

SEQ ID NO: 4767 - protein, 756 aa, Candida glabrata CBS 138
MTASKRHTYYGGGSISYERTNNSEHDKTQRPQDHQGPKHRKHVTFGPYVIGATLGEGEFGKVKLAWSKSAYQQCDNTEGNAGNKPMTFKVPKQVAIKLIKRDFITKDPSKETKIYREINALKHLSHPNIVKLEEVLQNSKYIGIVLEYAAGGEFYKFIQRKRRLKENHACRLFSQLISAVHYIHSKGLVHRDLKLENLLLDNEENLIITDFGFVNEFLRQNGMMKTSCGSPCYAAPELVVSNRPYDARKADTWSCGIILFAMLAGYLPWDDDPKNPDGHDISRLYNYILNTPLKFPEYINPVPRDLLRKILVIDPKKRINIRSIEKHPWLESHSTFLSITPDEWDRLSNTKNIYRKSKPQFYPNKRPGSTYSNYSSGSKDNKRDSLIIDSALVSLPVPPKEFQSHILARPSSLVVESRYSPLGKRNGHNRSNSAASAALQAVFDASERESLKSVDSKPRSRSNDHKDIIEGIQPQKHAFVKPSRKVRPTSMQAPGSSYIHHGNFEGLHELMKRDNSTASSHQTSISSEARIFDASPTLIPDLTKSPSSSTGNSPKLLPRKSFTVSKPLLDLKFASADIIKANESTDSLSKRIHDQIYEVEHPRQRRHSYRYSGIISDLIFGTLSEEGEINTFENKDHKSDAEESEMTISESKLDSVSICSQQSNIHRNISKQASSVSLLRTTSNHSTNNLNVGSRTYGRAELYDKRHLRQIPSNTLNQINAPGNTHRNSAIYSEDDKRKSTAKRVFEFFKRRSMRV

SEQ ID NO: 4768 - protein, 382 aa, Pseudomonas fluorescens PfO-1
MVYHKFHPHRESSMAFNSIEEIIEDYRLGKMVLLVDDEDRENEGDLLLAADRCTPEAISFMAREARGLICLTLTDDHCQRLGLEQMVPSNGSVFSTAFTVSIEAAVGVTTGISAADRACTVAAAVAPNARAEDLVQPGHIFPLRAKEGGVLTRAGHTEAGCDLARLVGFTPASVIVEVMNDDGTMARRPDLEVFAHKHGIKIGTIADLIHYRLSTEHTIERIGERELPTVHGTFRLITFEDRIEGGVHMAMVMGELRREEPTLVRVHVIDPLRDLVGAEYSGPTNWTLWAALQRVAAEGHGVVVVLANHESSQALLERIPQLTQPPRQFSRSQSRIYSEVGTGAQILQNLGVGKLRHLGPPLKYAGLTGYDLEVVESIPFTE

SEQ ID NO: 4769 - protein, 499 aa, Mycoplasma hominis
MKKIILTIIDGLGLRKERQGNAYLQAKHPCFDYLFSMCPNSVLQASGQYVGLPEGQIGNSEVGHLNIGAGRVVYTGLSLINKAIENNTFKDNEILNDVIDKTIKNNTTLHVMGLLSNGGVHSLDLHLFEILKLAHSKGLKNVSVHVFGDGRDVKPQSIKNSLETLKDLCQKFGYKISSISGRFYAMDRDSIFSRNQEAYDAILGQSKNVIENIDDYIESQYKKGIFDEFFEPAQLKDGVFVKNGDSIIFFNFRPDRARQLSHMFIGSNLYTYKPKNQVQIDNFVSLMKYEGINSKIAFKEMEVVNPLGKVLESNDIKQLRLAETQKYAHVTFFFDGGVDIEYKNENRILVDSLKVDSFADYPHMSAKEITDSLLNNIEKNDFIIMNYANPDMVGHTGNLNATIEAIEFLDSQFQRILEYVSLNHENVTWFITADHGNAEITEDENNKPATKHTTSPVMFICTDKNVNLGNGSLCDVAPTILDYLKINKPKEMTGKSLLK

SEQ ID NO: 4770 - protein, 128 aa, Oryza sativa (japonica cultivar-group)
MGLWEWPWDRRRRGPSGLGPTSTAEEVTAGVDATHLTAIVTGATNGIGRETARVLARRGAEVIIPARTMESGNAVKQSIAEEVPGSRLHVMEMDLASLDSVRRFATAFDSSHTHLNILMYATLTHSLT

SEQ ID NO: 4771 - protein, 183 aa, Arabidopsis thaliana
MGYRRSYAITFVALVAALWSVTKAQPSSSCVSTLTTLSPCLSYITGNSTTPSQPCCSRLDSVIKSSPQCICSAVNSPIPNIGLNINRTQALQLPNACNIQTPPLTQCNAATGPTAQPPAPSPTEKTPDVTLTPTSLPGARSGVGGGSKTVPSVGNGSSSRNVDPLPLHFLMFAVLVVCTSSFL

SEQ ID NO: 4772 - protein, 393 aa, Glycine max
MNISTTRKDFMIVNMGPHHPSMHGVLRLIVTLDGEDVIDCEPILGYLHRGMEKIAENRTVIQYLPYVTRWDYLATMFTEAITVNGPEQLGNIQVPKRASYIRVIMLELSRIASHLLWLGPFMADIGAQTPFFYIFRERELIYDLFEAATGMRMMHNFFRIGGVATDLPYGWVDKCYDFCDYFLTRIVEYQKLITRNPIFLERVEGVGVVDIKEVINWGLSGPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 4773 - protein, 149 aa, Brassica napus
MIQRKVGSSIKSNTSCLSSLLLFRRNSHSRIRGYESNGQVVEKKKQHDGLFLQKSKGQHLLTNTRILDAIVRSSDVRPTDTVLEIGPGTGNLTMKLLEAAQHVVAVELDKRMVEILRARVSDHALQHKLTIIQKDVLKTDFPEFDLVVA

SEQ ID NO: 4774 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVESRKARRIEVRFPDPAGNPYLCFAALLMAGLDGIKNKIHPGEAMDKNLYDLP

SEQ ID NO: 4775 - protein, 131 aa, Emiliania huxleyi
MVKGGRGGGSKKKAQSKSAKAGLTFPVARIGRALRTMRLAKRYGAGGPVYLTAVIEYMAAEVLELAGNACRDNKKKRVTPRHLVLAVRNDEELNKFLGGVTIASGGVLPNIHSVLLPKKSKVAGKGASQEF

SEQ ID NO: 4776 - protein, 235 aa, Nostoc punctiforme PCC 73102
MTGTDPVKLMKQEVGKAAAALVKSGSIVGLGTGSTTAYTIQFLGDRLKSGELKDIIGIPTSFQSEVLAKQYGVPLATLDSIDHIDIAIDGADEVDPQKNLIKGGGAAHTREKVVDYLAEQFIVVVDSGKLVDRLGSSFAVPVEVIPMAITPVTNAIKKLGGKPELRMGVKKAGPVITDQGNFVLDVRFDSIEDPVSLEKTLNNIPGVLENGIFVNCVDLVLIGEVKDGQPLVRQL

SEQ ID NO: 4777 - protein, 146 aa, Salmonella enterica
FMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRMEVRFPDPAANPYLCFAALLMAGLDGIKNKIHPGEAMDKNLYDLP

SEQ ID NO: 4778 - protein, 122 aa, Emiliania huxleyi
MVKGGRGGSKKKATSRSAKAGLQFPVGRVHRHIKLGRYASRIGAGAPVYLAAVLEYMAAEVLELAGNAARDNKKSRIIPRHITLAVRNDEELNKFLGGVTVAQGGVLPNIHSVLLPKKSKKE

SEQ ID NO: 4779 - protein, 592 aa, Ashbya gossypii ATCC 10895
MFIRRTVLKSIPPLQFHLLRRYTMATDPKLATFPAGSPANVGIDGAAAEMKRPGSPTDLKTQPKKKARKPKKYKAKPVDPTSPAGVLQFEIDELLREQGLSRVQVETDVTPILNDVRGGPMQQKYNRRLIDVHVLKLTSSGDGLAIVDSPEDSNKKQLVLVPFGLPGDVVTIQVHKTHPHYAEASLLEVQTSAEMRHDDLINCKYFGKCSGCQYQFLTYDQQLQLKQRTVSNAFKFFAPQLLAEGLLPTVGETVASPLQFAYRTKLTPHFDMPRKVKQLETRPPLGFGQKGRPTWRHSDAGGSAAILDIEDCPIGTEIIRRGMRNERARFEETFKNYKKGATILLREHTKVLNPAAPVEEQLDPGSCDPVSGQVSHLRVDADPPLLKLCTTNTRQIVTEYVDGCTFEFSAGEFFQNNSSILPVVTAYVRDNVRIPNSGPEDKHYLVDAYCGSGLFSITASKGVDRVIGVEVSADSVAFAERNAKTNGVTNCTFIVGKAEKIFASIDTPCDRTSVILDPPRKGCDDVFLKQLAEYNPARIVYISCNVHSQARDVQYFLKETPNGARYKVDSIRGFDFFPQTHHVEGVCVLSRD

SEQ ID NO: 4780 - protein, 651 aa, Pyrococcus furiosus DSM 3638
MTILIKRETMVEEILKEIREKVAQKIPKEAKITEIEFEGPELVIYVKNPEVVMKDGELIKELAKILKKRISIRPDPDVLLPPEEAEKLILEIVPKEAEITNISFDPSVGEVLIEAKKPGLVIGKNGETLRLITEKVRWAPKVVRTPPLQSQTIYLIRQILQTESKDRRKFLRQVGRNIYRKPEYKSRWIRITGLGGFREVGRSALLVQTDESFVLVDFGINVAALNDPYKAFPHFDAPEFQYVLKEGLLDAIVITHAHLDHSGMLPYLFRYNLFDGPIYTTPPTRDLMVLLQKDFVEIQQSNGQEPLYKPKDIKEVIKHTITLDYGEVRDISPDVRLTLHNAGHILGSAIVHLHIGNGLHNIAVTGDFKFIPTRLLEPASYRFPRLETLVMESTYGGANDIQMPREEAEKRLIEVIHQTIRRGGKVLIPAMAVGRAQEIMMVLEEYARVGGIDVPIYLDGMIWEATAIHTAYPEYLSKTLREQIFKEDYNPFLSEIFHPVANSKERQDIIDSNEPAIIIASSGMLVGGPSVEYFKQLASDKRNSIIFVSYQAEGTLGRQVQSGVREIPMIGESGRTEVIKVNMEVHTIDGFSGHADRKELMNYVAKVRPRPERVITVHGEPQKCLDLATSIHKKFGLSTRAPNNLDTIRLR

SEQ ID NO: 4781 - protein, 443 aa, Acidobacteria bacterium Ellin345
MAINRHVVKSTFVSALGGLLFGFDTAVIAGTTHQLTEVFKLTPNALGITVSSALLGTVLGAITAGYPGQRIGRRDSLRIMAIFYMLSALGCALAWNWSSLLVFRVIGGLGIGGSSVLAPMYIAELSPPKWRGRLVGFFQVNIVIGILVAYLSNFVIGRMNFGAMEWRWMLGIAAAPAVLFFVMLFFIPRSPRWLAMKGRTAEALRVMRLTGTDNPEEELNGIVRSIHLERSTKSESLLQRKYLLPIFLAVSAGAFNQLTGINACLYYLNDIFAAAGASKYSAGMQSVLIGCTNLFFTLVAMTMIDKLGRKKLLLVGTTGVCIFLAIIGQIFHSGGHGGSLIWLLIGFMGFFAISQGAVIWVYISEVFPTRVRAQGQALGTSTLWITNALISWMFPVLAAKSSATPFFFFAAMMFIDVLIIAMIYPETSGVSLEQLEQKLGVVE

SEQ ID NO: 4782 - protein, 486 aa, Burkholderia xenovorans LB400
MRYSIKLNDQALLRQHAYINGEWQTADNGSTFTITDPSSGDLLAQVPMMGAAEARRAIHAACIAWSVWRKKTAKDRAIVMRRWFNLVLENADDLATILTAEQGKPLAEAKGEIAYAASFIEWFAEEGKRVSGDTPATPDADKRIIVTKEPIGVCAAITPWNFPAAMITRKVAPALAAGCTIVVKPAEATPLTALALAVLAERAGIPSGVLNVITGDPRAIGAELTANPGVRKLSFTGSTAIGRMLMAQSAPTIKKVTLELGGNAPFIVFDDADIDNAVEGAVVSKYRNSGQTCVCPNRFYVHDAVYDAFVEKLSKAVFELKVGSGRDPGVSIGPLISEAAVKKVEAHIADALQKGAKLEVGGARHELGHSFFQPTVLSDVTPDMMLSREETFGPLAAVSRFSSEDEVVRLANDTEYGLAAYFYSRNIARVWRLAEALEYGMVGINTGLISNEVAPFGGVKESGIGREGSRYGIEDYLVIKYLCLAS

SEQ ID NO: 4783 - protein, 111 aa, Zea mays
MASDSKPDSMDTDPLGGGLSIAVERNPPESRLQQLGVRSWPKWGCPPGKFPVKFDARQTCYLLKGKVRAHIKGSSECVEFGAGDLVVFPKGLSCTWDVAAAVDKYYKFDSS

SEQ ID NO: 4784 - protein, 250 aa, Desulfovibrio desulfuricans G20
MKKLMAANWKMYKTPQEAALTAGELVKAVGTVPDDREVLVFPPFVGLAQVAQAFSGVAGFYCGAQNVYPADEGAYTGEISPGMIVSTGAAWALTGHSERRSVLGESSAFVGQKTAFCLEKGLNVVLCIGETLEEREGGQLEKVLRGQLSEGLSGVPAGIAPERLAIAYEPVWAIGTGKVAGTAEIAATHAVVRGMLRELLPAAADSMRILYGGSVKPDNAAAIISLDNVDGVLVGGASLQAESFSRIILA

SEQ ID NO: 4785 - protein, 470 aa, Vibrio vulnificus CMCP6
MKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVTGKELALESGLGSKGDIVVMVSGALVASGTTNTASVHVL

SEQ ID NO: 4786 - protein, 272 aa, Pseudomonas putida KT2440
MSKTRIAFIGAGNMAASLIGGLRAQGLDASQIRASDPGAETRSRIQAEHGIEAFEDNAQAIDGADVIVLAVKPQVMKTVCQALQPNLQDGQLIVSIAAGITCASLQSWVGARPVVRCMPNTPALLRQGVSGLYATAEVSGEQRLQAEQLLSAVGTALWLEQEQQLDAVTAVSGSGPAYFFLLIEAMTAAGEKLGLPRETASQLTLQTALGAARMAVASDVDAAELRRRVTSPAGTTEAAIKSFQASGFEAIVEQALQAAATRSAELAEQLGK

SEQ ID NO: 4787 - protein, 357 aa, Azoarcus sp. EbN1
MTTMKAAVFKAPGRIELVDKPLPQVGPNDALVRITTTTICGTDVHILKGEYPVATGLTIGHEPVGVIEQLGSNVQGYVEGQRVIAGAICPSFTSYGCQDGVPSQDGGHVGHGYKPMGGWRFGNTIDGTQADYVLVPDAIANLAPVPDGLTDEQVLMCPDIMSTGFAGAEAANIRIGDIVAVFAQGPIGLCATAGAKLRGASLIIAVDGVDERLRISRNMGADVTLNFREVDVVSEILRITGGRGVDAAVEALGLQSTFESALRVLKPGGTLSSLGVYSSDLTIPLGAFHAGLGDNKIVTSLCPGGKERMRRLMNVVASGRDDFGALVTHTYKLDDIVAAYDLFANQRDGVLKIAIKP

SEQ ID NO: 4788 - protein, 217 aa, Azoarcus sp. EbN1
MHTADTRNAGPVASTDETDQRNTRLVASCRLPTPWAIFRMHGFEEPATGREHVALTLGAVADGKPVLTRVHSECLTGDALFSRRCDCGPQLEAALAAIAAEGRGVLLYLRQEGRGIGLLNKVRAYALQDEGADTVEANHLLGFDADTRDYAVAASMLGELGIASLRLMTNNPRKVAALEQYGITVAERVPHIIEPNPHNANYLRTKAQRLGHLLAGH

SEQ ID NO: 4789 - protein, 266 aa, Mycobacterium tuberculosis CDC1551
MTDRDRLRPPLDERSLRDQLIGAGSGWRQLDVVAQTGSTNADLLARAASGADIDGVVLIAEHQTAGRGRHGRGWAATARAQIILSVGVRVVDVPVQAWGWLSLAAGLAVLDSVAPLIAVPPAETGLKWPNDVLARGGKLAGILAEVAQPFVVLGVGLNVTQAPEEVDPDATSLLDLGVAAPDRNRIASRLLRELEARIIQWRNANPQLAADYRARSLTIGSRVRVELPGGQDVVGIARDIDDQGRLCLDVGGRTVVVSAGDVVHLR

SEQ ID NO: 4790 - protein, 262 aa, Hypocrea lixii
MGHEDAVYLAKLAEQAERYEEMVENMKIVASEDRDLTVEERNLLSVAYKNVIGARRASWRIVTSIEQKEESKGNSSQVTLIKEYRQKIENELAKICDDILEVLDQHLIPSAKSGESKVFYHKIKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETPARLMPLLRRRPLLRLPSRRRRAQG

SEQ ID NO: 4791 - protein, 422 aa, Roseovarius nubinhibens ISM
MTQTDWPARARAVLPGGGFGNFDPSITIREGRGSRVWDEEGRDYVDYLIGSGPMLLGHGHPEVLEAVIEQLPKGQTFFANNAAGIELAEVICAAVPCAEQLRYVSSGGEADMYAIRAARAFTGRDKIVKFEGGYHGMSAEAQMSLAPTNRLNFPQAQPDSAGIPQSVADEMLIAPFNDAEFIRSLLAEHGDKVAGLIVEPLQRIIPPAPGFLQLLREECDRYGIVLIFDEVVTGFRFAYGGAQDLYGVTPDLCTLGKVIGGGFPLAALAGRADIMAHFDKSAVGAERWLMQLGTLSGNPVAAVAGLKTLEILRRDGQYEQLRANGRRVMEMMTRALDAEGIAHRIVGDETLFEPVFTATDPRDYRDVQSADAAASARFNAVLRAEGIFKSGGKTYPSLALTEEDFARTEAAITRAAQALSER

SEQ ID NO: 4792 - protein, 308 aa, Clostridium tetani E88
MNVKKILVIGSFMMDLVAQTPRAPIEGETIIGKSFSQFTGGKGANQAVAAARLGAYVTMIGKLGKDSFGEAHIESLRREGINHDYVLFDDVESSGVGHITLEENGNNRIIVIPGANLKLTPKEVEDLEDNIKSSDIVILQLEIPFETVYKTIELAHKHGKTIILNPAPAAKLKEHFVELVDYIVPNESEASLLTGIKVNSIESARKAAKSLLNLGCKNVIITLGEKGVLLVNNNEEIFQESFKVKPVDTTAAGDSFIGAFAYSLANGLGNVKSLEFACAVGALTVTKIGAQPSLPKLTEVEMFMKENR

SEQ ID NO: 4793 - protein, 351 aa, Staphylococcus aureus subsp. aureus MSSA476
MKALVKTREGHGNLELLDKEVATPLDDKVKIKVHYAGICGTDIHTYEGHYKVNFPVTLGHEFSGEIVEVGADVKDFKVGDRVTSETTFYVCNECEYCKSKDYNLCNHRKGIGTQVDGAFTNYVIAREESLHHIPDEVSYQSAAMTEPLACAHHGVSKIQVNSGDVAVVMGPGPIGLLVAQVLKSKGATVVVTGLDNDKVRLDKAEALHMDYVVNLQQTDLKTYINGITDGYGADVVVECSGAVPAARQGLDILRKKGFYSQIGIFKDAEIPFDMEKVIQKEITVVGSRSQKPADWEPSLQLMADGLVNAEALVTKIYDISKWDEAYQHLKSGEGIKALLKPLDLDENEGEN

SEQ ID NO: 4794 - protein, 189 aa, Zea mays
  misc_feature (16)..(16): Xaa can be any naturally occurring amino acid
  misc_feature (57)..(57): Xaa can be any naturally occurring amino acid
  unsure (1)..(189): unsure at all Xaa locations
MRPLDEKETTQVFEKXLFKFTGPNLKHLLERPAVEGPDAEPGRYCLRLHRNRVYYAXEALVRRATAVSRPRLAGVGTPIGKFTHHGAFHLTVHALDLLAAHARRRVWLKPDTERSFLFGNSVPKSSLARITENTKAGDGVVVMSMADVPLGFGIAARSAQDCRKADTNAVVVLHQSDAGEYLRKEEELM

SEQ ID NO: 4795 - protein, 257 aa, Pseudomonas putida
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRVYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELG

SEQ ID NO: 4796 - protein, 144 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNL

SEQ ID NO: 4797 - protein, 253 aa, Corynebacterium striatum
MSAYGHGRHEHGQNFLTNHKIINSIIDLVKQTSGPIIEIGPGSGALTHPMAHLGRAITAVEVDAKLAAKITQETSSAAVEVVHDDFLNFRLPATPCVIVGNIPFHLTTAILRKLLHAPAWTDAVLLMQWEVARRRAGVGASTMMTAQWSPWFTFHLGSRVPRPAFRPQPNVDGGILVIRRVGDPKIPIEQRKAFQAMVHTVFTARGRGIGEILRRQGCFHHVQKHNHGCAREESTPRPYLPDCTPTTGSISSR

SEQ ID NO: 4798 - protein, 247 aa, Yarrowia lipolytica CLIB122
MPKLILLRHGQSDWNEKNLFTGWVDVKLSELGHTEAKRAGTLLKESGLKPQILYTSELSRAIQTANIALDEADRLWIPTKRSWRLNERHYGALQGKDKAATLAEYGPEQFQLWRRSFDVPPPPIADDDKWSQYNDERYQDIPKDILPKTESLKLVIDRLLPYYNSDIVPDLKAGKTVLIAAHGNSLRALVKHLDGISDDDIAALNIPTGIPLVYDLDDNLKPTKAAEYLDPEAAAAGAAAVANQGKK

SEQ ID NO: 4799 - protein, 331 aa, Glycine max
MASSTNALPPTGNGLIVSFGEMLIDFVPTVSGVSLAEAPGFLKAPGGAPANVAIAVARLGGKAAFVGKLGDDEFGHMLAGILKENDVRSDGINFDQGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFHGSVEAFHVSTVDTTGAGDSFVGALLSKIVDDQSVLEDEARLREVLKFANACGAITTTKKGAIPALPTEADALNLIKEA

SEQ ID NO: 4800 - protein, 204 aa, Triticum aestivum
  misc_feature (195)..(195): Xaa can be any naturally occurring amino acid
  unsure (1)..(204): unsure at all Xaa locations
PRVRYATTRAGRAATFPPASPPPGEQFAEVVVVRHGETSWNASRTIQGQMDPELNETGRRQALVVARRLSREAKPAAVYSSDLKRAAETAQTIATACGVSSLVLDPALRERHMGDLHGVVFDDAVRRSPEIFSSYSRTHEIPGGGESLDQLSKRCVSYLNTVAEKHKGERVIVVTHGASTEELCIHADPTSPGAXKLYNTSIRV

SEQ ID NO: 4801 - protein, 692 aa, Bacteroides thetaiotaomicron
MNKHLHFLSLLWLSMLMAFMTACSDDKNITDPAPEPEPPVEGQWTALTASPDTWDETKRADISYQLLLYSFADSDGDGYGDLNGVTQKLDYLNQLGVKALWLSPIHPCMSYHGYDVTDYTKVNPQLGTESDFDRLVTEAHNRGIKIYLDYVMNHTGTAHPWFTEASSSSESPYRNYYSFSEDPKTDIAAGKIAMITQEGAAGYNAAEWFQVSDETAAVKGLLKFTLDWSNAPSPILVVSTGTKADEDNPDTGTDNAKYLYYGEDICKKFYDKGNNIYELTVDFESTWGLLIRTSNASFWPSGTKYGASSSSEKLALNKDFKLTNAGNPANIMFDSQQITYFHSHFCTDWFADLNYGPVDQAGESPAYQAIADAAKGWIARGVDGLRLDAVKHIYHSETSEENPRFLKMFYEDMNAYYKQKGHTDDFYMIGEVLSEYDKVAPYYKGLPALFEFSFWNRLEWGINNRTGCYFAKDILSYQQKYANYRSDYIEATKLSNHDEDRTSSKLGKSADKCKLAAAVLLTSAGHPYIYYGEELGLYGTKDNGDEYVRSPMLWGDSYTTNYTDKTDATVSKNVKTVAHQQADTHSLLNIYFSLTRLRNTYPALAEANMTKHSVYNESQEKDYKPIAAWYMTKDNEKLLVIHNFGGTAMQLPLTDKIEKVLFVNGETQQNTDSDSYTLKLGGYACVVFKLGN

SEQ ID NO: 4802 - protein, 458 aa, Oryza sativa (japonica cultivar-group)
MGCMCLFQDKRRSKRRPEVAAPAPAPAPPSPSAAAAVSTDACSNVSVPAAAPSTCTSSWASTRPSASSSAVSTPEPYEARQGAPRELALRELRGATGDFSPLLMVGRGGFGCVYRGVLRLPGEPPHGTPVAVKRLNPDSRQGHKEWLAEVQLLGVVEHPNLVNLLGYCAAQTERGPQRLLVYEFVPNKTLDDHLFDRSHPVLPWGVRLQIALGAAEGLLYLHEGLEFQIIYRDFKAANVLLDDEFRPKLSDFGLAREGPSEGQTHVSTAVMGTYGYAAPDYVRTGHLTTKSDVWSFGVVLYEILAGRRSIDKSRPKDEQKLLEWVRRHPAGSPRFGRIMDGRLQGRYSVRAAREVAELAAGCLAKHGKDRPAMAEVVERLRRATRHAELDGEVYDDAGEESSSSPAAAAVEDDVAVAAAAARRRMLHLAALGENASASAHARRRLMLMRAAAAATAAT

SEQ ID NO: 4803 - protein, 239 aa, Arabidopsis thaliana
  misc_feature (118)..(118): Xaa can be any naturally occurring amino acid
  unsure (1)..(239): unsure at all Xaa locations
GAGPSGEGGEEEDGFRDLVRHTMFEKGQSKRIWGELYKVIDSSDVIVQVIDARDPQGTRCHHLEKTLKEHHKHKHMILLLNKCDLVPAWATKGWVRVLSKEYPTLAFHASVNKSFGKXLRQFARLKSDKQAISVGFVGYPNVGKSSVINTLRTKNVCKVAPIPGETKVWQYITLTKRIFLIDCPGVVYQSPGSETDIVLKGVVRVTNLEDASEHIGEVLRRVKKEHLQRAYNIKDWEDD

SEQ ID NO: 4804 - protein, 477 aa, Coxiella burnetii RSA 493
MEECIVPVLLAGGVGSRLWPVSRESYPKQFCKLFDEFSLLQKTAERAKYISKDADLIVVTNYSYYFLCKDQLEAIGIYNVHYILEPCSRNTAPAIALAAQYACEYIHPDSVLLVLPSDHQLNDHAYFKSTVRAAMNFVERNKLVVFGIEPQSPKTGYGYIEKGDAVDEGFEVKRFIEKPPLPLAKEFLLQGNFFWNSGLFLFKAKDYLNKLEKLANDIYVQSTKAFQATEPNLEFFRVNKIFDSCRAGSIDYEVMEKTNSAVMLPLRTNWSDLGCWLSVGEVVEGDEAGNVCYGDVMVDKCQNCLISSEGRRVVAIGVKDQVIVSTPDALLVIDKAYSQEVKRAVEQMKLQHDIAATEHPRMYRPWGFYEKLAVGADYQVKYLMVNPGSSLSLQLHRYRSEHWIVVSGEAEVVKGESVFRLHSNQSTFIEKGMKHRLSNPGDEPLLIIEVQSGKYLGEDDIVRFDDAYGRVVESTSL

SEQ ID NO: 4805 - protein, 377 aa, Pneumocystis carinii
MSFELERIDIEKDREFSEIMHGKDAAKERGLLSSFRKDKEAQKIALDSYFGFWGDKCTSEKNDIHQQERFKFYATLTRHYYNLVTDFYEYGWSTSFHFCRFAKDESFSQAIARHEHYIALHAGIREGETVLDVGCGVGGPACQISVFTGANIVGLNNNDYQIQRAKYYSEKKGLSDKLKFIKGDFMQMPFPENSFDKIYSIEATIHAPSLEGVYSEIYRVLKPGGLYASYEWVMLNKYDENDPEHQQIVYGIEIGDSIPKISKIGEAEAALIKVGFEIIHSEELSTKNSPLPWYYYLDGDLRKVRSFRDFISIARMTTIGKWLISSFIGLMEFIGLLPKGSKKVNDILLVAADSLVKAGKKEIFTPMQLWVCRKPLV

SEQ ID NO: 4806 - protein, 510 aa, Geobacillus kaustophilus HTA426
MAPLCASAQIDIVQKKTTEAEEELHTFDALLVRSATKVTEELLEKMPNLKIIGRAGVGVDNIDVDAATKRGIVVINAPNGNTISAAEHTFAMMAALVRRIPQAHISVKSREWNRSAFVGNELFGKKLGIIGFGRIGSEVAKRARAFGMSVHVYDPFLTKERAEKLGVSIHSLDEVLTVADIITVHTPLTKETRGLLGTENLAKTKKGVYLINCARGGIIDEQALIPFLESGHVAGVALDVFEQEPPGDHPLLAFDNVIVTPHLGASTVEAQLNVATQVAEELLHFFEGRPVTSSINLPALSKDVYEKIQAFYHLGQKLGLIASQFMNIPVQELSVTYAGTVADLETTYITRSLLAGFLRPRVASTVNEVNAAMVAKERGITYGEKFSDETHGYANCISLTVHGENKTFTIKGTHVPNYGDRIVHFDGVAIDFAPEGHLLYIQHQDRPGMIGKVGNVLGAHDVNIATMQVGRQEAGGKAMMILSLDKPVDDEVLQALAQIDDIETVKRLEA

SEQ ID NO: 4807 - protein, 512 aa, Methanothermobacter thermautotrophicus str. Delta H
MTGVIAGPSVLGAVSSGSIESLAELGVILLLFTIGLEMSAERFGEFRRTALIGGTLQICLTVSVVTILTMVLGLSPGKAVFLGFLISLSSTAVVLKVLQDFHETEAPHGQASLAILIFQDVAAVPMILTVPFLGGVVGDPSSALGTLLTAGAVLPWEPCIGKVLVPRLFDVVAATGSREIFLLTVILVCASVTWLTGEVGLSPALGAFLVGSIVANTEYAHRAQGTILPFQEVFLSFFFVSLGMLLDLRFFLDHIYLIVLAVIGVLMIKVVMNSLVGFVMGYSARVVVLLGLVLAQIGEFSFILSETGLRYGLMDRLTFQAFLSVSLITMAITPFLISLSPRISERIVRADLHPRIKNGRVYRRPSVDLRDHLIIIGMGITGRRLADTCEDHGIPYIGLDVNPEAVRRARDEGLNVYYGDGTHLAVLRHFNVPEAAVMVIAIADYRSTVHAIHEARALNEGMKIIARIRGFENTEMLYTAGADVVVSEKREATRRISDEIFSCYSGVCELEE

SEQ ID NO: 4808 - protein, 136 aa, Prototheca wickerhamii
HEQLESIGLPLNTFNNRKPFTARIVSVDRIVGPKATGETYHVVLETRGEIPFAEGQSYGVIPPGSKVNSKGKEVPHGTRLYSIASTRYGDFFDGRTASLCVRRATYWDPETGAEDPAKKGICSNFLCDAKPGQEVT

SEQ ID NO: 4809 - protein, 347 aa, Staphylococcus aureus subsp. aureus MSSA476
MKALKLYGVEDLRYEDNEKPVIESANDVIVKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 4810 - protein, 393 aa, Glycine max
MNISTTRKDFMIVNMGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGMRMMHNFFRIGGVATDLPYGWVDKCYDFCDYFLTRIVEYQKLITRNPIFLERVEGVGVVDIKEVINWGLSGPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 4811 - protein, 267 aa, Mesorhizobium loti MAFF303099
MSRKRPTVADLRAMKGKRQLTMLRVLNLDEAQAAERAGVDIVSVPPELVLNPQYRDAAPSLFTMPGENFFEIGTADDFVRWAFRLYKASADAVYCSAGYATIKRMADDAIPVIGHVGLIPSRATWTGGFKAVGKTADTAIQVFEAVKQLEAAGAVGAEIEVVPVEVAKAISERTSLIMLSMGAGTGCDAQYLFADDILGQNRGHMPRHSKVYRNFAAEYDRLQAERVAAFSEYVADVNSGAYPEDRHVVHMDPAELSLFMKRVDAKS

SEQ ID NO: 4812 - protein, 204 aa, Glycine max
MALELVIKLDWVDLIMMDWLVQIEMSAVNITNVTVLDNPASFLTPFQFEISYECLTALKDDLEWKLIYVGSAEDETYDQLLESVLVGPADPPDPSKIREEDIIGVTVLLLTCSYLGQEFIRVGYYVNNDYDDEQLREEPPPKVLIDRVQRNILSDKPRVTKFPINFHPENNENEEQLPPSEHPSETGEDPLAVVDRDPPDEKDS

SEQ ID NO: 4813 - protein, 383 aa, Triticum aestivum
MAMERELMETFEAAKKAADAAAEEADGSSPEAERCLDALRRLREFRVNTDVLVSTQVGKRLRYLTKHPNSDIQAVAADLFGYWKKVVIEETGKKNGTPANGKSNNSAAKAEKPQPMKVERKSANVKVEKNSTSTTVKTEKNATVKTEKDSMSASVKIEKTVNSDSKVQHVKVEKVSKESSRTTDTKKPSSVPSGPPKLTSLVRCNDAARDKYRELLVDAFVKVSKETSEDDREEIRDLLDQVNACDPYRVAVTVESALFERIGRSTGTHKVKYRSILFNLKADNNPDFRRRVLLGEVRPGSLVDMPADEMASDARKLENQQIKEKALFDCERASAPKASTDQFKCGRCGQRKTTYYQLQTRSADEPMTTFVTCVNCNNHWKFC

SEQ ID NO: 4814 - protein, 89 aa, Arabidopsis thaliana
KVLRNKVPPPVPGIIFFFGGPLEGGGTLHFDAINPGPNPWGGSFFFGRGVENPCFKTWGGRPQNVYAAPTPFLGRAQGHLLGQLGKNPG

SEQ ID NO: 4815 - protein, 853 aa, Ipomoea trifida
MRNAAEDHRYPLWFFLISQIFIGNLAVALAVDSITPTQPLAGNRTLVSSDGLFELGFFTPNGSDQSYVGIWYKEIEPKTVVWVGNRDGASRGSAGILKIGEDGNIHLVDGGGNFIWSPTNQSAARNTVAQLLDSGNFVLRREDDENPENYLWQSFDYPTDTLLPGMKLGWDSKTGLNRYISAWKSLNDPGEGPISFKLDINGLPEIFLRNRDKIVYRSGPWNGVRFSGVPEMKPTATITFSFVMTKNERYYSFELHNKTLYSRLLVTRNGNLERYAWIPTSKIWSKFWYAPKDQCDSYKECGTFGFCDTNMSPVCQCLVGFRPKSPQAWDLRDGSDGCVRYHELECRKDGFLTMNFMKLPDTSSSFVDTTMNLDECMKMCKNNCSCTAYTNSNISNGGSGCVIWTTELLDAAVRGGRRWPSCLHPRSASDVAQGGDSGDASGRTKRIIIACGIAVGVGILLFALSALFILKRRQSKRALGKNTELRGFRDRSQDLLMNAAVIPSKREYSGETMTDEFELPLFDFSTIVVATDNFADVNKLGQGGFGCVYKGMVEGEEIAVKRLSKNSGQGVEEFKNELRLIARLQHRNLVRLLGCCVDMEEKILIYEYMENKSLDSTLFNKQRSSLLNWQTRFNIICGIARGLLYLHQDSRFRIIHRDLKASNILLDKEMNPKISDFGMARIFGGDETDANNTKRVVGTYGYMSPEYAMDGLFSVKSDVFSFGVLVLEIVTGKKNRGFYNQNNQQNLLGHAWRLWRERRGSELLDSAIGESYSLCEVMRCIQVGLLCVQEQAEDRPNMATVVLMLGSESATLPQPKHPGFCLGSRPADMDSSTSNCDESCTVNQVTVTMLDGR

SEQ ID NO: 4816 - protein, 272 aa, Nostoc punctiforme PCC 73102
MTIKFGLIGGGVMGEALLSRLIARGIYQSSEVIVSEPLPSRLDFLQQQYGVSVTTDNSEVFTQAKEVVFLAVKPQVFSAIAQELADIDIINREQSPLIISILAGVPLNQLEAAFVQLPVIRAMPNTPATVGAGITAICLGAYTNTKHHQIAQQVFSAVGEVVEVSEGLMDAVTGLSGSGPAYVALLVESLADGGVSAGLPRAIANQLALQTVLGTAKLLYETKMHPAELKDRVTSPGGTTIAGIAKLEQAGFRSALIEAVKAATERSQELGK

SEQ ID NO: 4817 - protein, 255 aa, Robiginitalea biformata HTCC2501
MQRIKLPATDSTNAYLKRLLRERELPDGTLVSAGVQTRGRGQRGSGWKSEEGKNLTFSILKRFSGFPAREHFRLNMAVSLAIVSVLDALEIPEISVKWPNDILSGPYKVCGILIENALQSGGITHSIVGIGLNVNQRAFPGLPAAASLAVRAGRNLDRDQLLDRLQEALWKELSGLESQPSPEPPLRYGSLHDRYEARLFRKGAESKFSTADRGLFAGVIQGVDAEGRLLVATGERQVRAFGFKEIRLHYGPEAR

SEQ ID NO: 4818 - protein, 384 aa, Cryptococcus neoformans var. neoformans B-3501A
MPDIKLKNQASLCASTRLFLAYTSIKPFDVAFHPKEPVVFSSLLTGQVCAWSYDDATGETSSSWSVRPSKRTARALSIEENGDEIWMGGKSGSLLCALTPPKVMCPILLMSNCSQLSTRDGSMTRERDSAHECPINRVYCVNRNLVATGDDDGVIKLWDPRQADSIRTYSQHFDYISDFTYFDDKRQLVATSGDGHLSVIDIRSNKSTPLTVSEDQEDELLSIVPIKGGQKAIVGSGLGILSVWNRQMGWADSVDRIPGHPASIDAIVALTPDIIATGSEDGMIRVIQVLPHKFLGVVATHEEFPVERIRLDRNNKWLGSVSHDECLKLTDVEDLFEDSDEDDEMEEDEPDSDEEKSKKKKKDNGMKDMSRGQAENDGSFFADL

SEQ ID NO: 4819 - protein, 340 aa, Ginkgo biloba
MSSTGKIKIGINGFGRIGRLVARVALLRDDIELVAVNDPFISTDYMTYMFKYDSVHGQWKKHEVKVKDSNTLLFGEKAVTVFGCRNPEEIPWGETGVEYVVESTGVFTDKEKAAAHIKGGAKKVVITAPSKDAPMFVVGVNEHEYKPDLAIVSNASCTTNCLAPLAKVINDRFGIVEGLMTTVHSITATQKTVDGPSNKDWRGGRGAGFNIIPSSTGAAKAVGKVLPALNGKLTGMAFRVPTPDVSVVDLTVRLEKPASYDEIKAAIKEESEGKLKGILGYTEDDVVSTDFIGDNRSSIFDAKAGIALSDNFVKLVSWYDNEWGYSSRVIDLIVHMASTV

SEQ ID NO: 4820 - protein, 273 aa, Colwellia psychrerythraea 34H
MKHIHSYYSPNNLYNKIIEGLNNLGKDLSSVTPDDLQPVDEFHIRGDIATKELIELGNFTPDMHILDVGCGVGGSTRRLSHETGCHVTGIDLSDEYIDAAERLTQLLNMQARVKFNVGSALELPYADNTFDGAWSIQMNMNVEDKLGWLKEMYRVLKPGARAVLYEVCGHEEKTIYFPVPWAQDSSMSFLIPKEAFRDLIASTGFKIEVWNDKSDLAQKAFARMREPTGESTLPELGLHMLIGNDIKTKAYNMRRNLDDERISLIEILAIKPS

SEQ ID NO: 4821 - protein, 93 aa, Desulfovibrio desulfuricans G20
MQTASARHILVNTEEACLELKKRIEAGEAFADIAREHSRCPSGRRGGDLGKFRKGQMVPEFDEVVFSGDLNVVHGPVRTQFGFHLLEITERSE

SEQ ID NO: 4822 - protein, 284 aa, Synechocystis sp. PCC 6803
MAFRPRKRFGQHWLNHEPTLQAIVAAADIQSGAPQSGSLRDRLLEIGPGMGVLTKQLLATGNPVVAVELDRDLCLKLRKKLGQRENFLLLEGDVLILDLNALLQDFPQFSPLNKVVANIPYNITSPILELLLGTIQKPRVPGFETIVLLVQKEIAERLTAQPSTKAYGALSVRMQYLARVDWIVDVPPKAFTPPPKVDSAVIRLTPYPVEQLPGDRRLLDQLLCLGFANRRKMLRNNLKGLIAPEQLTTLLEQLALPSTARAEDLSLEQWLELTNLLPTFLPPT

SEQ ID NO: 4823 - protein, 268 aa, Vibrio vulnificus CMCP6
MRNDVHMGHKARKRFGQNFLNDPYIIDGIVSAINPRPGQNLVEIGPGLGAITEPVGREVDKFTVIELDRDLAERLRTHPELADKLTIHEGDAMRFDFTQLVKPNNKLRIFGNLPYNISTPLMFHLFEFHKDIQDMHFMLQKEVVNRLAAGPGSKAYGRLTVMAQYYCKVVPVLEVPPTAFVPPPKVDSAVVRLVPYETLPHPANNLQWLERVCREGFNQRRKTVRNCYKSLMSEQVLEELGVNPGMRPENLTLQQFVAMANWLDANHK

SEQ ID NO: 4824 - protein, 434 aa, Raphanus sativus
TSFLLVYVVMILFHPALSIYINTLSSTESITISSNRTLVSPGHVFELGFFRTTSSSRWYLGIWCKKLPERTYVWVANRDSPLSDSNGTLKITGNNLVILGHSNKSVWSTNLTRINERSPVVAELLANGNFVMRYFNDHDANRLLWQSFDYPTDTLLPEMKLGYDLNTGFNRFLTSWRNLDDPSSGDYSYKLEPRELPEFYLLKAGIRGHRSGPWNGVRFSGIPEDRKLSYMVYNFTENSKEVAYTFLVTNNSIYSRLQLSYDGDLKRLMWIPTSWEWSLFWSSPVDPQCDVYKTCGPYGYCDLSTSPVCNCIQGFDPKNRQQWDLRNPTSGCIRRTRLSCSGDGFTRMKNMKFPETTIAIVNRSIGLKECKKRCISDCNCTAFANVDIRNGGTGCVIWSGRLHDMRNYFDDGQDLYVRLAATDLGQKRNANGKI

SEQ ID NO: 4825 - protein, 815 aa, Bacillus halodurans C-125
MSLSVQEFRQQFSDKLMTTFGKKVEKATPFEAFQTVGLILRELLNRKWQDTKGTYRSNSQKQVYYFSMEFLLGRLMITNLLNSGLLETCKQGLEELGFNLEEVLGQEQDPGLGNGDLGRLAACFLDSLASLELPGHGCGIRYKYGLFQQKIVDGNQVELPDYWLKNEYVWETKRLDQTVEVHFGGEIETVEESGRLTFKHHHYEKVLAVPYDIPVSGYQNHTVNTLRLWSAESTTNDFHFYSIDRKDYYHYLDYKRSVEQISEFLYPDDSSYEGRLLRLKQQYFLVSAGLQCILREFKNSYPSVDLLPEKIAIQINDTHPSLVIPELMRLLLDQEQLSWEKAWELTTRTVAYTNHTTMSEALETWPVDMVKTLLPRIYMIIHEINERFCRHLWLAHPTLRDEIKHMAIISYGQIHMAHLAIVGSYSVNGVAKLHTDILKNSVMKPFYTVFPEKFNNKTNGITHRRWLLMANPPLASLITEAIGETWVREPKQLITLLKYAGDAAFQEKIAGVKQANKTALAKYIQERTGIRVDDRSIFDVHIKRLHGYKRQLLNVFHILHLYEMIRDNPNMDMVPRTFIFGAKAAPGYHFAKKVIKLITTTAAKIAADPIVREKIRVVFLENYNVSLAEQIIPATDVSEQISTASKEASGTGNMKFMLNGAITIGTLDGANVEIREMVGPDNIFTFGLTAEDVLAYQLSRMYRSRDVYNGDQRIRRVMDQLVNGSLSNDDVEFKDIYYTLLSNNDEYFVLKDFDSYVEAQDLLEQAYRQPTEWLKKSITNIAHSGKFSSDRTISEYASEIWDIHPVTISSTTQSR

SEQ ID NO: 4826 - protein, 433 aa, Raphanus sativus
TSFLLVFVVMILFHPAISIYINTLSSTESLTISSNRTLVSPGDVFELGFFRTNSRWYLGIWYKKLSERTYVWVANRDNPLSNSIGTLKISGNNLVILGHSNKSVWWTNITRGNESSPVVAELLANGNFVMRDSNNNSASGFLWQSFDYPTDTLLPEMKLGYDLQTGLNRFLTSWRSSDDPSIGNSSYKLKTGRIPEFYLSTWIVPVYRSGPWNGIRFSGIPDDQKLSYMVYNFTENNDEVAYTFLMTNKSIYSRLVVSSGYIERQTWNPSLGMWNVFWSLPLDSQCDTYKMCGPYAYCDVSTSPICNCIQGFNPFNVEQWDQRSWSGGCIRRTRLSCSGDGFTRMKNMKLPETTIAIVDRSIGVKECEKRCLSDCNCTAFANADIRNGGTGCMMWSGELDDMRNYAADGHDLYVRLAAADLVKKRNANGKIIS

SEQ ID NO: 4827 - protein, 437 aa, Raphanus sativus
TLSFFLVFVVMILFHPALSIYINTLSSTESLTISSNRTLVSPGNVFELGFFRTTSSSRWYLGMWYKKLPYRTYVWVANRDNPLSNSIGTLKISGDNLVIFGLSNKSVWSTNVTRGNERSPLVAELLANGNFVMRDSNNNDASQFLWQSFDYPTDTLLPEMKLGFQPKTGLNRFLTSWRSSDDPSSGDFSYKLEPRSFPEFYLLKGNVRVHRSGPWSGIQFSGIPEDQKLSYMVYNFTENSEEVAYTFKMTNNSFYSRLTLTYTGSFQRLTWAPSSVDWNVFWSSPANPQCDMYRICGPYSYCDVNTSPLCNCIQGFDPGNAQQWDLRIPLSGCIRRTRLSCSGDGFTRTKKMKLPDTTMAIVDRSIGVKECKKRCLSDCNCTAFANADIRNGGLGCVIWTRELVDIRTYAVGGQDLYVRLAAADLVQKRNANGKIIS

SEQ ID NO: 4828 - protein, 215 aa, Haemophilus influenzae R2846
MNQSILSPFGNTAEERVLNAINAFKNGTGVLVLDDEDRENEGDLIFPAETITPEQMAKLIRYGSGIVCLCITDERCQQLNLPPMVEHNNSVNKTAFTVTIEAAKGVSTGVSAADRVTTIQTAIADNAVPTDLHRPGHLFPLRAANGGVLTRRGHTEASVDLARLAGFKEAGVICEITNDDGTMARTPEIVEFAKKFGYSVLTIEDLVEYRLAHNI

SEQ ID NO: 4829 - protein, 332 aa, Magnetospirillum magnetotacticum MS-1
MTVRVGINGFGRIGRMVFRAVAKEFPEIEIVGINDLLEPDYLAYMLKYDSVHGRFAGDISVEGSNLIVNGKKVRLTAVKDPAELKWDEVKADIVIESTGLFLDAVNAEKHIKAGAKKVLMSAPSKDDTPMFVYGVNHEKYAGEKIVSAASCTTNCLAPVAKVLNDNWGIKRGLMTTVHAATATQKTVDGPSQKDWRGGRGILENIIPSSTGAAKAVGKVLPELNKKLTGMAFRVPTSDVSVVDLTVELNKDASYEDICKAMKAASEGALKGVLGYTEDKVVATDFVGCNMPSIFDADAGIALDSTFVKVVTWYDNEYGYTCNMLRFLRHIAK

SEQ ID NO: 4830 - protein, 556 aa, Streptomyces parvulus
MTGNTTSAAFLRRTQNALAMQRKICAQPEETAERVFSDILSVSRDTGFGREHGLAGVRTRQEWRRAVPIRTYDELAPYVERQFSGERRVLTTDDPRAFLRTSGSTGRAKLVPTTDHWRRVYRGPALYAQWGLYFEQIGTHRLTGDEVLDLSWEPGPIRHRLRGFPVYSITERPVSDDPDDWNPPWRHARWFTRDAGAATMADLLYGKLLRLAAHDLRLIVSVNPSKIVLLAETLKENAERLIQDLHDGHGTDRAARPDFLRRLTAAFDRTGGRPLLTDLWPGLRLLVCWNSASAALYGPWLSRLATGVAALPFSTTGTEGIVTLPVDDHLSAGPLAVDQGHFEFVPWQDLDDGSPLPEDTPTLGYDELELGADYRLVMSQANGLYRYDVGDVYRVVGAVGATPRLEFLGRAGFQSSFTGEKLTESDVHTAVMRVLGSERTDHPHFSGIPVWDTPPHYLVAIEWADAHGTLNVQDTARRIDATLQEVNVEYADKRRSGRLRPLQILPLVPGAFGQIAERRFRQGTAGAQIKHHWLQKDSAFLDTLRDLDLVRARPGT

SEQ ID NO: 4831 - protein, 291 aa, Haloarcula marismortui ATCC 43049
MLIRLPDYCKISHMEYTREESLLRLRETVEQGNPIIGAGAGTGISAKFAERGGVDLLIIYNSGRYRMSGRGSLAGLLPYGDANEIVCEMGHEVIPVVEDTPVLAGVNGTDPFRQMDVFLADLKRRGFSGVQNFPTVGLIDEDSGFRQNLEETGMGYDKEVDMIREAASQDMLTCPYVFNETQAREMAEAGADVIVSHMGLTTSGDIGAETALDLEAAAERVQAHHDAAKDVNEDVLVICHGGPIAWPDDATYVLEHTDGVVGFFGASSIERLPTEEAIENQAREFKEIDIQ

SEQ ID NO: 4832 - protein, 96 aa, Zea mays
VTTRARPSHKCAGLLAVKPLVRTFVMIKPGGVQRGLIGEIMSRFEKKGFYLRASVLVNLDRSVAEKHYTDLAFKPFFQGLLGYLISGPVAAMDWEG

SEQ ID NO: 4833 - protein, 531 aa, Corynebacterium diphtheriae
MSQNGRPVVLIADKLAQSTVDALGDAVEVRWVDGPNRAELLAAVPEADALLVRSATTVDEEVLNAATNLKIVGRAGVGLDNVDIATATDKGVMVANAPTSNIHSACEHAISLLLSTARQIPAADKTLRVGEWKRSSFKGVEIFGKTVGIVGFGHIGQLFAQRLAAFEATIIAYDPYANPARAAQLGVELVDLESLMQRADFVTIHLPKTAETAGMFNAELLAKSKQGQIIINAARGGLVDEQALADAIDAGRIRGAGFDVFATEPCTDSPLFNRPEVVVTPHLGASTVEAQDRAGTDVAASVLKALAGEFVPDAVNVSGGRVGEEVALWLDLARKLGVVAGKLLDKAPVAVEVEARGELSTENIDVLGLSALRGVFSSFIEEPVTFVNAPRIAEERGVKLDVTTASESLTHRSVLEVCVIGADGSKESVIGALTGLNHVEKIVRINKRGLDLRAQGFNVYFQYTDTPGALGKVGTALGAQGFNIDAAALSQDSEGDGATLVLRVDKPIPDALVEEIAAGIGAEAFAVDFDA

SEQ ID NO: 4834 - protein, 220 aa, Triticum aestivum
  misc_feature (183)..(183): Xaa can be any naturally occurring amino acid
  unsure (1)..(220): unsure at all Xaa locations
MDAMAAVARTGPSLAAAGHRSSATFRPSASLSFASASSRNRGRVGLSTAGWNQRATRVARATPNRIVASSEVEQTYIMIKPDGVQRGLVGEIISRFEKKGFLLKGLKLFQCPKDLAQEHYKDLKERPFFPNLIDYITSGPVVCMAWEGDGVVASARKLIGATNPLQAEPGTIRGDLAVQTGRXVVHGSDSPDNGKREIGLWFKEGELAQWESVQTPWLIE

SEQ ID NO: 4835 - protein, 477 aa, Methanococcoides burtonii DSM 6242
MNLPDHKTKIVCTIGPASSSEEMLRELIFAGMNVARINFSHGSFEDHSKVIRLIKKLCDELNVIVSVMADLPGPKIRVGEIKDSPINLQKGDKVKLTTKRIVGSKDLIPVDFDKLPYCIAKKSDVYFNDGFIQMRCSGICSNEAECEVIVGGQLSSHKGVNLPGIDLLLDPVTEKDLKILDFALDEGVNCFSVSFIEQGSDIQKIRDHATKKGRSVFLVAKIERGHSVGNIDDIMEATDALMIARGDLGVEIPIEEVPIVQKELIHKANLRGMPVITATHMLESMTDNVRPTRAEATDVANAILDGTDAIMLSGETAVGKYPLEAVHTMVRIARKTEAWRDSTGNGMGNIRNAIGETEMGISDVISLQVYDAIRKLSIELVVTPTHSGATPRRISRFKPDNWIIAMSHVELTCEQLAYSYGVYPISVSDSSEDLEKKMLGALLSRGIGKSGNTIVLTQGSSGGTNLLKIIELDQLVE

SEQ ID NO: 4836 - protein, 406 aa, Haloarcula marismortui ATCC 43049
MAIVLVGTLDTKGEEFAFARDVIEAQGVDVHVIDVGVLDDAEFEPDTTATEVAEAAGTTLDVLREESDRGEAMTAMGEGAAAVVTDLFESGELAGVLGLGGSGNTSIATRAMRALPVGVPKLMVSTMASGDTEPYVGSTDIAMMYSVADIEGLNQLSRQVISNAALAIVGMGTTESDVTVEDRPTVGITMFGVTTPCVQAAREHLEGWGYETIVFHATGTGGQAMERLIREGIIDGVLDITTTEWADELVGGVLNAGPERLDAAAQTGVPQVVSTGALDMVNFGPRDSVPDEFEGRQFHVHNPQVTLMRTTPEECAELGEILATKLNAATGPAAVALPLGGVSVLDVEGKDFYDPEADAALFDAIHKHIDPAVELFEMEAPINDEAFARALAEKLDEYMRAAGVGP

SEQ ID NO: 4837 - protein, 951 aa, Oryza sativa
MATASAPLQLATASRPLPVGVGCGGGGGGGLHVGGARGGGAAPARRRLAVRSVASDRGVQGSVSPEEEISSVLNSIDSSTIASNIKHHAEFTPVFSPEHFSPLKAYHATAKSVLDTLIMNWNATYDYYDRTNVKQAYYLSMEFLQGRALTNAVGNLELTGQYAEALQQLGHSLEDVATQEPDAALGNGGLGRLASCFLDSLATLNYPAWGYGLRYKHGLFKANHTKDGQEEVAENWLEMGNPWEIVRTDVSYPVKFYGKVVEGTDGRMHWIGGENIKVVAHDIPIPGYKTKTTNNLRLWSTTVPSQDFDLEAFNAGDHASAYEAHLNAEKPHYRDIIARFERRAGDSLSWEDFPSKVAVQMNDTHPTLCIPELMRILIDVKGLSWNEAWSITERTVAYTNHTVLPEALEKWSLDIMQKLLPRHVEIIEKIDGELMNIIISKYGTEDTSLLKKKIKEMRILDNIDLPDSIAKLFVKPKEKKESPAKLKEKLLVKSLEPSVVVEEKTVSKVEINEDSEEVEVDSEEVVEAENEDSEDELDPFVKSDPKLPRVVRMANLCVVGGHSVNGVAAIHSEIVKEDVFNSFYEMWPAKFQNKTNGVTPRRWIRFCNPELSAIISKWIGSDDWVLNTDKLAELKKFADDEDLQSEWRAAKKANKVKVVSLIREKTGYIVSPDAMFDVQVKRIHEYKRQLLNILGIVYRYKKMKEMSAKDRINSFVPRVCIFGGKAFATYVQAKRIVKFITDVAATVNHDPEIGDLLKVVFIPDYNVSVAEALIPASELSQHISTAGMEASGTSNMKFAMNGCILIGTLDGANVEIREEVGEENFFLFGAEAHEIAGLRKERAQGKFVPDPRFEEVKRFVRSGVFGTYNYDDLMGSLEGNEGYGRADYFLVGKDFPSYIECQEKVDKAYRDQKLWTRMSILNTASSSKFNSDRTIHEYAKDIWDIKPVILP

SEQ ID NO: 4838 - protein, 179 aa, Pyrus communis
FTQQYQPAACNSNPTPCKDPPAKLFTVHGLWPSNWNLPDPIFCKNTTITPQQIGHIQAQLEIIWPNVFNRTNHLVFWNKQWNKHGSCGYTTINDEIQYFETVIKMYITKKQNVSKILSKAKIKPEGKNRTRTEIINAISISTNNMTPKLKCQKNNGTIELVEVTLCNDHNITKFINCPH

SEQ ID NO: 4839 - protein, 313 aa, Neisseria gonorrhoeae FA 1090
MAIQWFPGHMNKARKAIAERAKSVDMVIEMLDARMPASSENPLLAQLSKGKPKLKILNKQDLADPERTKVWLDHYNSRPDTRAIALDSSETGAHGKITQACRAMIPHRQGIDKPLRVLICGIPNVGKSTLINGMIGKKSAKTGNEPGITKAEQRLFLADDFWLYDTPGMLWPKIIVEESGYNLAAGGAVGRNALDEEEVALELLDYLRRHYLPMLQERYQADKDPSSHWDDNSWLEWIAKKRGAVLSGGRVNYQKAAENILTDFREGKIGRITLETPNQWETWLKKARQKEAELKAIREARKAERKGQKPSEA

SEQ ID NO: 4840 - protein, 527 aa, Arabidopsis thaliana
MHSSHLLLEEPIRMASILEPSKSSFFPALTKIVGTLGPKSRSVEALSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 4841 - protein, 213 aa, Candida maltosa
DQSLNILLAGRDTTAGLLSFAVFELGRNPEVWSKLRQEIGDKFGLDSDSRIEDISFELLKLCEYLKAVINETLRLYPSVPRNGRFAAADTTLPHGGGKDGMSPILVRKGQTVMYSVYALQRDEKYYGKDANEFRPERWFEPEVRKLGWAFLPFNGGPRICLGQQFALTEASYVLVRLIQSFETLELSPEAAYPPAKLTHLTMCLFDGAPVRIE

SEQ ID NO: 4842 - protein, 746 aa, Sorghum bicolor
MSMIHCKLNVQAEDLMGGATGAQGDVQWCNGGKLEEVAVLGCAHRIMAAEVSTVHQEVCKMYFWFAGAAIASRLIDCEAYLRTEFSGFIIVCKRAIVLDEMKSTVFSAVVVSIGYAMLGWDFAALLEANHHMKKEFELLNGPSIEGITLAASTFGAIVITIFSGALLDWLGRRAILVYSSLVLFSGGVLMLWSPNIYIVLLARLIVGSGSGLVFTCVPIYISETSPPNMRGLLGTMPQFMFFIGTIFSYCLIFWLTLMSSPNWRIMIGAIFAPSIVYFALLVYYLPESPRWLASDGKISEARVSLQRLRGKKHDVSGEIAVIVDGVDIISDSAVGTARAQSFSGTSASRTWPRSTFYWQLSDPLVDLLGSIHENMSEGGSRRNSFFPVFNSFSFPEHEHMNEHRDGNSDQQTREAYSAGEVNNGDGLRASLLSQAASVEVNDANTSFTSEGSSSYLRRHGTSVLAQEFMASIHDHDIEEEEEIHGFVLPHQSAPRDMESRGRHQVVRLSETADMKFKWRVLLQPGIRHALCYGMLIQALQQSTGISGLLRCAPEILEQVGVSLFSDIGLSPHSTSILISTLQALLILPCITAAMLLMDVCGRRVLVLATTPILILSLSVMSMSILFNMGPFDRAIVFHFALTVCFCSYVIGLGPIPNILCSEIFPTKARATCASFCSLSFWFGGLLSAYCLPVMMSTIGLGGACGIYALVCCAPLFLFYYRIPETKMLNLELIAELFKLSRQEYVQ

SEQ ID NO: 4843 - protein, 450 aa, Saccharomyces cerevisiae
MTSDKHLFVLIHGLWGNYTHMESMRTILSTTLKKEDVNDDMIYFLPKQNAMFKTFDGIEIIGYRTLIEVCEFIRDYKDGKITKLSVMGYSQGGLVARFMIGKMLTEFKELFEDIEPQLFITMATPHLGVEFYNPTGIAYKSALYSALRTLGSTILGKSGREMFIANSSNNILVKLSQGEYLEALSLFKWRIAFANVKNDRTVAFYTAFITDCDPFIDFDNKLKYTFEEKIPGSGYKGILPKIVDLNALNVNSHAPTKPTKTYKKWGRTILIILVATFLILPIALVMNGLGTAYSYIVTCKYRKMLSNGILHNEVRGKLGLTEQLKGYVTDAYGSIINSALDMDANYEASNSNLVNEEELPWKEFIQKYTTINDGVWKSKFKKLPFDENRKVILRNLNKLKWIRVPIYIKAVNAHGVIVARRGMDENTAATGIACIEFTAQLLAYLMHKSN

SEQ ID NO: 4844 - protein, 320 aa, Triticum aestivum
AVKTMAILAEMKANDPDFNYTVQVDGESRVKTLMWVTSRGFDHWRRWGDAITFDTTYRTNLYDMPFRSFVGVNYHFQSIIFGGAMMRDEKEDTFKWIFREFIRMVGGKHPQTILTDHARAMELAIAAELPNTVHRWCKWHVLKKAKESMGVLWSKNSNFKMEFHKLVHHMITEEEFEAGWQDMLEKYNLRKHPFLTQIYEVQHKWAKPYFRGVFCAKMTSTQRSESANHLLKGYVPPGCPMHLFLKQFEKLQFDRESEESFQEKSTLLSGVSLRLNLPIERHASKVYTRAMFEKFDEELYKCGTHVLDEIVPRKIINQAI

SEQ ID NO: 4845 - protein, 612 aa, Oryza sativa
MATSAAAAASTLPYLVAAASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQLEHPYRAQDTKKAMLLHLIPGKATAPSDDDDEEEKDNGKDYIAWHQPHHVPTSTPWHQRPLEAGGEVASRAGIHHQPLLTPSLEPSLLVPPSSTSVVTSRQGRPEGRSERRIKGGGMEIKEAEEEASHWATAACSLIGA

SEQ ID NO: 4846 - protein, 145 aa, Myxococcus xanthus DK 1622
MAIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 4847 - protein, 217 aa, Nicotiana glutinosa
YVEFAQDFDFFYFVQQWPASYCDTRRSCCYPTTGKPDEDFSIHGLWPNYENGKWPQNCDRESSLDESEISDLISTMEKNWPSLACPSSDGVRFWSHEWLKHGTCSALGERAYFQAALDFRKKSNLLENLKNAEITPRNGEHYTLESIKKAIEEGVGHSPYIECNVDTQGNHQIYQVYLCVDKTATDFIDCPIFPHGRGCGSKIEFPPFSSESDHDEF

SEQ ID NO: 4848 - protein, 427 aa, Pyrococcus furiosus DSM 3638
MKKVEYWVKIPFGPIHPGLEEPEKFIITLDGERIVNVDVKLGYNLRGVQWIGMRRNYVQIMYLAERMCGICSFSHNHTYVRAVEEMAGIEVPERAEYIRVIVGELERIHSHLLNLGVVGHDIGYDTVLHLTWLARERVMDVLEAVSGNRVNYSMVTIGGVRRDIGEKQKRLILDMIKYYREVLPQIEDVFLHDSTIEARLRDVAVVPKKLAIEMGAVGPTARGSGIKEDSRWSEQLGVYPDLGIKPVTPEDVTGEKARGDVYDRMAVRIGELWMSLDLLEHALDQMPEGKIKTFPKDNILVAKLKLLGDGEGIGRYEAPRGELVHYVRGQKGRDGPVRWKPREPTFPNLFTIAKALEGNELADLVVAIASIDPCLSCTDRVAIVKEGKKVVLTEKDLLKLSIEKTKEINPNVKGDPTPTGIGCSRGV

SEQ ID NO: 4849 - protein, 228 aa, Staphylococcus epidermidis RP62A
MPKLILCRHGQSEWNAKNLFTGWADVKLSKQGIEEAQSAGKKIYGNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 4850 - protein, 442 aa, Raphanus sativus
AFSFLLVFDVMILFHPVFSIYINTLSSTESLTISSNRTLVSPGNDFELGFFRTTSSSRWYLGIWYKKLSDRTFVWVANRDNPLSNSIGTLKLSGNNLVLLGHSSKSIWSTNLTKRNERSPVVAELLANGNFVMRDTNNNDASAFLWQSFDFPTNTLLPEMKLGYDLKTGLNRFLASWRSSDDPSSGDHSYKLKPRRFPEFYIFNDDFPVHRVGPWNGIRFSGIPEDQKSSYMVYNFTENSKEVAYTFLMTNNSIYSILKITSEGYLQRLMWTPSSKIWQVFWSSPVSFQCDPYRICGPYAYCDENTSPVCNCIQGFDPKNRQQWDLRSHASGCIRRTRLSCSGDGFTKMKNMKLPETTMAIVDRGIGVKECEKRCLSNCNCTAFANADIRNGGSGCVIWTGELEDIRNYVADGQDLYVRLAAADLGFFSFSPQLRRETLMGK

SEQ ID NO: 4851 - protein, 439 aa, Raphanus sativus
IFSFLLVFVVLILFHPAHSIYINTLSSTESLTISGNRTLVSPGDDFELGFFKTTSRSRWYLGIWYKKISRRTYVWVANRDNPLSSAVGTLKISGNNLVLLGDSNKSVWSTNLTRGNERSPVVAELLANGNFVIRYSNNNDASGFLWQSFDFPTDTLLPEMKLGYDLKKGLNRFLTSWKNSDDPSSGEISYQLDIQRGMPEFFLLKNGFRGYRSGPWNGVRFNGIPEDQKLSYMVYNFTDNSEEVAYTFLMTDKSIYSRLMISNDEYLARLTLTPASWDWNLFWTSPEEPECDVYMTCGPYAYCDVNTSPVCNCIQGFKPLNVQQWDLRDGSGGCIRRTQLSCSGDGFIRMKSMKLPDTTMATVDRSIGVKECEKRCLSDCNCTAFANADVRNGGTGCVIWTGKLDDIRNYFEDGQDLYVRVAAADLVKKRNANGKIIAL

SEQ ID NO: 4852 - protein, 212 aa, Lycopersicon peruvianum
FMFLFALSPIYGDFELLELVSTWPATFCYAYGCSRRPIPKNFTIHGLWPDNRSTILHDCDVPPEVDYVQIEDHKILNALDKRWPQLRYDYWYGIDKQYQWKNEFLKHGTCGINRYKQPAYFDLAMKIKDKFDLLGTLRKHGINPGSTYELNDIERAIKTVSIEVPSLKCIRKPPGNVELNEIGICLDPEAKYTVPCPRIGSCHEMGHKIKFR

SEQ ID NO: 4853 - protein, 430 aa, Raphanus sativus
SYTLSILLVFLVLILFYPALSIYVNTMSSSESLTISSNRTLVSSDGVFELGFFKPSGLSRWYLGIWYKKVSEKTYAWVANRDNPLSNSIGTLKISGNNLVLLGQSNNTVWSTNRTRGNARSSVIAELLPNGNFVMRYSNNKDSSGFLWQSFDFPTDTLLPEMKLGYNLKTGRNRFLTSWRSYDDPSTGIFAYKLDIRRGLPEFILINQFLNQRVEMQRSGPWNGMEFSGIPEVQGLNYMVYNYTENSEEISYSFHMTNQSIYSRLTVSDYTVDRFTWIPPSSAWNLFWSLPTDVCDPLYLCGSYSYCDLNTSPNCNCIRGFVPKNRQQWDLREGSEGCVRTTQLSCTGDGFLRLNNMKLPDTKTATVDRRIDVKKCEERCLSDCNCTSFATADVRNGGLGCVFWTGDLVEMRKQAVGGQDLYVRLNAADL

SEQ ID NO: 4854 - protein, 388 aa, Xanthomonas campestris pv. vesicatoria str. 85-10
MIRTGTMPLTTKLPKVGTTIFTVMSQLAAEHGAVNLGQGFPDFAVPQRLVDELSKAMAAGHNQYPPMTGVAALRQAIAGKAQRCYGAQVDADTEITVTSGATEAIFNAIHAVVRAGEEVIVLDPAYDCYEPAIDLAGARAVHVALHPQTFAVDWAALRAAITPKTRLLMINSPHNPSGAMLSAEDMQTLTELLRGTDIFLLSDEVYEHIVFDGRRHESVLRWPELRERALVISSFGKTYHCTGWKIGYAIAPPALTAEFRKVHQYNTFTSFGPAQHAFAAMIRDEPEHDEQLGAFYQAKRDHFRERLLTTRLKPLPVPGGYFQLVDYSAISDLPDTEFVKWLTIEKGVAAIPLSPFYQNAPAGQRLARLCFAKNDATLDAAIERLRRL

SEQ ID NO: 4855 - protein, 1814 aa, Arabidopsis thaliana
MGSCVSSSQSKSSSASDSVVKLASFISKPDSTPPLKTDVMITSSTINGNPPIDSGRWDSGNKEDMIFFDSRGWLDSDCDDDFMSVGGEFTPSRGTTPVHHKFCDQTPHQGEENKHGEEEEEASPTDNKKRLLELFKETQDEEDEEEEDYVAEGKARACLWIRTPVRSSAPATPYNNNKERQQKFKRVRSAALGRCVPRLAQGNSDVNSTAVSRSTDTFLSSTSLPVETAFTFPSALPVIPSGGGNFGKGRIDLGGLEVIQVSISTSTSQRVWRTYEGGPDNMGLSIFQPINLPPSFSTLGFYGQPNNRLLFGWVLAARDVSGNSLRPPVDYIQVINTTSMNINQEGAAFFWQPLCPNGYQAVGLYVTTSPIKPSLSQESISCVRSDLTEQSETDTWVWGTEEMTLSSLRPANRGTEATGVHTGTFSCQPLNIPPPPPLFCLKNTKFDLSSMPSHNQTTVLFQSYSPWIYLHPDEDFISSSVDWFFSNGALLFQKGNESNPVPVQPDGSNLPQGGSDDGLFWLDYPADKNAKEWVKRGDLGHTKVYLHIKPMFGGTFTDIVVWIFYPFNGNARLKFLFFKSLSLGDIGEHIGDWEHVTLRISNFNGELWRAYFSEHSGGTLVEACDLEFQGGNKLVSYSSLHGHAMFSKPGLVLQGDDGNGIRNDMARSNKFFDAGVAYELVAGPGIQEPPWLNYFRKWGPLVPHDIQKNLEGIAKSLPGLLRKKFRNLINKIPREVLEEDGPTGPKQLSWAETGTNPLTNISYVNSLGYPFKYPYLSSNGLPVETSFKFPSPLPSMPSDGGNFGKRSIDMGGLEVTQISISNSTSHRVWRTYEGGPDNMGVSIFEPTTIPRNFFKLGFYAQPNNRQLFGWILVAKDVSGSNLRPPVDYTEVGNTTTLLIKQEGPAYFWQPLCPNGYHAVGLYVTTSPMKPSLGQNSISCVRSDLTEQSEADTWVWRIKDMTISSLRPATRGVEATGVFTGTFSCKQLNFLPHPPPLFCLKNTKFDLSSMPSENQTRVLFKTYSPWIYLHPKEDFLPSSVNWVFANGALLHKKGNESIPVPIHPNGSNLPQGGCNDDLFWLDYLVDKKAREKVKRGDLESTKVYLHIKPMFGATFTDIVVWLFFPYNGNAHLKFLFIKSLSLGNIGEHVGDWEHVTLRISNFNGELWRVYFSEHSGGTLVDACDLEFMQGGNKPVVYSSLHGHAMFSKPGVVLQGGGKSGIRNDMARSDKCFDAGIGYEVIAGPGVVEPPWLNYFRKWGPRVHYRIDIFLNSVAKILPIFLRKGLRKLINKIPLEMRGQDGPTGPKVKIYCREAILIHLNMDPRTMAVGPLTNGWVLTRLKNSAMSGNNELNALKGPQSSLPWPFGMASASFAPSHMAPPNFQPQFQLSQDQGISAPGRRFPHKPPIGGPPAVPPSMELTPASRKKKHKLPDKSSLQERVAAVLPESALYTQLLEFESRVDAALFRKKVDIQDSLKNPPSIQKTLRIYVFNTFSNQIPGPDPPTWTLRIFGRVLDPDHTGGLVQNSNPLYPKFSSFFKTLKISLDQSLYPENHLIEWKRDRSPAPLEGFEIKRIGCQEFAATILLEMNYVPEKFKTSPALMQVLGIEVDTRPRIIAAIWHYVKVRKLQNPNDPSFFNCDAALHSVFGEEKMKFTMLSHKISQHLSPPPPIQLVHKIKLSGNNPAISACYDVLVDIPAPVQTELSNLLANPEKNKEIEACDEAICGAIRKIHEHRRRRAFFLGFSQSPVEFTNALMESQTKDLKLVAGEASRNAEKEGRSEFFNQPWVEDAAIRYLNRKPAGGFHVLTSNWLDLVL

SEQ ID NO: 4856 - protein, 290 aa, Zea mays
KDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHNIQVRRAQV

SEQ ID NO: 4857 - protein, 106 aa, Brassica napus
  misc_feature (21)..(21): Xaa can be any naturally occurring amino acid
  misc_feature (36)..(38): Xaa can be any naturally occurring amino acid
  misc_feature (40)..(40): Xaa can be any naturally occurring amino acid
  misc_feature (83)..(83): Xaa can be any naturally occurring amino acid
  misc_feature (91)..(91): Xaa can be any naturally occurring amino acid
  unsure (1)..(106): unsure at all Xaa locations
MASVRLSSATMTSSLAHATMXAPFIGLKSSAAFPVXXXAXTEITSITSNGGRINCMKVWPPVGKKKFETLSYLPGLTDVEIAXEIDYLIRXKWTPCIEFEVEHGFV

SEQ ID NO: 4858 - protein, 215 aa, Lycopersicon peruvianum
FILFFGLSPISVHGSFDHWQLVLTWPPGFCEIKHCPKKPIPKNFTIHGVWPDHTDYIMYDCNPNKEFKKIYDKHLLNKLESRWPQLTSHEYAGLNDQTFWKYEYEKHGLCCEKVYDQSQYFDIAMKLKDSIDLLNILTTNRIVPGFQYSYTGDQISSAIKRVTQKDPNPKCTYSKGGLELTEIGICFNRTTNALMRCPRNSNSCKLGTTTKVVFR

SEQ ID NO: 4859 - protein, 435 aa, Raphanus sativus
TFLLVFVVMILFRPALSIYINTLSSTESLTISSNRTLVSPGDDFELGFFRTTSSSRWYLGIWYKKLSERTYVWVANRDNPLSNSTGTLKISTMNLVLLGESNKSVWSTNLTRGNERSPVVAELLANGNFVIRDTNKNDASGFLWQSFDYPTDTLLPEMKLGYDLKTRLNRFLTSWRMSDDPSSGNSSYELETRGLPEFYLWSGIFPMHRSGPWNGIRFSGIPDDQKLSYMVYNFTENSEEVAYTFRMTNNSTYSRLTLSFLGDVERLTWNPSLGAWNVFWALPFDSQCDTYKICGPNSYCDVSTSPICNCIQGFIPSNVQQWDQRSWSGGCIRRTPLSCSGDGFTRMKNMKLPETMMAIVDRSIGEKECKKRCLGDCNCTAFANADIRNGGTGCVIWTGLLDDMRNYATDGQDLYVRLAAADLVKKRNANGKIIS

SEQ ID NO: 4860 - protein, 432 aa, Raphanus sativus
TLLVFFVLIRFRPAFSINAFSATESLTISSNITLVSPGNVFELGFFITNSSSLWYLGIWYKKLSERTYVWVANRESPLSNAIGTLKISDNNLVLLDHSNKSVWSTNLTRGNERSPVVAELLANGNFVMRDSNNNDASALLWQSFDFPTDTLLPEMKLGYDHETGLNRFLTSWRSSNDPSSGDFLYKLEARTLPEFYLSSGIFRLYRSGPWNGIRFSGILDDQNLSYMVYNFTENNEEVAYTFRMTNNSIYSRLTVSSSGNFERLTWNPTLGMWNVFWSLPSDSQCDTYRICGPYSYCDVSTLPICNCIQGFNPSDVQQWDQRSWSGGCIRRTQLSCSGNGFTRMKNMKLPEIRMALVDRSIGVKECRKRCLSDCNCTAFANADIRNGGTGCVIWTGRLDDMRNYASDGQDLYVKLAAADIVKKRNPNGKITS

SEQ ID NO: 4861 - protein, 158 aa, Arabidopsis thaliana
  misc_feature (103)..(103): Xaa can be any naturally occurring amino acid
  misc_feature (129)..(129): Xaa can be any naturally occurring amino acid
  unsure (1)..(158): unsure at all Xaa locations
LDGEHDIDRTYDVAEKVWAEVFFYLAQNNVMFEGILLKPSMVTPGAESKDRATPEQVAAYTLKLLRNRVPPAVPGIMFFVRSTVRGGGNTQLERNEPGTKPHXHVFLLLRTCRLQKHLVLKTLGRQNPXERERSFRPLFLLAPCPRPIPGSTSGNTPR

SEQ ID NO: 4862 - protein, 479 aa, Klebsiella pneumoniae
MTAPVQHPMYIDGQFEPGRGDAWIDVINPATEALLSRIPDGSAEDARRAILAAERAQPGWEALPAIERARWLRKIAAGIRERAEEIAALIVAEGGKIQQLAAVEVSFTADYLDYMAEWARRYEGEIVQSDRTGENILVFKRALGVTTGILPWNFPFFLIARKLAPALITGNTIVIKPSEFTPNNAIAFAQIVHDIGLPKGVFNLVLGRGETVGQELASNPKVAMVSMTGSVAAGEKIMAAAAKNITKVCLELGGKAPAIVMDDADLELAVKAVVDSRVINSGQVCNCVERVYVQKGIYDRFVNRLGEALKAVQFGDPASRDDIAMGPLINAAALARVEQKVAKAVAQGARVALGGKAVTGRGYFYPPTLLLDVRQEMDIVHEETFGPVLPVVAFDTLEEALAMANDSDYGLTSSIYTRDLNVAMKAIKGLKFGETYINRENFEAMQGFHAGWRKSGVGGADGRHGLNEYLQTQVVYLQA

SEQ ID NO: 4863 - protein, 399 aa, Robiginitalea biformata HTCC2501
MPTLSKKGQAMPASPIRKLVPYAEAAKKSGVEVIHLNIGQPDIKTPSQALEAVRNFRTEVLEYSRSEGSESYRAKLADYYGKQGIAVTREQILVTTGGSEALSFVMSCVADLGDEIIIPEPFYANYNGFATATGVTVVPVASGISDNFALPPISDFESYIGPRTRAILLCNPGNPTGYLYSPEEIRSLAELVRRHDLFLIADEVYREFAYDGKKHYSILQEPGLEDNAVVVDSVSKRYSMCGARIGCIITRNEQLMQAALKFAQARLSPPTFAQVASEAALDTPPSYFEAVNAEYTRRRDVLLEELGKIPGILVARPQGAFYCMVELPIRDADHFAQWLLEEFRLEGATVMLAPAAGFYATPGLGENQVRIAYVLEENQLRKAVRILAAALEKYQADGH

SEQ ID NO: 4864 - protein, 561 aa, Oryza sativa (japonica cultivar-group)
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLGLCTASIALFTELQVVFEMISIGTLLVFYLVANALIYHRYAKLGANRSLHVLLFLLILTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 4865 - protein, 172 aa, Oryza rufipogon
FGSVYRGILEDNMVVAIKKSKMMEEAETKEFAREMFILSQINHRNVVKLLGCCLEVEVPMLVYEFVSNGTLYHYIHGKEPKANIALDTRLRIAAESAEALSYMHSSASPPILHGDVKTANILLDDKLNAKVSDFGASKLAPTDEAEIATLVQGTCGYLDPEYLMTCQLTDKS

SEQ ID NO: 4866 - protein, 271 aa, Debaryomyces hansenii CBS767
MGKADIGTAKYQSKQLKASGLQRLRFYCQICEKQCRDANGFKNHINSLSHQKKITSLKDGGSSIIEEYSSQFLNDFIKLLKINHGTKKINANKFYQEYILNDRDHVHMNSTKWSSLTQFVKFLGTKGYVKVEQPEADTDTEFNLVIRLIDTEYYQKQQELLQNQKNLKTEEQMSMKLINDQIKKSQEYMNRHKQEFKEESKPDNINTNQPIKVSLKLSISKRPKVRSAFGNDSESEGEEEGEEEERGSQLKRKNNTKIGEITNRLGVKSKR

SEQ ID NO: 4867 - protein, 302 aa, Sorghum bicolor
MASAAVPAATGGLKEDIAGLYDESSGVWERICGEHLHHGFYEPAGDATAVRPDVRRAQIRTIDEALAFAAVPDDLEKRPKTIVDVGCGIGGSSRYLARKYGAQCTGITLSPVQAERGNALTAAQGLSDQVSLQVADALEQPFPDGMFDLVWSMESGEHMPDKRKFVSELARVAAPGGTIIIVTCCHRNLNPSETSLKPDEQRLLKRISDAYCLADWFLPSDYVSIAKSLSLEDIRTADWSENVVPFWPAVIKLSLSWKGLTSALTCGWKTINGAMGILLLIQGYRKGLIKFTVITCRKPGPP

SEQ ID NO: 4868 - protein, 254 aa, Cytophaga hutchinsonii ATCC 33406
MYNNSANTQFTGKSIHFLPSCHSTNTEASLLIRAQKAVNGLIVITNEQTAGRGQQGNSWLSKADSNLTFSVIFFPEKLHLKDSFYLNIVSSLSIAKTVDELVPENIVKVKWPNDILLNNKKVCGILIENMLRGEHIHAVVMGIGVNVNHSDGNLPFAGAMSSEAAKTFHLQEVFTRICENLEPYYLMLEQGLFAELDALYLQNLYGLNEKKHFSDSEGNFTGTIQAVLPGGLLQVEKESGVIKQYTFKEVSLVK

SEQ ID NO: 4869 - protein, 507 aa, Mycoplasma genitalium
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVISFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 4870 - protein, 90 aa, Triticum aestivum
MASAASRKAPSLVVAASVGAVEALKDQAGLCRWGYPLRSLYRRAAAAPRVRALSASLSEATAAAAPRPAPLSAEPPTLRKAHHLVCWGPN

SEQ ID NO: 4871 - protein, 234 aa, Glycine max
GEFNLSSFFVHFTDKSILHFQISSSFYCVWENNLHQGHNHWNQTSPRSTRDMRLVENLNCFQTSSGYSPIVNNAKEKQHGQSSSGWLYSAPTIPNDISSLHKLGAQESVLQKRPSMGENMKAAKKQCSTESKTPKHKSSPSKDPQSVAAKNRRERISERLKILQELVPNGSKVDLVTMLEKAISYVKFLQLQVKVLATDEFWPVQGGKPPEISQVKEVIDVILSSQRERSSCSK

SEQ ID NO: 4872 - protein, 458 aa, Staphylococcus epidermidis RP62A
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFVFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 4873 - protein, 226 aa, Magnaporthe grisea
MSGVWGWFGGNAAQRRKDTPKNAILGLRSQLDMLQKREKHLQNQISEQDAIARKNISTNKNAAKAALKRKKTHEHSLDQTLSQIGTLEQQINAIESANINMETLEAMKKAGKAMEDIHGKLTVEKVDETMDKLREQNALSEEIVNAITNNQLGNEAIDDADLEDELEAMEQEQLDEKILKTGTGPVSDAIQRLPAAANGELKGKATTVEEDDEEAELRKLQAEMAM

SEQ ID NO: 4874 - protein, 253 aa, Zea mays
  misc_feature (239)..(239): Xaa can be any naturally occurring amino acid
  unsure (1)..(253): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVXPEVIAEYPSAPSED

SEQ ID NO: 4875 - protein, 372 aa, Haloarcula marismortui ATCC 43049
MSQYAARVEEMDISGIREVFEAAGEDAINLGLGQPDFPTPEHAREAAMSAIQDGMGDSYTSNKGIPELREAISDRYATDNGQDIPAENIIATAGASEAIHVAIEAHVQPGDEVLCPDPGFLAYEQLVLLAGGEPKRVELRDDLTLDPAAVENAITDNTSLFIVNSPANPTGAVQSKRDMAEFARIADEHEVICLSDEVYEKIVFDGEHHSPAEFANSDRVIQASACSKTYSMTGWRLGWVAASAERIERMLRVHQYVQACASAPSQYAAEAALTGPQEPVREMVSAFEERRNVLLDGLADIGLDTPVPKGAFYAMPHVPDGWTQKMLDNDVIVVPGEAFGPSGKGQARISYATSTAELKEALEVMRTVTNSL

SEQ ID NO: 4876 - protein, 453 aa, Rhodococcus sp. RHA1
MAVDTADAFTAQNIVTTPPQTLSEVARATGTTFILALFVTLSGKPCAKLVPIEAVEQLQDDGVGFAGYAAGHMGQEPKDSDLVAVPDVSSFTPIPFVKPGLAIVHCDPHVEGKPWPYAPRVILKETLRKASDLGLSVNVGAEIEYFLVHRTGDGALTTADTADVSRQPCYDARDVTRMYDHLTEVSAAMNALGWGNYANDHEDGNGQFEQNFDYADALTTADRVITARYLLSVIAEKRGMKATFMPKPFSDRTGSGMHLHLSLWNDAGSVFPDGDDPKGLGLSRTAYAFIAGILEHACALQGVIAPTVNSYKRTGATSTSSGATWSPRYATYGGNDRTHYLRVPDRNRVELRGGDGSANPYLAAAAAIAAGLDGIERDLDPGTPGSGDSPSDMLPMTLLHAMDALESDPVVTGALDVAGPGVAEYFAKLKREEFFAWHNTVSPWELDHYLTAF

SEQ ID NO: 4877 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 4878 - protein, 174 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGNTPGYYDGRYWTMWKLPLFGCTDSAQVLKEVEECKKEYPGAFIRIIGFDNTRQVQCISFIAYKPPSFTEA

SEQ ID NO: 4879 - protein, 178 aa, Triticum aestivum
  misc_feature (100)..(100): Xaa can be any naturally occurring amino acid
  misc_feature (106)..(106): Xaa can be any naturally occurring amino acid
  misc_feature (116)..(116): Xaa can be any naturally occurring amino acid
  unsure (1)..(178): unsure at all Xaa locations
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFRXEHNSSXPGYYDGRYWXTMWKLPMFGCTDATQVLNEVEEVKKEYPDAYVRVIGFDNMRQVQCVSFIAFRPPGCEESGKA

SEQ ID NO: 4880 - protein, 220 aa, Coxiella burnetii RSA 493
MSKNELKKAAAMEAIQFVKNVNIVGVGTGSTVNYFIDALAEIKHQIEGAVASSVATENRLKEHRIPVVDLNSVSNVDVYVDGADEFNKHFYLTKGGGGALTREKIIAAAAKRFICIVDESKQVDVLGQFPLPIEVIPMARSFVAREIVKLKGDPVYRQGFTTDNGNVILDIHNLTILNPVELEAILNNIPGVIANGLFAQQPADDLLIGTPAGVQLHHRK

SEQ ID NO: 4881 - protein, 356 aa, Zea mays
  misc_feature (251)..(251): Xaa can be any naturally occurring amino acid
  unsure (1)..(356): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTXLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 4882 - protein, 2195 aa, Ustilago maydis 521
MTGRELLQVLLPGNAAILSASVASSASTSIQDLIVALLTDLTNEKHLAATFGSHFQPWSSATSHDFESSPKWLVDHHGQLWGIQAVQVSEPNYEWNEQQLKAIDDGLVPLQTGVFGFLRSIARGADHAENDVQSQPTLDLSSSTTFSDFLLSSHLHSPRLRLVCGAPGLRVRLRFGHIPEIYDGWDHRTLFLPADPTTPGASGIGSTVADAVEAICEEFGIRRVVLQGSKSARVVYALAPLPSTPASAPAPMPPPSPLPDTAFLPQILRSIDTPNPSLMFTISASWLSKLGTVAQGFSKHARRQGSNGLTPGLPTTSGPGQPTQSSSPIKQTGAKTGMLGLWGSASVSKATAALLPSTFLPAAKDASPSTGDADLDALSMELTSARLSAEDEDDEEAGGTLKGSKPPTPAQHIVSLPGYTQQDDPSSEVAESSVDTAVNIPKGRRHQPPSATARLSRMFEGWIGGSAEPSSPTRDNNGAADLPETPTNSHARRVPVTVGRSGKTFSVSGPLELESDSSSVSRSPSIASLHQLSPAPDNIDNPEEIAVRFEKLMQDLGIKGTSRTAMLALPDDRKRFLISQNEAARASTPSKSRIPSQADKPGSPTPSTGSETMARSSVIPTGWSNRFSISSIATWATSDSQGSGAGSTKDGDGGASPCASLLADASGGSTRPTTIMSECGSLGSIDSKVQTNGDHTNTVRAHHTGSSAGATASLWSSWWGGGSVIAGGSGNPGQDSGDEKNAAMGHVTQLKDGKLSRKDLYKHLLSLRVTLSSAKLSWIDSFLHCDGLGALELLMQQETDGIVGALGSNRSKQLERKDMSDAILLEAIKCLRTLMNIELGFEKVLEQPYLVNYIAFALRSPSYKLRLQVADVLAALCVLSLDDGHRMVCGALSELKIVTGERFRFAFLVEDLKPDASSSSSSDAWDASADLNDADTNESIEWEYKAAAMVLINAITNSPEDLEERVALRDEFARRGLNEVLVSLRYVDPPESLATQIQVYVEEKQEDQDELHDRALHVSDRERGGDAVSDLGEAGDLLRSAQDAHEDLYPVMISILRHTSSILDRDIDHQFKTDLLFVVDKYVEQSVHVADFDEGWRIFMRSYLANIQHLVGKQAMIKANRMSDTSTVPSSFIEELEGLRAKVEELSDDKAKLSTKLNEQTAEVITLRSLPGAAALRKDTIDDELAPPGTPSTLPKRGDKESFAGVIQRLVAKEKQVIELQAELDRLSSAARPDERTDGDDRAKKDRLERNRQWTNLMDEIARHKEQLASVEANVEAKEREIKYLKRALETVYGRFQNGIAQAQEEAEAKDKEQEAAKGAASIENPELEADMMARRTIETLSKKDAEISELRTDIAKLQEKALQSMEAAKSSEHTEALQSQLGEKDKQITKLKSEMAKLQALLLQLQIQPAGLGDGAVRAAPVHRQAPRPPGAPVVSAADGAFRTAPLPPPKSAASAAPMISAASPSSPPPPPPPPPPPPGPAAVGLVPHLLASASIGGPPPPPPPPPLAPGFPPATASNDTGGLLPPPPPPPPPPSLQAGMLGGPPPPLPPPPPPGGLAIGIPPPPPPPSLSAGPAPPPPPPLSGPTAPKPPALPLIPKKKRKALFWNKLPAHSLASTVWSDLPPATVDVIGEIDRIDELFAVGSKPIAAIPETKQTGRKANPTTLLDLTRAQNVSIVLTRIKLPFPELRTALLQCDESKLSLDNLKSIRSCLPTAEELSLVRDYDGDISALSKADQFFHEVLGIPRLAERLGCMIYMRKFELELEELKPDLRILKHAVDEINASSKFKAVLGTVLTVGNVLNAATFRGEAAGFQLSDLLKLKETKPSQPTPSTPTLLHYLVRVLNKTDKTLVGFLDDCSHVEAAARLSTTLIMQSVTSLISAHATVKEEMSTLQRISISSQSDRFVDVTAEFVKQTTPQIKALQLAGTTVQESLAKLLVYFGEDPSQTKPEDFFGLVSSFGQALMRAEEDTLQADRKAELEEQKKAKQVKRKFGLSIPQFGPEVRGPLALGARSESTGGREDEDKLEEDVTPTSSRFHTCASNESSSGTLKVDQPEVDLNRRSYRGRGQLDEAIKELRAGAAGRKLANVFAGRDSSPSPKACSRIFTRAPAPAVTLEAQEEAGVAAAATIGRTRFASSTLRGAARESIYANGTLSGAPTGTLSGRKSLRVKQSQSRRPLSRVFITGDPVVRDE

SEQ ID NO: 4883 - protein, 232 aa, Saccharomyces cerevisiae
MADYDSAKYWSKQGARRGLQKTRYYCQICQRQCKDANGFQSHNKSPSHLRKISQVTAEDARRYNIQFEKGFLQLLKQRHGEKWIDANKVYNEYVQDRDHVHMNATMHRSLTQFVRYLGRAGKVDVDMDIDDTSENVEGPLLIRIHPSSLSSPSEDGMLRSQQEEQEVIAAELLKRQLNRAKRQTEKVYQPEMKSEISGDSTLKRVQVTFHGNGRVNKKKKKVPPRKDGIKFR

SEQ ID NO: 4884 - protein, 69 aa, Glycine max
DKDSFLFDSCPHVSSIENQDQFCTRDIKGSEGQMVRLVCVTTFNDTGVAGMLNLRDHDRYALSCATHIS

SEQ ID NO: 4885 - protein, 568 aa, Candida albicans SC5314
MFEVGEKYPVESSSSSNDIESRGVQPITSLKDNKSIGMIEKDNDDLSCEQYSTCDEVKRDLKARHVSMIAIGGTIGTGLFISTGSLLHTTGPVMSLISFLFVTTLAYSVTQSLGEMTTYIPVSGSFAQFITRWVSKSCGAANGWLYWFSWAITFALELSVVGQVIQYWTDAVPLAGWISIFFVLLTTFNLFPVKYYGEVEFWIASTKVIAIVGWLIYAFCMVCGAGKTGPVGFRYWRNGYAWGDGMIVSNNGKYAISFINGLINAVFTFQGTELVAVTAGEASPRAIRSAIKKVMFRILVFYVLCMLFIGLLVPYNDPKLTQDGGFTRNSPFLIAMENSGTKVLPHIFNAVIVTTIISAGNSNVYSGSRILYGLAQAGVAPKFFLKTNKGGVPYFAVLFTAAFGALGYLACSEDGNKAFTWLLNIIATAGLIAWGFISVSHVRFMNVLRKRGLSRDILPYKAFFMPYSAYYAIIIIFIVVLIQGFTVFWDFNASDFFTAYISVILFVVLWIGFHFFFYGFGKDSFKWENILIPLDDCDIDSGVRDINDAEFDVPEPKNVWERFWLLIA

SEQ ID NO: 4886 - protein, 218 aa, Lycopersicon peruvianum
LTSVFFMFLFALSPIYGYFELLELVSTWPATYCYAYGCSRRPIPNNFTINGLWPDNKSVILNNCNFAKKEDRYTKITDPKKKSELDKRWPQLRYEKLYGIEKQDLWEKEFLKHGSCSINRYKQEAYFDLAMKIKDRFDLLGTLRNQGIIPGSTYELDDIERAVKTVSIEVPSLKCIQKPLGNVELNEIGICLDPEAKYTVPCPRIGSCHKMGHKIKFR

SEQ ID NO: 4887 - protein, 472 aa, Bradyrhizobium sp. BTAi1
MRRHRRAKIVATVGPASNSPEMLKALFLAGVDTFRLNFSHGTQADHAKVHAAIRALEKDVQRPIGILMDLQGPKIRVGTLRDKKIQVESGETIRFVLNGTEGDKTSIPLPHPEIFAAVAPGHDLLIDDGRVRVRVTGLGDDWIEAKVIVSGTISNHKGINLPGTILELSPLTPKDRSDLAFGLELGVDWVALSFVQKPSDVLEARGLINGRAGIMSKIEKPAALDRIDDIIQLSDAIMVARGDLGVEIPNEDVPGKQKELVRACRLAVKPVIVATQMLDSMVATPTPTRAEVSDVATAIYDGADAVMLSAESASGQYPREAVAMMDSIIKATEGHKMYRSIVEATQPGEEQTPPHAVATAAADLASAIHAKAIVAYTSSGTSASRVARKRPSLPILAITPNEDTSRRMCLLWGAHSVLSQDVQSYEEMVERATFFAVQEEFAQTGDLLVVVAGIPFAQAGTTNNLRVVTVPR

SEQ ID NO: 4888 - protein, 526 aa, Magnetospirillum magnetotacticum MS-1
MPKVLISDKLSPAAVQIFKDRGIETDVKTGLAPDELKAIIGQYDGLAIRSNTKVTTEILAAATNLKVVGRAGIGVDNVDVPAATARGIVVMNTPFGNSITTAEHAIAMMFALAREIPEANASTHAGKWEKNRFMGVELTGKVLGIVGCGNIGAIVADRAQGLRMRVIAYDPFLSHERAKELNVEKMELEELFPRADFITLHTPLTDATRNIIDSKAMAKMKKGVRIINCARGGLVVEEDLLAALESGQVAGAALDVFKTEPAKENPLFGNSKVVCTPHLGASTSEAQENVALQVAEQMADYLLTGAVTNALNIPSVSAEDAPKLKPYMTLANQLGSFAGQLTETGIREVKIEYMGHVASLNTKPLTAVVLEGLLKPMNEAVNMVNAPVVAKERNIKVSEVKTETEGDYHTLVRLTVTTDKRERSVAGTLFGGDKARVVEIKGISIEAELGSHMLYVTNQDKPGFIGALGTLLGANGVNIATFHLGRSEAGGDAILLTQVDQPVSNELLEKVRALPQVVQAKFLTFA

SEQ ID NO: 4889 - protein, 149 aa, Triticum aestivum
  misc_feature (73)..(73): Xaa can be any naturally occurring amino acid
  misc_feature (80)..(80): Xaa can be any naturally occurring amino acid
  misc_feature (98)..(98): Xaa can be any naturally occurring amino acid
  misc_feature (106)..(106): Xaa can be any naturally occurring amino acid
  misc_feature (115)..(115): Xaa can be any naturally occurring amino acid
  misc_feature (124)..(124): Xaa can be any naturally occurring amino acid
  misc_feature (126)..(126): Xaa can be any naturally occurring amino acid
  misc_feature (129)..(129): Xaa can be any naturally occurring amino acid
  misc_feature (138)..(138): Xaa can be any naturally occurring amino acid
  misc_feature (142)..(142): Xaa can be any naturally occurring amino acid
  unsure (1)..(149): unsure at all Xaa locations
MRPLDEKETTQVFEKLFKFTGPNLKHLLERPAVEGPDAEPGRYCLRLHRNRVYYASEALVRRATAVSRPRLAXRGDAHRXFTHHGAFHLTATRSTPRXTARRRVWXKPDTERPFXLGFRAKSSXAXITXNTKRGRVAXSMVXPLGSDEP

SEQ ID NO: 4890 - protein, 349 aa, Sinorhizobium meliloti 1021
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEFAINMSNYRHWEEAIRLYVDDCLAGSEGPRERDFNMRWIASLVAETYRILIRGGIFLYPADGRKGYSQGRLRLVYEANPIAFIIENAGGAATTSIDRILDLVPENLHQRVPLVFGSRREVARITRYHVDPNMIGERAPLFGKRGLFRA

SEQ ID NO: 4891 - protein, 175 aa, Triticum aestivum
MAPTVMASSATSVAPFQGLKSTAALPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESGKA

SEQ ID NO: 4892 - protein, 767 aa, Oryza sativa (japonica cultivar-group)
MRRGTGALLLLLLPTSASDDDDHPRRGRDAAAAAAAAAAAALDVWTSEPAPVQERRRRLLQMMGLSGDPSLARLEMGRSASYDGPIRPETVSPISRSRSDGSVPASATKPPLAARSRQTSSDSSEATPGGDDADPRCLIRNLDDGSEFVVKEESALREVGTGRQLTMEEFDLCVGRSPIVQELMRRQNVASSGSSNGASALIQRSSSDSSNGATRHRRRGSWLRSIRNVAGSMVVGSRDRRSSDEKDTSSEKGGRRSSSATDDSQESASAVRRGPERVKVRQYGKTCKELSGLFMNQDIQAHNGSIWSIKFSHDGRYLASAGEDCVIHVWEVSELERKREGNGVCNQLVAVVCNGSPEPILALASVDGSCWEKKHRARILETRKSASSDRLMFPEHVFALSEKPVKTFEGHSEDVLDLCWSKSQYLLSSSMDKTVKLWHMSRTSCLKTFSHSDYVTCIQFNPVDDRYFISGSLDEKVRIWSIPGREIVDWNDLHEMVTAACYTPDGQRALVGSHKGSCHIYDTSDNKLLQKKQIDLQNKKRKSNQKKITGFQFLPGSSSKVLITSADSRIRVVDGFELVHKFKGFRNTNSQISACLSSNGRYVISASEDSHVYFWRNDDNSAQGRSKAVVSVTNSYEHFHCQDVTVAVALPSAGSAMTSRTNSRKTEEQDSIPQQHTQPDKQQDSSDFQCLSGNGLSTSSNHSGDRTSATWPEELMTPSKQSPPSSTSLPNGAGQAPSRSAWGLVIVTAGRGGQIRAFQNFGFPVRV

SEQ ID NO: 4893 - protein, 169 aa, Brassica napus
MKEDDVFPTNQKKDSSDSVLFGRGRYKFFAFAALMLLAFWSMFTGTVTLRLSTEDLNRLSEDIGIPTNHESLDVLEMEERERVVKHMWDVYTNSRRIKLPQFWQQAFVAAYEELTSDVPGVRDAAIGEIAKMSVARSISLDPTTPSRSMSARVLGRSFNKILHKPAASS

SEQ ID NO: 4894 - protein, 328 aa, Debaryomyces hansenii CBS767
MADHQEADIDSIVDRLLEVRGSRPGKQVTLLEHEIRYLCTKAREIFIQQPILLELEAPIKICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDIPDVGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQILKPADKKPRYPQSNNISNNRPVTPPRKPRRGSK

SEQ ID NO: 4895 - protein, 150 aa, Streptococcus suis 89/1591
MRIADKNVTRAVLERHGFTFKKSFGQNFLTDTNILQKIVDTAEIDQNVNVIEIGPGIGALTEFLAENAAEVMAFEIDDRLIPILADTLGRFDNVTVVNQDILKTDLQTQIQNFKNPDLPIKVVANLPYYITTPILMHLIESKIPFSEFVV

SEQ ID NO: 4896 - protein, 553 aa, Daucus carota
MNRNSINILNYMQFTDAYLDKYGVLMTLELYSNNISGPIPSDLGNLTNLVSLDLYMNSFSGPIPDTLGKLTRLRFLRLNNNSLSGPIPMSLTNITTLQVLDLSNNRLSGPVPDNGSFSLFTPISFANNLNLCGPVTGRPCPGSPPFSPPPPFIPPSTVQPPGQNGPTGAIAGGVAAGAALLFAAPAMAFAWWRRRKPREHFFDVPAEEDPEVHLGQLKRFSLRELQVATDTFSTILGRGGFGKVYKGRLADGSLVAVKRLKEERTPGGELQFQTEVEMISMAVHRNLLRLRGFCMTPTERLLVYPYMANGSVASCLRERQPSEPPLDWPTRKRIALGSARGLSYLHDHCDPKIIHRDVKAANILLDEEFEAVVGDFGLARLMDYKDTHVTTAVRGTLGYIAPEYLSTGKSSEKTDVFGYGIMLLELITGQRAFDLARLANDDDVMLLDWVKSLLKEKKLEMLVDPDLENNYIDTEVEQLIQVALLCTQGSPMERPKMSEVVRMLEGDGLAEKWDEWQKVEVIHQDVELAPHRTSEWILDSTDNLHAFELSGPR

SEQ ID NO: 4897 - protein, 153 aa, Brassica napus
  misc_feature (32)..(32): Xaa can be any naturally occurring amino acid
  misc_feature (150)..(150): Xaa can be any naturally occurring amino acid
  unsure (1)..(153): unsure at all Xaa locations
SSKGGIGFQAIAEALGLAAVKAAVAITAIIAXGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVVIGTLGLLILGKTILVVVMGXLFG

SEQ ID NO: 4898 - protein, 473 aa, Trichodesmium erythraeum IMS101
MVKTAQDVLNWIKSQDIQVIDLKFIDLPGIWQHLTVHQSQIDESSFTDGVAFDGSSIRGWKSINESDMMMVLDPTTAWIEPFMAEPTLSITCSIKEPRTGEWYSRCPRVIAQKAVDFLKTQGIGDTVYFGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAKRLEFRCPDATCNPYLAFAAMLCAGIDGILNEIDPGPSLDVDIYDLSPEELSKIPSTPGSLEGALEALEKDHEFLTAGGVFTEDLIQTWIDYKMENEVKPMRLRPHPYEFSMYYDC

SEQ ID NO: 4899 - protein, 370 aa, Methanothermobacter thermautotrophicus str. Delta H
MILPLGPMHPGYKEPIRLKVKTRGEKVLKAEIEYGYVHRGIERVMRNKTWQKAIYLSERVCGICSYIHTQTFAEAFEAISEVEAPPRAQFLRALTNELDRIQSHLIANSTYFKALDHETMFMYMLALREPVMDAIELLTGNRVNMGWNVVGGVRMDASESHLSMIREIIVDLEREFDRYVEMFEHGPLIGLRSREVGYMSQEEAEKARAVGPIGRASGIRYDFREDHPTYRDHLDFRTIWRDDGDNFARVMNRFDEIRVSIDLIKQVIDDMPGGPVRTKVDVKAGYGEWRNEAPRGEVAYMIETNGNLIKNISIRTPSIMNIDACAKYMLRDVATVADAVATYASADPCIACAERVMVVDEESGEREILL

SEQ ID NO: 4900 - protein, 273 aa, Pseudomonas aeruginosa PAO1
MSTPRIAFIGAGNMAASLIGGLRAQGVPAAQIRASDPGAEQRAKIAGEFAIDVVESNAEAVADADVVVLSVKPQAMKAVCQALAPALKPEQLIVSIAAGIPCASLEAWLGQPRPVVRCMPNTPALLRQGASGLYANAQVSAAQCEQAGQLLSAVGIALWLDDEAQIDAVTAVSGSGPAYFFLLMQAMTDAGEKLGLSRETASRLTLQTALGAAQMALSSEVEPAELRRRVTSPNGTTEAAIKSFQANGFEALVEQALNAASQRSAELAEQLGQ

SEQ ID NO: 4901 - protein, 423 aa, Desulfovibrio vulgaris subsp. vulgaris str. Hildenborough
MSQRSSELFERAQQLIPGGVNSPVRACLGVDSEPLFIARAAGSRLHTVDGETFIDFVESWGPMLLGHTHPEVTAAVHAAVDRGTSYGAPCEDEVVLAAKVVDALPGVDMVRMVNSGTEATMSALRLARGYTGRTKLVKFVGCYHGHADPFLASAGSGVATLSIPGTPGVPESTVRDTLLAPYNDLAAVKDLFALHGKDIAAIIVEAVAGNMGLVPPKAGFLEGLRELCDQHGALLIFDEVITGFRVSFGGAQQRFGITPDLTTLGKIIGGGLPVGAYGGKREIMQRIAPCGEVYQAGTLSGNPLAMAAGIATLDVLSRSDYAGLEARVAAFVKELEAILKGKGVPVRINTLASMFTVFFTNDPVTDFASAKTADGALYTSFYKQMRAQGIYLAPSPFEAAMVSFAHTDDDLAAMLDAARKVTF

SEQ ID NO: 4902 - protein, 398 aa, Geobacillus kaustophilus HTA426
MMFDTIEAALSALKNGEVIIVCDDEDRENEGDFVVLAEKATPDVINFMITHGRGLVCVPITEELAERLELEPMVTHNTDAHGTAFTVSVDYKTTTTGISAYERAATIQALLDPNVKASDFKRPGHVFPLIAKKGGVLRRAGHTEAAVDLARLCGAKPAGVICEIIKEDGTMARVPDLRQIADQFGLKMITIKDLIAYRSQREKLVKREVDVWLPTEFGEFRAIGYTNVLDGKEHVALVKGEIIPDEPILVRVHSECLTGDVFGSYRCDCGPQLHAALRQIEAEGRGVLLYMRQEGRGIGLMNKLRAYKLQEQGYDTVEANEKLGFPADLRDYGIGAQILKDLGVTKMRLLTNNPRKIAGLKGHGLEVVERVPIQMPAKKENEKYLRTKHEKLGHMLHF

SEQ ID NO: 4903 - protein, 175 aa, Triticum aestivum
MAPTVMASSATSVAPFQGLKSTAGLPVSRRSNSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4904 - protein, 401 aa, Leptospira interrogans serovar Lai str. 56601
MIQPIENAIEEIKSGKMIILVDSEDRENEGDLVVAAEFADKEKINFMAAFGRGLICIPMEVERLKKLGLNRMVDDYSLGDKHGTAFTVSVDAKHGTSTGISAQDRAVTVQVLLDDKTVSADLMRPGHLFPLQAVPGGVLRRAGHTEAAVDLSKLAGLYPAGVICEIMNDDGTMARLPDLEKFAEKHGLNIYTIEDLIRYRRAKENLIRLEVESKLPTEYGEFTIRAYSTLIDDKIHIALIKGDIKKEETIMVRVHSECLTGDIFSSNRCDCGPQLHAALEMISKEGRGVLLYMRQEGRGIGLINKLKAYNIQDKGYDTVEANEKLGFAPDLRDYGIGAQILREIGVGKMKILTNNPRKIVGLDGYGLEVVERVPIEIQPGSDNHDYLMTKKLKLGHMLGLG

SEQ ID NO: 4905 - protein, 258 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEK

SEQ ID NO: 4906 - protein, 298 aa, Methanothermobacter thermautotrophicus str. Delta H
MRFDAVGLGALNMDQLHMVERIAGPDEETFVRGLVESCGGSAANTMIGLSRLGLRTAHIGKVADDREGGLLRSNLSSEGVTDFTVVADTGRSGRVMGFVDPDGNRALYVDPGVNDTLRVDEVADEALNTELLHLTSFAGDGINVQVEVIEALDESVTVSLDPGHIYASRGVSELSDILERTDILLTNQRELELMTGSADPEEAASLLGIGVVVVKMGARGVRAWDGESVMVDALSTECVDTTGAGDAFNAGFIYAWLEGFGLEVSCRFGNYIASRCIGGYGATESLPGTGPGCPQEVR

SEQ ID NO: 4907 - protein, 500 aa, Mycobacterium tuberculosis CDC1551
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPIPPAGICSRAGSPTRVAAADPAGRDIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 4908 - protein, 205 aa, Lycopersicon peruvianum
RPLVFSPVCGDFDYFQLVLQWPRSFCKTRYCPNPVPRNFTIHGLWPDKQRIMPINCPRKESYKSITDSKKIKLLEQHWPDLTSNQGSAEFWRYQYKKHGTCSVDLYNQEQYFDLAIELKEKFDLLKTLKNHGITPSKTNTVIDVEEAIKAVTKEVPNLNCIGDSSQTMELLEIGICFNKEGTTVIACRRRWNNHPNGNQKITLPP

SEQ ID NO: 4909 - protein, 141 aa, Arabidopsis thaliana
  misc_feature (56)..(56): Xaa can be any naturally occurring amino acid
  misc_feature (65)..(65): Xaa can be any naturally occurring amino acid
  misc_feature (95)..(95): Xaa can be any naturally occurring amino acid
  misc_feature (107)..(107): Xaa can be any naturally occurring amino acid
  misc_feature (112)..(112): Xaa can be any naturally occurring amino acid
  misc_feature (116)..(117): Xaa can be any naturally occurring amino acid
  misc_feature (129)..(129): Xaa can be any naturally occurring amino acid
  misc_feature (139)..(139): Xaa can be any naturally occurring amino acid
  unsure (1)..(141): unsure at all Xaa locations
DITSITSNGGRVNCMQVWPPIGKKKFETLSYLPDLTDSELAKEVDYLIRNKWIPCXEFELEHGFXYREHGNSPGYYDGRYWTMWKLPLFGCTDSXQVLKEVEECKKXEYPNXFIRXXGFGNNRQSPVHXVSLPSKPPRXTG

SEQ ID NO: 4910 - protein, 227 aa, Haemophilus influenzae 86-028NP
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 4911 - protein, 191 aa, Glycine max
SFEDEIKKLHAEASDVKNEANGCKNIKRKAEIKLEELDKNMNSIKRQCVDADKSLTSKKLVLEQEEMDLYTAKNSATPLSSVDELIEEISEIQKKIKDEKVLLEGLRQKECEAAGKADDLKVKFDKLCESANGEFASYEKAESELVEIEKEMDSAKKAKDHYEGIMKNKVLLDIEEAEEHYLELTKMRKES

SEQ ID NO: 4912 - protein, 425 aa, Zea mays
  misc_feature (190)..(190): Xaa can be any naturally occurring amino acid
  unsure (1)..(425): unsure at all Xaa locations
MGNSQASPASASSSRFVMASRAFPKQELDGLRELFASLAAQSRTGGRAISRPVFLEYYQVRGRLGDRLFQLVAKESGGSDGVTFEDLIISKATYGRGTRDEVDEFIYQLCDVTGDGALTRSDLESVLASVHETVFAIKKEVVEVSNNRPFEEFLNSAVFSKDVEGVSGKSMSLSDFRNWCTLLPSLRKFXGNLLMPPDSGRPGFEVPLLHHPENICTDTLLLNKEYAWHIGGGFSQHEVQEWKLLYHSSLHGQSFNTFLGKVTNGDAQTVLIVKDTEGSIYGGYASQPWERHSDFYGDMKTFLFKCYPQASIFRPTGANKNLQWCAVNFSSENIPNGIGFGGQPHHFGLFLSANFDQGHSFTCSTFTSPPLSKTNRFRPEVIECWGIQMRGAQDEKLELVKGTVLERFKEDRNMLKMVGLANASD

SEQ ID NO: 4913 - protein, 223 aa, Triticum aestivum
MPPLFLLFLPVLLLVLPPSPQAAAAAAAEDICIVGCGISGASTAFFLTNYTAPDPAPQLRVFERCDRVGGRLATVTVAGEVFEAGGSIIHPRNLHVRRFADLLGLTAKTGGDDDEDWLGIWDGARFVFKTLRPPPPGSSWLRRKLHGLANSLLLLRRYGLSLLRMDSFVQEMLQKFMLYYNGFESRPVFDNVEEMLKWSGLYGLTRRTLEDELIDAGLNTQTI

SEQ ID NO: 4914 - protein, 215 aa, Haemophilus influenzae 86-028NP
MNQSILSPFGNTAEERVLNAINAFKHGTGVLVLDDEDRENEGDLIFPAETITSEQMAKLIRYGSGIVCLCITDERCQQLDLPPMVEHNNSVNKTAFTVTIEAAKGVSTGVSAADRVTTIQTAIADNAVPTDLHRPGHVFPLRAANGGVLTRRGHTEASVDLARLAGFKEAGVICEITNDDGTMARTPEIVEFAKKFGYSVLTIEDLVEYRLAHNI

SEQ ID NO: 4915 - protein, 349 aa, Treponema denticola ATCC 35405
MKVAINGFGRIGRLVFQALVNQNLLGKDKFDVVAVVDLSTDAKYFAYQLKYDSVQGKMDAKIGTDGDDVLVVNGHKIKCISGKGLTPAQLPWKELGIDVVIESTGIYTNEKAYEHLEAGAKKVIISAPGKSKDPAKPIKTFVMGVNENEYKASEHHVVSNASCTTNCLAPVVHVLLKEGFGIETGLMTTIHAYTATQKTVDGVSLKDWRGGRAAAVNIIPSTTGAAKAVGEVLPTTKGKLTGMSFRVPTPTGSVVDLTIRTEKDTSIEEIDKAIKKASESYLKGVLAYCDEEIVSTDIIHDPHSSIYDSKATLQNNLPGEKRFFKLVSWYDNEWGYSNRVIDLLKFITK

SEQ ID NO: 4916 - protein, 427 aa, Pseudomonas syringae pv. tomato str. DC3000
MSRSETLFANAQKHIPGGVNSPVRAFKSVGGTPLFFKHAAGAYVTDEDDKRYVDYVGSWGPMILGHSHPDVLDAVRNQLEHGLSYGAPTAMETEMADLVCELVPSMEMVRMVSSGTEATMSAIRLARGFTGRDSIIKFEGCYHGHSDSLLVKAGSGALTLGVPSSPGVPAAFAKHTLTVPFNDLNAVRDLLAEVGQEVACIIVEPVAGNMNCVPPAPGYLQGLRALCDEHGVVLIFDEVMTGFRVALGGAQAYYDVKPDLSTFGKIIGGGMPVGCFGGKREIMSHIAPLGPVYQAGTLSGNPLAMAAGLTTLRLISRPGFHDELSDYTRRLLEGLQQRADAAGIAFVTTQAGGMFGLYFSDASEIVTFEDVMTSDAERFKRFFHLMLEGGVYLAPSAFEAGFTSIAHGDAELKLTLDAAEKAFAALK

SEQ ID NO: 4917 - protein, 175 aa, Glycine max
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIDFQPPGCEESAKA

SEQ ID NO: 4918 - protein, 427 aa, Clostridium perfringens str. 13
MNMDRNKEIFEESKKYMPGGVNSPVRSFGSVGINPPVIKSGKGAMIKDENGNEYIDFVLAWGPMILGHCDEDVVEAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYNHIEKIGSKLEKGVLEIAKKKGLGLVVNRQGGMITLFFTDLKEVKCYDDVKTCDGERFKRYFLHMLNKGFNIPPSQFEAMFLSVKHTEEHIDKFLEAFETFEG

SEQ ID NO: 4919 - protein, 507 aa, Robiginitalea biformata HTCC2501
MNSKAILMILDGWGISPDPKVSAIEQADTPFVDSLYEKYPHATLLTDGMHVGLPDGQMGNSEVGHMNLGAGRIVYQDLAKINLAVSNNSLKDAPALKEAFRYAVENDKPVHFLGLLSDGGVHSHIDHLKGLIRAADEAGVPASYVHAFTDGRDVDPKSGVGFVRDLMEFARPTRTRLASVVGRYFAMDRDKRWERVKKAYDLLVNGTGTATDNPVAALEASYAAGTTDEFVEPIAVAGTDGKPLAQIRDGDVVVFFNFRTDRGRELTLALSQEAFHEQNMHPLKLHYVTMTNYDDTFKDVHVVYDKENIKDTLGEVLARAGKKQIRIAETEKYPHVTFFFNGGREAPFEGESRILCPSPKVATYDLQPEMSAYDIRDAILPELAKGEADFVCLNFANPDMVGHTGDLQAAIKACETVDACARDVITAGLENGYTTLVIADHGNCDTMVNPDGSPNTAHTTNPVPLILVDPDRKSIKSGVLGDMAPTILEIIGVAQPELMTQKSLLVS

SEQ ID NO: 4920 - protein, 338 aa, Vibrio vulnificus CMCP6
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 4921 - protein, 150 aa, Sorbus aucuparia
AACNSNPIPCKDPPDKLFTIHGLWPSDSNGHDPVNCSQSTVDAQKLGNLTTQLEIIWPNVYNRKDHISFWNKQWNKHGSCGHPTIMNDIHYFQTAIKMYITQKQNVSKILSNAKIEPEGKPRKQIDIVNAILKGTGDKEPKLKCQKNNQV

SEQ ID NO: 4922 - protein, 393 aa, Prochlorococcus marinus str. MIT 9211
MSKSHLISERTQELQLSLTLEISARAKLLKKEGKDICSLSAGEPDFDTPNYIVNAAIEALRNGITRYGPAAGDPELREAIAQKLTTSNNVPSKAENILITNGGKQAIFNLFQIILNPGDEVLIPSPYWLSYPEIAKLAGAIPVPLHTSPKDGFKLSSEKLEEKITNRTKLLILNSPCNPTGRVIQKEELISIAEVLRRNKQLLVMTDEIYEYLISENESHHSLAAIAPDLRERIFIVNGFAKAWAMTGWRIGYLAGPKEFIKTAIALQSQSTSNVCSFAQRGALAALLGPKESIKTMSRSYNERREILTKGLNSINGISLIPQKGAFYAFPELAPSLPNSLSFCKLALEKVGLAIIPGIAFGEDRCVRLSCAVSEDTIKEGIARLEKLITQLI

SEQ ID NO: 4923 - protein, 150 aa, Sorbus aucuparia
AVCYFNPTPCKDPPDKLFTVHGLWPSNLNGPHPENCTNATVNSQRITNIQAQLKIIWPNVLDRTNHVGFWNKQWIKHGSCGNPPIMNDTHYFQTVINMYITKKQNVSGILSKAKIEPVGGKRPLVDIENAIRKSINNKKPKFKCQMKNKV

SEQ ID NO: 4924 - protein, 150 aa, Sorbus aucuparia
AVCNSKPTPCKDPPDKLFTVHGLWPSNLNGPHPENCTNATVNSHRLKNIQAQLKIIWPNVLDRTNHVGFWNKQWIKHGSCGYPAIMNDTHYFQTVINMYITQKQNVSEILSKAKIEPLGIQRPLVHIENAIRNSINNKKPKFKCQKNSGV

SEQ ID NO: 4925 - protein, 513 aa, Vicia sativa
MELETLISWLLFSTSLFWFLFLATKTKSKPPKTPSSTTNTPIPKSYPIFGSAFSLLANFHRRIQWTSDILQTIPSSTFVLHRPFGARQVFTAQPAVVQHILRTNFTCYGKGLTFYQSINDFLGDGIFNADGESWKFQRQISSHEFNTRSLRKFVETVVDVELSDRLVPVLSQASNSQTTLDFQDILQRLTFDNICMIAFGYDPEYLLPSLPEIPFAKAFDESSQLSIERLNALIPLLWKVKRFLNIGVERQLKEAVAEVRGLATKIVKNKKKELKEKALQSESESVDLLSRFLSSGHSDESFVTDMVISIILAGRDTTSAALTWFFWLLSKHSHVENEILKEITGKSETVGYDEVKDMVYTHAALCESMRLYPPLPVDTKVAVHDDVLPDGTLVKKGWRVTYHIYAMGRSEKIWGPDWAEFRPERWLSRDEVGKWSFVGIDYYSYPVFQAGPRVCIGKEMAFLQMKRVVAGIMGRFRVVPAMVEGIEPEYTAHFTSVMKGGFPVKIEKRSPLV

SEQ ID NO: 4926 - protein, 225 aa, Zea mays
MGSAAASPPPSGKLTQDELKRVAAHRAVEFVEPGMTLGLGTGSTAAHALDRLGDLLRAGALPGVDPDLNLVKGRGGSLLREKMIEGAGARFVVIVDESKLVPRLGCTGAVPVEVIPFGAPHTLGLIRGLFHGLPGFHARLRTVPAAPAKGGEDSDSESEQPFVTDNGNYIVEMFFEDGIRGDLRDISDRLLRITGVVEHGMFLGMATTVIVANKDGTVTVINKKK

SEQ ID NO: 4927 - protein, 226 aa, Debaryomyces hansenii CBS767
MWNYLFGGNKQQKKEYPKKAIVELREHIQMLNKKRSHLELQIADQDALARKYITTNKALAKNALKRKKGYEANLMKIENQIDSLETQLTSIEGANLNLETMKAMKQGAQAMKQIHGEYDVDKVENTMDDIREQVELADEISEAISRPVGTEFVDEDELDEELAMLQEEEKEHKQQTPAQKAPVAKVSAPEEEMPDFPTVNKNKPAASTEDDEDEEALKALQAEMGL

SEQ ID NO: 4928 - protein, 482 aa, Escherichia coli
MSDVPLIAVVMAGGTGSRLWPLSREHYPKQFLQLSGENTLLQSTLLRLSPLSCETPLVITNEQHRFVVAEQLRQINQLSDNIILEPCGRNTAPAIALSAFTALKRNEQQDPILLVLAADHVINKTDVFCNAIKNSISIVEQGNILTFGIIPDYAETGYGYIEKGSIVKESQRGVGNTFYHVEQFVEKPNRSRAEEYISSGKYLWNSGMFMFKASVYLEELKKYRPDIYDICEKTISSSYHDLDFIRLSKDVFQNCPSESIDFAVMEKTKRCIVYPVDIGWNDVGSWQSLWDVSDKTPTGDVCKGDILTYNTKNNYIHSESALVAAVGVEDIVIVQTKDAILVSKKSEVQDVKKIVQMLKMQERSEYLSHREEFRPWGKFDAIEQGDRYKVKKIVVKPGEGLSLRMHHHRSEHWIVLSGTAKVTLNNKTFLVTANESVYIPLGATYSLENPGIIPLNLIEVSSGDYLGEDDIVRQKERYKIDD

SEQ ID NO: 4929 - protein, 346 aa, Brassica napus
VDPRVRAVHVDFGLKLGGADLMSIPGLYRFVQEQIKDQVANMYLWPKTLVVPILDPAKAFRRPVGIVHVKVVRAVGLRKKDMMGGADPYVKIKLSEDKIPSKKTTVKHKNLNPEWNEEHKFSVRDPQTQVLEFSVYDWEQLGKHDKMGMNVLPLKEMVPNEHKTFTLELRKTMEGAEEGVQPDKDRGKLEVELLYKPFTEEEMPKGCEESQSVQKAPEGTPAGGGVLAVIVHSAEDVEGKHHTNPYVRIYFKGEERKTKHVKKNRDPRWEEEFTFMLEEPPVREKLHVEVLSTSSRIGLLHPKETLGYVDIPVVDVVNNKRMNQKFHLIDSKNGKIQIELEWRTTS

SEQ ID NO: 4930 - protein, 455 aa, Triticum aestivum
AYLGDTIEQVCTKKQAGTGPEFPGYRRPTRPSMRSTLFPNFGSMFSVAEQQQAKADWDAESHRDDEDYASDHGADDIEDSLNSPLISRQATSVEGKEIAAPHGSIMGGVGRSSSMQGGEAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRRFLLLSTIPVLIVALAVLVLVNVLDVGTMVHAALSTISVIVYFCFFVMGFGPIPNILCAEIFPTSVRGICIAICALTFWIGDIIVTYTLPVMLNAIGLAGVFGIYAIVCVLAFVFVYMKVPETKGMPLEVITEFFSVGAKQGKEATD

SEQ ID NO: 4931 - protein, 600 aa, Ustilago maydis 521
MADPAGQGVDVSDAANGPTRKRKPDQLANLDRYNFLRPSRGGNDDDDAAEEEDELLPLDHSELSSASYLARLTGVACLGGLQFGWDTGIASGMLVAIHSDLGHELNEGEQELIVSATTVGAILGSIVAGRMADWLGRKKVMIGSGVLFLLGALEQAASQVVRELVLGRVLVGLGVGMASMVVPTYLAEVAPTKVRGRIVGINSLLVTGGQVIAYLIDAAFYNLPHGWRWMVLAGGVPAVLQLVGMIYLDESPRWLVARGRIIRARRVLQRIYPHASVHTIDNEIDRISRSMQGATQHDSVDPDACHTAVQQAEEVQHDLSATLGRVTAAPAQLTSTARQTTTRVKSKLDMLLQDRTHRRALLIACVLQFFQQATGANSLLYYSSRLLMMAGFVVNPNAAAIGIAIANFGGTVIAVRYIDSWGRRKLLLYTTAAMTLCLALVAIGFSQIDLGPVTGTSEQGEPVSTSWPYWTLVFMIMFTLSYALGLGIVPWLVQSEIFSGQVRGVGAGLATATNWSTNLLISSTFLHLVKLIHPQGCFALFSAVSALSCAFTYWLLPETAGVSLNDVSGALPSTDRPGTHAHAAQAYQAIPSTEDADALE

SEQ ID NO: 4932 - protein, 150 aa, Sorbus aucuparia
AVCRSNPTPCKDPTDKLFTVHGLWPSNLNGPHPENCTNATVNAHRIKNIQAQLKIIWPNVLDRTNHVGFWNKQWIKHGSCGNPPIMNDTHYFQTVINMYITQKQNVSEILSRAKIEPLGIQRPLVHIDKAIRNSINNKKPKFKCKKNAGV

SEQ ID NO: 4933 - protein, 150 aa, Sorbus aucuparia
AVCRSNPTPCKDPTDKLFTVHGLWPSNLNGPHPQNCTNATVNSHRIKNIQAQLKIIWPNVLDRTNHLGFWNKQWIKHGSCGNPPIMNDTHYFQTVINMYITQKQNVSEILSKAKIEPLGIQRPLVDIEKAIRNSINKKKPKFKCQNNGGV

SEQ ID NO: 4934 - protein, 151 aa, Sorbus aucuparia
AVCNSNPTPCNDPPDKLFTVHGLWPSNRNGPDPEKCKTTALNSQKIGNMTAQLEIIWPNVLNRSDHVGFWEREWIKHGTCGYPTIKDDMHYLKTVIRMYITQKQNVSAILSKATIQPNGTNRPLVDIENALRRGTNNTKPKFKCQKNSRTT

SEQ ID NO: 4935 - protein, 350 aa, Staphylococcus epidermidis RP62A
MKAAVWYGQKDVRVEDREPKAIKDNEVQVKVSWAGICGTDLHEYLEGPIFISTDQPDPLLGQTAPVTLGHEFSGVVENVGKDVSRFKKGDRVVVNPTVSKREKPENVDLYDGYSFIGLGSDGAFAEFTNAPETNVYHLPDNVSAREGALVEPTAVAVQAVKEGELLFGDTVAVFGAGPIGLLTIVAAKAAGASKIFVFDLSEERLAKAKSVGATHVYNSGNVDPVQTVYEHTDNGVDVSFEVAGVGITLQQSIEVTRPRGTAVIVSIFGHPVEFNPLLQMNKGVKLTTTIAYTPTTFQQTIDLIANGSLNVKDVVTDQIELDNIVESGFNQLVNDKSQAKILVRLNGDQK

SEQ ID NO: 4936 - protein, 150 aa, Sorbus aucuparia
AVCNSNPTPCNDPPDKLFTVHGLWPSNVNGSEPKKCKTTILNPQTITNLTAQLEIIWPNVLNRRAHVRFWRKQWRKHGTCAYPTIADDMHYFSTVIEMYITKKQNVSEILSKAKIKPEKKFRTRDDIVNAISQSIDYKKPKLKCKNNNQM

SEQ ID NO: 4937 - protein, 139 aa, Sorbus aucuparia
AVCNSNPTPCKDPPDKLFTVHGLWPSNKNGPDPEKCKNIKMNSQKIGNMTAQLEIIWPNVLNRTDHVGFWEREWLKHGTCGYPTIKDDMHYLKTVIRMYITQKQNVSAILSRATIQPNGQNRSLVDIENAIRSGTNNMK

SEQ ID NO: 4938 - protein, 837 aa, Oryza sativa (japonica cultivar-group)
MAIHQLSFVLLLMLLAPATSRARDSIAPGEPLAGHDTLVSAGAGDGGGFALGFFTPPGSNDTYVGVWYARVSPRTVVWVANRADPVPGPVDGNAGATLSVSRACELAVADANSTVVWSVTPATTGPCTARIRDDGNLVVTDERGRVAWQGFDHPTDTLLPGMRIGVDFAAGNNMTLTAWKSPSDPSPSSVVVAMDTSGDPEVFLWNGPNKVWRSGPWDGMQFTGVPDTITYKNFSFSFVNSAREVTYSFQVPDASIMSRLVLNSSGGGLVQRWTWVEAAGAWNLYWYAPKDQCDAVSPCGANGVCDTNSLPVCSCLRGFAPRSPAAWALRDGRDGCARETPLGCANGTDGFAVVRHAKAPDTTAATVDYDAGLQLCRRRCLGNCSCTAYANANLSAPPGRRGCVMWTGELEDLRVYPAFGQDLYVRLAAADLDSTSKSKKKTHIIIAVVVSICALAIILALTGMYIWRTKKTKARRQGPSNWSGGLHSRELHSEGNSHGDDLDLPLFDLETIASATNGFSADNKLGEGGFGPVYKGTLEDGQEIAVKTLSKTSVQGLDEFRNEVMLIAKLQHRNLVQLIGYSVCGQEKMLLYEFMENKSLDCFLFDKSKSKLLDWQTRYHIIEGIARGLLYLHQDSRYRIIHRDLKTSNILLDKEMTPKISDFGMARMFGSDDTEINTVRVVGTYGYMAPEYAMDGVFSVKSDVFSFGVIVLEIISGKRNRGVYSYSSHLNLLARAWSSWSEGNSLDLVDKTLNGSFNQEEVLKCLKVGLLCVQENPDDRPLMSQVLLMLASADATSLPDPRKPGFVARRAATEDTSSSRPDCSFVDSMTITMIEGR

SEQ ID NO: 4939 - protein, 236 aa, Thermosynechococcus elongatus BP-1
MSDDAVKQMKQVVAKAAADRVQSGMVVGLGTGSTTAFVIQFLGDRLRKGELSNIVGVPTSFQASVLAKKYGIPLVTLDDVEKLDIAIDGADEVDPAKNLIKGGGAAHTREKIVDSLAEQFLVVVDSSKLVQKLGSTFPVPVEVLPFAVAPVTRALKALGGEPELRMGVKKDGPVVTDQGNFVLDVRFDDIPDPAELEKAINNIPGVVENGLFVNVADVILVGEIVDGQPQVREIFH

SEQ ID NO: 4940 - protein, 152 aa, Triticum aestivum
  misc_feature (65)..(65): Xaa can be any naturally occurring amino acid
  misc_feature (80)..(80): Xaa can be any naturally occurring amino acid
  misc_feature (110)..(110): Xaa can be any naturally occurring amino acid
  misc_feature (114)..(114): Xaa can be any naturally occurring amino acid
  misc_feature (126)..(126): Xaa can be any naturally occurring amino acid
  unsure (1)..(152): unsure at all Xaa locations
MSAYCGKYADELIKNAAYIGTPGKGILAADESTGTIGKRLSSINVENVEENRRALRELLFCCPGXALQYISGVILFEETXYQKTKDGKPFVDVLKEGSVLPGIKVDKGTXEVVXTDKETQPRHDDXGKRCAKYTRPCPFAIGCVPRWPNNLQ

SEQ ID NO: 4941 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 4942 - protein, 395 aa, Lactobacillus plantarum WCFS1
MTLFRDDLNETISHIQVSTIRQFDEEVSAIPDMVKLTLGEPDFNTPEHVKAAAKKAIDDNYSHYTGMAGLLELRQAAAHFQETKYGVHYDAEDQVLVTVGATEAIATALTTICNPGDAIIIPSPIFPAYIPIIQEAHAKPLFMDTGVNDFVITPKMVDDFIAAHPDENFKGIVLNYPNNPTGVTYVEDEIKALADCFHRHNLWVVSDEIYSELTYGSDHVSIAKFIPDEVILINGLSKSHAMTGWRIGFLFASKEMTAQLKKVHQYYVTAATTIAQKAGVEALTNGIDDAQPMRQEYQARRDFVYQTMSKLGFKIARPTGAFYIFAKIPAGFEQDSMAFCKDLARKNQLAIIPGTGFGAEGEGYVRLSYAASMEKLHQAMDRLTAYMQEPANCIN

SEQ ID NO: 4943 - protein, 392 aa, Triticum aestivum
  misc_feature (261)..(261): Xaa can be any naturally occurring amino acid
  unsure (1)..(392): unsure at all Xaa locations
AYLGDTIEQVCTKKQAGTGPEFPGYRRPTRPVVHEEGVRHRPTAAQRRRRIFSPRAVPECSVRARIRRSHNGRKHQRSVREKASNFLSEVAVVTGGNRGMGLEICRQLAGHGLAVVLTARDDKRGAEAAETLREEGLSDVAFHQLEISEPASAARLAAFVKKKFGKLDILVNNAGVLGVTTDVGDPATLQETLAGKDGMERAEWLRQRTTQTTQDAEDPRGRNYHGSKTVTEAPPPAPPSPPPTRRIVNVTSARGAAQVFXSGDHLPRGRLDDLPNLTARPLDEMLRLFLEDLGKGNGALERRGWPADRVYAAYMASKALVCAYTRVLAREEGAALRVNCVHPGYVLTGMNDYTGVLTAAEGAAAAVAVALAEKGGVTGAYFDRTELGASFV

SEQ ID NO: 4944 - protein, 215 aa, Triticum aestivum
  misc_feature (42)..(42): Xaa can be any naturally occurring amino acid
  misc_feature (73)..(73): Xaa can be any naturally occurring amino acid
  misc_feature (82)..(82): Xaa can be any naturally occurring amino acid
  misc_feature (86)..(86): Xaa can be any naturally occurring amino acid
  misc_feature (88)..(88): Xaa can be any naturally occurring amino acid
  misc_feature (90)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (98)..(99): Xaa can be any naturally occurring amino acid
  misc_feature (112)..(112): Xaa can be any naturally occurring amino acid
  misc_feature (120)..(120): Xaa can be any naturally occurring amino acid
  misc_feature (124)..(124): Xaa can be any naturally occurring amino acid
  unsure (1)..(215): unsure at all Xaa locations
MSAYCGKYKDELIKNAAYIGTPGKGILAADESTGTIGKRFAXSINVENVEDNRRALRELLFCTPGALQYLSGXVILFEETLXQSTXGXKXFXDILXGXXVLSPALRGERGPXNFVGNNRXETPXNGFLLKWQRLWPKLLTKAWWPPLFNGAWPSSKESGPPRPNKGHETKNGKGVLFGFPIQLQGKKGVGVSPIWGGPRNPLWLEWGPQLQFGRG

SEQ ID NO: 4945 - protein, 395 aa, Robiginitalea biformata HTCC2501
MKQFLSDRINNMATSATLAMAAKARELRQEGKDIIGLSLGEPDFNIPEFIREAAKEAIDQNYSSYSPVDGYGDLKQAISRKFARDNGLQYGIDQIVVSTGAKQSLANVAMVMLNEGDEVILPAPYWVSYSDIVKLAGGVPVEVPTSIDTDFKMTPDQLREAITPRTKMIWYSSPCNPSGSVYSKPELEGLAAVLREHPGIFVVSDEIYEHINFREGHVSMAGLEGMYDRTITVNGVSKAYAMTGWRIGFIGAPAWVAKACTKFQGQITSGANAIAQRATIAALDAPIEKIRYMIDKFHERRDLILELLGEIPGFNLNVPEGAFYVFPDISSYFGKTLGGKTIANASDFALYLLEAAGVATVTGEAFGNPNCIRISYAASEEEIREAVRRMQEALA

SEQ ID NO: 4946 - protein, 139 aa, Triticum aestivum
  misc_feature (80)..(80): Xaa can be any naturally occurring amino acid
  misc_feature (90)..(90): Xaa can be any naturally occurring amino acid
  misc_feature (95)..(95): Xaa can be any naturally occurring amino acid
  misc_feature (99)..(100): Xaa can be any naturally occurring amino acid
  misc_feature (107)..(107): Xaa can be any naturally occurring amino acid
  misc_feature (110)..(110): Xaa can be any naturally occurring amino acid
  misc_feature (118)..(118): Xaa can be any naturally occurring amino acid
  misc_feature (120)..(120): Xaa can be any naturally occurring amino acid
  misc_feature (122)..(122): Xaa can be any naturally occurring amino acid
  misc_feature (131)..(131): Xaa can be any naturally occurring amino acid
  misc_feature (136)..(136): Xaa can be any naturally occurring amino acid
  unsure (1)..(139): unsure at all Xaa locations
MAPTVMASSATSVAPFQGLKSTAGLPVSRRSNGASLGSVSNGGRIRCMQVWPIEGIKNSETLSYLPPLNTEASSSSPLPXFRSKWVPCLXFNKVXLSSXXHNASPGXYNXGRYWAMLXLXFXCTDPPGVNXVEEVXKDT

SEQ ID NO: 4947 - protein, 469 aa, Shigella flexneri 2a str. 301
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 4948 - protein, 541 aa, Desulfotalea psychrophila LSv54
MTVTQLSPLENYKVISGPIVMVVMDGLGLGEDGEQNGVYAAHTPTLDGLFQEKLFTSLKAHGTAVGLPSDADMGNSEVGHNALGAGRIFVQGAKLIDEALSRGDVFSGAAWQKIVECGESAGTVHFIGLVSDGNVHSNISQLFQLLDACAEAGIERVRVHALLDGRDVAQKSALDYIRPLEERLRALSVSGRDYRIASGGGRMVTTMDRYKADWSVVERGWRAHVLGEGRFFSSASEAVETFYREDSTMTDQYMAAFVVVEGETPVGTIEDGDAVVCFNFRGDRAIEISRAFDEEVFQEFDRVRRPDVFYAGIMEYDGDAHIPRNYLVEPPLIDATLGDYLCASGVTSYAISETQKFGHMTYFWNGNKSGYIDEGLELYEEVLSDRVTFDQRPWMKAAEITDKVIEQIEAGERKFIRLNYPNADMVGHTGVPLAVEIAVEAVDLCLARLLPAVEKAGGIVVISADHGNADCMWTEKGGKRLPMVAHTLNPVPCIIKDFSGQNDFVLTDLAERGLANVAATLCLLLGFNPPTDYEPSLLKLK

SEQ ID NO: 4949 - protein, 471 aa, Salmonella enterica
MIIPIIMAGGSGTRLWPLSRSLYPKQFLSLTSQHSLLQETLNRLKGLDCLSPIIVSNNEHRFIVAEQLRQLGINNFQIILEPVGRNTAPAVALAALKALELYGDHLMLVLAADHAIQNVDAFHTAIVAAEKEALNNKLVTFGIVPTKPETGFGYIKKGERVNDSSFQVESFVEKPDIETAKDYLKQNCYLWNSGMFMFKASTYLEELNKYRPDILSACKESLSGACTDLDFIRLNSEKFAACPDESIDYAVMEKTQDCVVVPLDANWSDIGSWSSLWDISEKDKNKNVSHGDVINYNSKNNYIYSESALISTVGVNNLIIVQTKDAVLVAQQDNVQDIKKIVEILKDSKRNEHISHREVYRPWGRYDSVEHGERYKIKRIMVKPGECLSSQMHHHRAEHWVVVAGTAKVTCGEQTYYVAENESTFIPIGTIHSIENPGKIPLEVIEIQSGPYLEDDDIIRLADKYGRVGEK

SEQ ID NO: 4950 - protein, 109 aa, Brassica napus
  misc_feature (29)..(29): Xaa can be any naturally occurring amino acid
  misc_feature (100)..(100): Xaa can be any naturally occurring amino acid
  unsure (1)..(109): unsure at all Xaa locations
MGNFLAKEPPPPVVLVPPLFDFPPLSARXRMLEPSYNLLFGKLALKCLFEDYFEDARQFSAKFLLKPIDDPHVDLVASLSGALDRKAEGDLVGNALFRWXSDVDDPHTF

SEQ ID NO: 4951 - protein, 150 aa, Sorbus aucuparia
AVCNSNPTPCKDPPEKLFTVHGLWPSNKNGPDPEKCKNIQMNSQKIGNMAAQLEIIWPNVLNRTDHVGFWEREWLKHGTCGYPTIRDDMHYLKTVIKMYITQKQNVSAILSKAMIQPNGQNRSLVDIENAIRSGTNNMKPKFKCQKNTRT

SEQ ID NO: 4952 - protein, 312 aa, Saccharomyces cerevisiae
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 4953 - protein, 302 aa, Zea mays
MQQQSFDCAGQQLTWHTVLDTSVLMVLHCIFEPFQEKAHYERVMETKVLGPITATESELTRLQQLHQEYFEKASTICAESEVEALGGVEGSTLEQLSARIKKLKQKFQQESRRYTETIDDLRALHDKKGQKILRKQQMYSGFRDKLNACQKALDLRWKKFQRNAGLLKRQLTWLFNEHLGKKGISGHINVDYKNEVLSVELTMPQDASRDTIRDTRGLSGGERSFSTLCFTLSLHGMAEAPFRAMDEFDVFMDAVSRKISLDTLVDFAVAQGSQWIFITPHDISMVKAGDRIKKQQMAAPRG

SEQ ID NO: 4954 - protein, 168 aa, Triticum aestivum
YSSSAPTRWELSHLVDLQAAALVISSGRPGRCLNLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 4955 - protein, 75 aa, Brassica napus
  misc_feature (7)..(7): Xaa can be any naturally occurring amino acid
  misc_feature (45)..(45): Xaa can be any naturally occurring amino acid
  misc_feature (53)..(53): Xaa can be any naturally occurring amino acid
  misc_feature (59)..(59): Xaa can be any naturally occurring amino acid
  unsure (1)..(75): unsure at all Xaa locations
EKEEVVXAYSMLSSAAVVTSPAQATMGAPFTGLKSSSAFPVTRKXNNDITSIXSNGGRXVPSIFASINLPSLPLP

SEQ ID NO: 4956 - protein, 143 aa, Sorbus aucuparia
AVCNSNPTPCKDPPEKLFTVHGLWPSNSNGPDPVNCKRKTKVPQAPQPIDATLKPQLEIIWPNVFNRADNESFWNKQWDKHGTCGYPTIKDKNHYFQTVIKMYITQKQNVSQILSKANINPDGLGRTRKLIESAIRNGTNDKE

SEQ ID NO: 4957 - protein, 518 aa, Photobacterium profundum SS9
MRDKLMSAKKPLALVILDGWGYREDNSDNAIANANTPVMDSLIANEANTLISASGFDVGLPDGQMGNSEVGHTNIGAGRVVYQDLTRITKSIADGDFFENEALTTAMDKAINAGKAVHIMGLMSPGGVHSHEDHIAAAIEMAAKRGAEKIYLHCFLDGRDTPPRSAQNSLERFDALFAELGKGRTASLVGRYYAMDRDNNWDRVEVAYNLLSAAKADFTVDSAVAGLTDAYSRDENDEFVKATEIRAEGQESAAMVDGDTVIFMNYRADRAREITRAFEADFTSFVRTQTPALAEFVMLTRYAANIKLPAAFPPATLKNTLGEWLSKKGKKQLRISETEKYAHVTFFFNGGVEDEFDGETRSLVASPKVATYDLQPEMSAPELTEKLVAAIKGGEFDTIICNYPNGDMVGHTGVYDAAVKACEALDGCIGQVVEAIKSVGGQLLITADHGNAEMMINPETGGVHTAHTNLPVPLIYVGDKSLTLKDGGKLSDLAPTMLSLSDIEIPAEMTGQVLFDLK

SEQ ID NO: 4958 - protein, 151 aa, Sorbus aucuparia
AVCNSNPTPCKDPADKLFTVHGLWPSNWTGPQPQNCTNTTVNSLTIKLLKAQLEIIWPNVLNRADHVLFWRKQWAKHGTCGSPAIRDDMHYFQTVIKMYITQKQNISKILSKAKIEPEGRSRKVVDIENAIRNGNNNTKPKLKCQNNNNGA

SEQ ID NO: 4959 - protein, 528 aa, Prochlorococcus marinus str. MIT 9211
MTKVLVSDPIDQAGIEILSQVAQVDQRIDLSNEQLKEVISEYEALMIRSGTQVTSEVIEASDRLRIIGRAGVGVDNVDVPAATKRGVLVVNSPGGNTIAAAEHALALLLALSRNIPQAHSSTFGGLWERKKYVGNELYKKILGVVGLGKIGSHVAKVANAMGMEVIAFDPFVSADRAQQMQVRLSSIDNLFEEADYITLHLPRTPETENLVNAQLLSTMKSTARLVNCARGGIIDEAALADALNSEVIAGAALDVYAEEPLKKDSPLLSVNKGLILTPHLGASTAEAQENVAIDVAEQIRDVLLGLPARSAVNIPGLSAEIMDSLKPHLQLAETLGLLASQISGGHIQKLEVRLQGEFAQHPSQPLVVATLKGLLSTALGDRINYVNASLEAKGRGINVLEVKDESCPDFSGGSLQLTTVADDGSHSLAGTVFADGDLRITCIDEFPVNVAPSRHMLFTRHRDMPGIIGKIGSLLGVHNVNIASMQVGRRIVRGEAVMVLSIDDPIPSELLKSILQIQGINEAHPVTL

SEQ ID NO: 4960 - protein, 529 aa, Bradyrhizobium japonicum USDA 110
MTKPKVLISDALSPAAVQIFKDRGIEVDFQPNLGKDKDKLAEIIGNYDGLAIRSATKATAKILEKATNLKVIGRAGIGVDNVEIPAATAKGIIVMNTPFGNSITTAEHAITLMLALAREIPQADASTQAGKWEKNRFMGVEITGKVLGVVGCGNIGSIVADRALGLRMKVVAFDPFLSPERAKDIGVEKVDLDDLLKRADFITLHTPLTEKTKNIIDAAAIAKMKKGVRLINCARGGLVDEQAVVDALNSKHIAGAAFDVFVEEPANTNVLFGHPNVICTPHLGASTTEAQENVALQVAEQMSDYLLTGAISNAVNFPSITAEEAPKLKPFIALAEKLGSFAGQLTESGILKVEITYEGHVAEMKIKAITSAVLSGLLRPMLGEVNVVSAPVVAKERGMVVDEIVRAAQSDYESLITVTVATERQERSVSGTVYHDGKPRLVDVKGIRVDAEFGKSMIYVTNEDKPGFIGAFASLLGAAKLNIATFHLGRVKLGGDAIALVEVDGAVPADVLAKVQALPQVKQAKALTF

SEQ ID NO: 4961 - protein, 149 aa, Sorbus aucuparia
AVCNFNPTPCKDPTDKLFTVHGLWPSNSNGNDPKYCNAQQYQTMKILEPQLVIIWPNVLNRNDHEGFWRKQWEKHGSCASSPIQNQKHYFDTVIKMYTTKKQNISEILSKANIKPGRKNRTLVDIENAIRNVINNMTPQFKCQKNTRTS

SEQ ID NO: 4962 - protein, 247 aa, Zea mays
  misc_feature (226)..(226): Xaa can be any naturally occurring amino acid
  misc_feature (237)..(237): Xaa can be any naturally occurring amino acid
  unsure (1)..(247): unsure at all Xaa locations
MSSAMESSYLPATTESIEKAQEAKDASESISILYRVIQDPSSSADALRTKELAITNLTNSLTKENRAEDLRNLLTQLRPFFSLIPKAKTAKIVRGIIDAVAKIPGTSDLQISLCKEMVEWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEXDYKTAYSYFFXAFEAFNALDD

SEQ ID NO: 4963 - protein, 393 aa, Hordeum vulgare subsp. vulgare
MSLPLTKKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVVEYQQLITQNPIFLERVEGVGFISGEEAVNWGLSGPMLRASGIQWDLRKVDPYESYNQFDWKVQWQKEGDSLARYLVRVGEMSESIKIIQQAIEKIPGGPYENLEVRRFKKEKNSEWNDFEYKFLGKKPSPNFELSRQELYVRVEAPKGELGIYLVGDDSLFPWRWKIRPPGFINLQILPQLVKKMKLADIMTILGSIDIIMGEVDR

SEQ ID NO: 4964 - protein, 272 aa, Wolbachia endosymbiont of Drosophila ananassae
LDVGAMTPLLWLFEEREKILEFYERASGARFHAAYIRPGGIAADVPEDLIEDIAKFIEQFPKYIDDVDELLTENRIWKQRTVGISEISIKQALDWGFSGPMLRAAGLAWDLRKSQPYEIYDQLDFDIPIGQNGDCYDRYLVRMAEIRQSISLVKQCIEKMPEGQIKTEDRKISPPSRAEMKKSMEALIHHFKLYSEGYHVPEGEAYAVVEAPKGEFGVYIVSDGTNRPYRCRIRAPGFAHLQALDFMAKGHMLADVAAIIGSLDIVFGEIDR

SEQ ID NO: 4965 - protein, 90 aa, Oryza sativa
  misc_feature (17)..(17): Xaa can be any naturally occurring amino acid
  unsure (1)..(90): unsure at all Xaa locations
MEQLFIMIKPDGVQRGXLIGDIISRIEKKGFYLRGMKFMNVERTFAQQHYDDLTDKAFLPGIEEYIIYGPLDTMVWEGKDAVDTGRRIIG

SEQ ID NO: 4966 - protein, 263 aa, Propionibacterium acnes KPA171202
MSGKIAVLGCGTMAGALVGGLIDAGQMKAEDVVATARSASHRDEIANTLGVTTSGDNTTAVRDADLVILGVKPYAAVDVLEEVSGALKADAVVVSIAAGVTTEKLLMAWQGKIVRVMPNTPVRVGKGAFIVSSAPGSEDAAKKVGDLLESVGVVVTVPEELHNAATAVSGSGPAYVFLVAEAMIDAAVALGVPRDQASQLTVATLAGSAELLAGGEHPAVLRSKVTSPGGTTAAAVAALEAGGVRSVFADAMTACRDRAAGLS

SEQ ID NO: 4967 - protein, 310 aa, Oryza sativa (japonica cultivar-group)
MEAAAISNPPSKRIALVTGGNKGVGLETCRQLASRGLRVVLTARNEARGLEAVDGIRRSGAADSDVVFHQLDVTDAASVARLADFVRDQFGRLDILINNAGISGVDRDPVLVAKVKDQIEGMDVDQRVEWMRENSKETYDEAKSCITTNYYGAKLVTEALLPLLLLSSSGRIVNVSSGFGLLRNFNSEDLRKEFDDIDSLTEKRLEELLDLFLDDFKVNLIEAHGWPTGGSSAYKVAKAALNAYTRILAKKYPTLRINCLTPGYVKTDISMHMGVLTPEEGASNSVKVALLPDDGPTGAYFDRNGEASFV

SEQ ID NO: 4968 - protein, 74 aa, Zea mays
FILSIQDGMWVVPSDYTSAEPDPLRNFAENIVEEFNNKNAEDVRRIYNIYVESDLQVADVKMIWVDRLGFDLHA

SEQ ID NO: 4969 - protein, 338 aa, Dechloromonas aromatica RCB
MTQQRTLARYLTEEQRNKGVITGDLKLLIEVVSRACQAISIAIGKGGLGGVLGEAGSDNVQGEAQKKLDVLSNDILLDANEWGGHLAAMASEEMDLPHLVPHRFPKGEYLLTFDPLDGSSNIDVNVSIGTIFSVLKCPEGADLSTPEAAEQAFLQPGTAQVAAGYAVYGPTTLLVLTVGDGVAVFTLDREQGQFILTLENVQIPADTKEFAINMSNQRFWEAPVQRYVAEMQVGKEGPLGKDYNMRWVASMVADVHRIMTRGGIFMYPMDSKIKGQGGKLRLMYEANPMAMLIEQAGGAATTGRQRILDIQPEKLHQRVPVILGSKNEVERVTGYHSA

SEQ ID NO: 4970 - protein, 307 aa, Oryza sativa (japonica cultivar-group)
MERDITSLPTKRVAVVTGGNKGIGLEVCRQLAADGITVVLTARDETRGVEAAEKLSGMGLSSVVFHQLEVTDSSSVARLADFLKTRFGKLDILVNNAAVGGMEYVQGVDTNKEQFVSMDKKQRLAWLNKQGRETYDAAKNGVQTNYYGTKIVIQALLPLLLQSSGEGRIVNVSSDFGLLRVVNNEDLRKELDDVDNLTEERLDEVLDSFLKDFEAGALEAHGWPTAFAAYKTAKVAMNAYTRILARRHPELRVNCAHPGYVKTDMTIDSGFLTPEEGGRNVVTVALLPDGGPTGAFFAEGKEASFLG

SEQ ID NO: 4971 - protein, 403 aa, Debaryomyces hansenii CBS767
MMALQWFGKEDVAVGKVPIPAITNDTDVIAKVTGTTICGSDLHLYHGEIMELKKGDVLGHEWCGIIEDVGPSVQNFKKGDRVVSSFQIACGECFYCRDNLSSMCDKTSTSRVQELMYGTAVSGIYGYSHFTGGYAGGQAEYVRAPRADYNLLKIPDKVPDEKALYLSDIVPTSYHSVVCADVKKGDTVAIWGLGPIGLCALRWAQLRGAKRVVGIDNVESRLAKAQSMGCKVLNFKDIDVVKEILNIVPGGVDSSIDAAGFRYANKLTHNIQRTLGLETDTSEVINEAIKATRKFGTIALVADYAGFANQFLIGGLMEKGITLRGCGQAPVQKYWHELLEKVEAGLFDPTFILTHRFPIEEFKELYQAFDKKKGGIGKVFVQTRFSSPPSEGTPSLSHVNELL

SEQ ID NO: 4972 - protein, 460 aa, Lactobacillus plantarum WCFS1
MSKQTHLSRQMESRHVLMISLGGVIGTGLFLSSGYTIHQAGPIGTLLAYTIGAILVYLVMLCLGELSVAMPYTGAFHVYAKKYIGPGTGFTVAILYWLTWTIALGSEFTAAGLIMQTWFPHIATWIWSLVFMVVIFTVNALSVRWFAETEFWFASIKVIAIIAFIVLGGLAMVGILPLHGHTSAPFLSNYTRNGWFPNGFGGVFTTMLTVNFAFSGTELIGITAGETKDPAHTIPTAIKTTLWRLIIFFIGSMFVMAALIPYKQAGVTQSPFVLVFKAIGIPYAADLMNFVVLTAIMSAANSGLYASTRMLWSLANEGTIPKVFKRTTKRDVPLVALITSMLGGILALLSSVYAAGSVYLVLVSISGLAVVIVWMAIALSEINFRKAYLKSGQSLDQLTFKTPGYPVVPWLAFILSGLSCILIWFDPNQRIALYYTIPFVAICYLGYYLNQRYRRTHAAK

SEQ ID NO: 4973 - protein, 283 aa, Listeria monocytogenes str. 4b H7858
MKTVKLNNGVEVPILGFGTYQITDAAEAEQAVKDAIETGYRHIDTAQSYMNEEAVGRGIVASGVDRKELFITTKIWVENVSYKGVMSSFDRSLKRLGLDYIDLLLIHQPFNDVYGAWIAMEELQASGKIRAIGVSNFSPDRVIDLAAFNEVTPQVNQIEVNPFQQQAANLAVLRKEGVAIEAWAPFAEGKNDIFNNPVLTKIGAKYGKSAAQVILRWLVEQDIIVLAKSVKPERMAQNLAIFDFELTEADKGEIASLDQGESQFFSHADPEMVKWMASRKLNV

SEQ ID NO: 4974 - protein, 610 aa, Clostridium perfringens str. 13
MGKITREAIHHIAQSNYSYGYDNETLHLRVKTKKGEVNKVEIRIGDPYIWDEGGCDGGNMNATGGRWTGGKSYPMRKECETKYFDHWIVGYKPLTKRSRYGFILYGDEETLLCTEKRIEELDGKYDEEKLSAIGNFYCFPYLNAIDVAKTPQWVKDTVWYQIFPDRFCNGDKSIDPENVEPWGTEPTRDNFMGGDLQGVLDKLDYLCDLGINGLYFCPVFEATENHRYETIDYFKVDPALGGNEVFKKLVSEAHKRGMKIMLDAVFNHIGYFSPKWQDVLKNNEKSRYKDWFCIKKFPVLENGLENVDGNNLNYETFGRIATMPKLNTENPEVVEYLLKVAKFWVEEMDIDGWRLDVCNEVDHVFWRKFREVVKGTNKEVYILGEVWHDGLPWLMGDQFDSVMNYPVTDAVKEYFCLNQSNPEDFKYMIEANKVSYLRQIGETIFNLLDSHDTPRILTVAGGNKDKMKLAYLFMFTQAGSPCIYYGDEVGMEGNQGMGMEFHRRCMIWDENKQDKDMLKFMKQIIKIRKENKELNLLDNNWIRANKDENILIYSKENIFIIMNNSENEEKIYLPKELKNNKINDLFEEKIELLKEDIDLKPFAFKVYKKL

SEQ ID NO: 4975 - protein, 477 aa, Dechloromonas aromatica RCB
MLRHTKIVATLGPASSTPEVLDRMVLAGIDVVRMNFSHGTADDHRARAEGIRAAAARHGRTIGILGDLQGPKIRVGKFEAGKITLVPGEKFILDAQCPLGNQERVGLDYKDLPKDVVNGDILLLDDGRLKLEVTGVRGHEIYTRIIVGGDLSNNKGINRQGGGLTAPALTGKDMDDIKTAADIGVDFVAVSFPKSAADMYMARQLLRAAGSTAVLIAKIERVEAITNLAEILDASDGIMVARGDLAVEVGDASVPALQKKMIRMARDRNKLTITATQMMESMITSPVPTRAEVSDVANAVLDGTDAVMLSAETASGKYPVETVESMARICVEAERSAEVTLDREFLDRIFTRIDQSIAMAAIWTAHHLKVKAIAALTQSGSTALWMSRMNSGVPIYALTPDAESVGRMVLFRGVCPLPMKQQHTDRDRLLAEAEQLLIDRGVVEKGDLIALTIGEPIGTTGGTNTLKIVRVGEHQLD

SEQ ID NO: 4976 - protein, 132 aa, Arabidopsis thaliana
  misc_feature (48)..(48): Xaa can be any naturally occurring amino acid
  misc_feature (52)..(52): Xaa can be any naturally occurring amino acid
  misc_feature (96)..(97): Xaa can be any naturally occurring amino acid
  misc_feature (101)..(102): Xaa can be any naturally occurring amino acid
  misc_feature (105)..(106): Xaa can be any naturally occurring amino acid
  misc_feature (120)..(120): Xaa can be any naturally occurring amino acid
  misc_feature (127)..(127): Xaa can be any naturally occurring amino acid
  misc_feature (129)..(129): Xaa can be any naturally occurring amino acid
  unsure (1)..(132): unsure at all Xaa locations
MPQGDYIDLHRKRNGYRLDHFERKRKKEAREVHKHSTMAQKSLGIKGXKMIXAKKNYAEKALMKKTLKMHEESSSRAVRLMRCSGRSCSCYLLVRXXPSCXXFLXXPFKPKEGKKKLANXEGPFPKXPXSCK

SEQ ID NO: 4977 - protein, 316 aa, Arabidopsis thaliana
MWFFGSKGASGFSSRSTAEEVTHGVDGTGLTAIVTGASSGIGVETARVLALRGVHVVMAVRNTGAGAKVKEDIVKQVPGAKVDVMELELSSMESVRKFASEYKSAGLPLNLLINNAGIMACPFMLSKDNIELQFATNHLGHFLLTKLLLDTMKNTSRESKREGRIVNVSSEAHRYSYPEGVRFDKINDESSYSSIRAYGQSKLCNVLHANELAKQLKEDGVNITANSLHPGAIMTNLWGYFNSYLAGAVGAVAKYMVKSVPQGAATTCYVALNPQVAGVTGEYFSDSNIAKPIELVKDTELAKKLWDFSTKLTDSQ

SEQ ID NO: 4978 - protein, 110 aa, Triticum aestivum
MAAAAATGGVTVAELEAAFKAAPLSAAAVTVTDVSGNCGSKFEVFVVSAAFEGVSILERQRMVHAAIGPQRMAKIHAVTIKAKTPAMAAAQAPAAAAAPAAAAAAPAASK

SEQ ID NO: 4979 - protein, 148 aa, Sorbus aucuparia
AVCNSNPTPCKDPPDKLFTVHGLWPSTKVGRDPEYCKTKRYRKIQRLEPQLEIIWPNVTDRTANRGFWRKQWYKHGSCASPALPNQEHYFETVIRMFLGEKQNVSRILSKATIEPEGKNRTLLEIQNAIRAGTNNMIPKLKCQKVNGV

SEQ ID NO: 4980 - protein, 209 aa, Cytophaga hutchinsonii ATCC 33406
MDQQAEKIKPKNSGTKKVFDNPILERLTRTHISVPITILMTIAAGLLYVAFVYTDYTQLTPMFVIGLFISGFFSFTLLEYIAHRYLFHMKPTNEFKRKVQYALHGLHHEYPKDKDRLAMPPIMSFLLAIVFFGIFYAMMNTKVFGFLPGFITGYCAYIFVHFIVHAYNPPKNFFKHLWLNHAIHHYKDNTQIFGVSSQLWDYVFGTIKK

SEQ ID NO: 4981 - protein, 149 aa, Sorbus aucuparia
AVCHFNPTPCKDPPDKLFTVHGLWPSNSSGNDPIYCKNTTLNSTKIANLTAQLEIIWPNVLDRTDHITFWNKQWNKHGSCGHPAIQNDMHYLQTVINLYITQKQNVSEILSKAKIEPVGKFRTQKEIEKAIRKGTNNKEPKLKCQKNTQ

SEQ ID NO: 4982 - protein, 346 aa, Alkaliphilus metalliredigenes QYMF
MKNRAVFMQGTDNMVTKDVPMPKIKEKDVLIKVDIVGICGSDVHYYKHGKIGDFVVEGEFILGHEAAGEVVEVGEQVKGLTVGDRVTMEPGKTCGKCEFCKGGKYNLCPDVEFFATPPYHGVLTNYVSHPEDMCFKLPKNVSNVEGALVEPLAVGLHASDQGGVKLGDTVVIFGTGCIGLMTIISCKAKGAAKIIVVDILENRLEVAKKVGATDTINAKEVNVLKKIQELTDGKGAEVVIDAAGAAITVKQTVDAVKPGGTIVLVGMTPKDEVEFNFMKLMGKEAEVKTVFRYRNLYPIAINAIASGAINIKDIVSHEFDFEQTKEAFDFVAEHASDVVKAVIKIK

SEQ ID NO: 4983 - protein, 262 aa, Photobacterium profundum SS9
MIWRKTMRHPVVMGNWKLNGSKEMVVNLLNGLNAELEGVTGVDVAVAPPALFIDLAEHTLTEAGSAIILGAQNSDLNNSGAFTGDMSPAMLKEFGASHIIIGHSERREYHNESDEFVAKKFAFLKENGLTPVLCIGESDAQNEAGETMAVCARQLDAVINTQGVEALEGAIIAYEPIWAIGTGKAATAEDAQRIHAQIRAHIAEKSEEVAKNLVIQYGGSVKPENAAAYFAQPDIDGALVGGAALDAKSFAAIAKAAAEAKA

SEQ ID NO: 4984 - protein, 146 aa, Sorbus aucuparia
AACNSNPTPCKDPPDKLFTVHGLWPSDSNGNDPKYCKAPPYQTMKILEPQLVIIWPNVLNRNDHEVFWRKQWDKHGSCASSPIQNQTHYFDTVIKMYTTQKQNVSEILSKANIKPGRKSRRLVDIENAIRNVINNMTPKFKCQKNT

SEQ ID NO: 4985 - protein, 394 aa, Thermosynechococcus elongatus BP-1
MPKIETRTEPMVINMGPHHPSMHGVLRLMVTLDGEDVIDCEPVIGYLHRGMEKIAENRTNIMFIPYVSRWDYAAGMFNEAVTVNAPEKLAGIPVPKRASYIRVIMLELNRIANHLLWLGPFLADVGAQTPFFYIFREREYIYDLFEAATGMRFINNNYFRIGGVAADLTYGWVTKCRDFCDYFLPKVDEYERLITNNPIFVRRLQGVGKISREEAINWGLSGPMLRASGVKWDLRKVDHYECYDDFDWDVPVATEGDCLARYIVRIQEMRESVKIIRQALDGLPGGPYENLEAKRMLEGAKSEWNGFDYQYIGKKLSPTFKIPKGEHYVRVESGKGELGIYLIGDDNVFPWRWKIRPPDFNNLQVLPQLLKGMKVADIVAILGSIDVIMGSVDR

SEQ ID NO: 4986 - protein, 146 aa, Sorbus aucuparia
AVCNSNPTPCKDPPDKLFTVHGLWPSDSNGNDPKYCKAPPYQTIKILEPQLVIIWPNVLNRNDHEGFWRKQWEKHGSCASSPIQNQKHYFDTVIKMYKTQKQNVSEILSKANIKPGRKNTTLVDIENAIRNVINNMTPKFKCQKNP

SEQ ID NO: 4987 - protein, 393 aa, Magnetospirillum magnetotacticum MS-1
MELKRQHLIDPVVCIRCNTCEEACPVDAITHDGTNYVVSFDKCTGCRTCVSPCPTGAIDNWLLVDQPWSIDDQFGWDELPLGQTGPGPAEPAPLPPGEVSDLLAAATSTTGPSVPPPASASKPYFNLYSRDKPVTARVAGNMRITGEGAESDIHHVVLDFSHNAFPFLEGQSIGIVPPGVDAKGRAHNIRLYSIASPREGERSGCNNLALTVKRVAGGVGSNYVCDLKKGDEVSVAGPFGQAFLMPDDPHANIIMICTGTGSAPFRAFTERRRRNAADAPGKLMLFFGARTPEELPYFGPLMKLPKSLIDVNLAFSRVADQPKQYVQDKLRERADDLAALLASPQTHIFICGLKGMEQGSDEAFADICRLHGLDWAGLRPKMREEGRYHVETY

SEQ ID NO: 4988 - protein, 149 aa, Sorbus aucuparia
AACNSNPTPCKDPPDKLFTVHGLWPSNKIGRDPEYCKTRNRRKRAKTLEPQLGIIWPNVLDRTNHTGFWRRQWKKHGTCGYPTIQNENDYFETVIKMYITEKQNVSRILSNAKIEPDGQSRPLVDVENAIRNGTHNKKPKFKCQKNNGV

SEQ ID NO: 4989 - protein, 98 aa, Zea mays
  misc_feature (76)..(76): Xaa can be any naturally occurring amino acid
  misc_feature (78)..(78): Xaa can be any naturally occurring amino acid
  misc_feature (85)..(85): Xaa can be any naturally occurring amino acid
  unsure (1)..(98): unsure at all Xaa locations
PTCSPLLLPVIPILLVRQGPLPHDGEARVPDAANRIKGWFMTYIDRDSEQAVKERLKRKRIKSDMADDERQERMIXRXIERAHKXLAKPNGGGAAEGE

SEQ ID NO: 4990 - protein, 466 aa, Streptococcus suis 89/1591
ESSAQKIAALITEGANVFRFNFSHGDHQEQGDRMATVRRAEEIAGKKVGFLLDTKGPEIRTELFEDDAKEYAYTTGDKLRVATKQGIKSTKEVIALNVAGGLDVFDDVEVGKQILVDDGKLGLTVVEKDAVNREFVVLVENDGVIAKQKGVNIPYTKIPFPALAERDNADIRFGLEQGLNFIAISFVRTAKDVEVVRNICKETGNDHVQLFAKIENQQGIDNIDEIIEAADGIMIARGDMGIEVPFEMVPVYQKMIITKVNAAGKAVITATNMLETMTEKPRATRSEVSDVFNAVIDGTDATMLSGESANGKYPVESVRTMATIAKNAQTLLNEYGRLNSDQFNRASKTEVIASAVKDACHSMDIKLVVTVTETGYSARSISKYRPDADILAVTFTEKVQKSLMLNWGVIPIVTNRPDSTDDMFDLAERIAKEQGLVEAGDDIIIVAGVPVGVAGSTNTMRVRTVK

SEQ ID NO: 4991 - protein, 410 aa, Bradyrhizobium japonicum USDA 110
MGHDACQEMTMSFLAAALDRVKPSATIAVTDKARALKAAGRNVIGLGAGEPDFDTPANIKLAAIHAIEAGKTKYTAVDGIPELKEAIIAKFQRENGVVYKPNQVIVGTGGKQVLYNALMATINPGDEVIIPAPYWVSYPEMVALAGGEPVPVVCTAATGFKLGAEALERAITPKTKWVILCSPSNPTGAAYTRAELKALTDVLVKHPHVWVMTDDMYEHLVYDDFQFTTVAQVEPSLYDRTLTVNGVSKAYCMTGWRIGYAGGPAQLIKAMATIQSQSTSNPCSIAQWASVEALNGPQDFIPANNKVFKERRDLVVSMLNQANGIECPRPEGAFYVYPSCAGTIGKKAPSGNVISNDEQFVTELLETEGVAVVQGSAFGLGPAFRISYATKTSDLEDACKRIQRFCGNLR

SEQ ID NO: 4992 - protein, 337 aa, Lentinula edodes
MAVKVGINGFGRIGRIVLRNALLNPEVNVVAVNDPFIALEYMVYMFKYDSVHGRFKGTVETKGGKLIVDGKEISVFGEKDAGAIPWSSVGAEYIVESTGVFTTIEKASAHLKGGAKKVIISAPSADAPMYVCGVNLDSYDSQHAVISNASCTTNCLAPLAKVIHDKFGIVEALMTTVHATTATQKTVDGPSNKDWRGGRSVNGNIIPSSTGAAKAVGKVIPSLNGKLTGLAFRVPTLDVSVVDLVCRTEKSATYDEIKAAVKEASKGPLKGILGYTEDHVVSTDFIGDNHSSIFDATAGIQLNKNFVKLIAWYDNEWGYSGRVVDLLVFAAKKDGAL

SEQ ID NO: 4993 - protein, 476 aa, Streptomyces coelicolor A3(2)
MRRSKIVCTLGPAVDSHEQLVTLIEAGMNVARFNFSHGTHAEHQGRYDRVRAAAKETGRAIGVLADLQGPKIRLETFAEGPVELVRGDEFTITAEDVPGDRTICGTTYKGLPGDVTKGDQVLINDGNVELKVTEVEGPRVKTIVIEGGVISDHKGINLPGAAVNVPALSEKDVEDLRFALRMGCDLVALSFVRDAKDVADVHRVMDEEGRRVPVIAKVEKPQAVDNMEDVVMAFDGVMVARGDLAVEYPLEKVPMVQKRLIELCRRNAKPVIVATQMMESMITNSRPTRAEASDVANAILDGADAVMLSAESSVGAYPIETVKTMSKIVTAAEQELLSKGLQPLVPGKKPRTQGGSVARAAAEIADFLGGKGLVAFTQSGDTARRLSRYRAAQPILAFTTDESTRNQLALSWGVEPHVVPFVNTTDEMVDLVDQETARLGRFSDGDTVVITAGSPPGVSGTTNMVRVLHLGETRRG

SEQ ID NO: 4994 - protein, 230 aa, Lactobacillus acidophilus NCFM
MDKKEQDRLKKEAAEKAANMVQSGMILGVGTGSTVAFFIDALGKRKDEEDLKLKAIVTTSNRSKKQLESLGFEVSELADIDQADLTVDGSDRVADNLDGIKGGGGALTLEKNVAINSKKIVWIVDESKLVHRLSGFPLPVEVLPISCEQNFRRFEQEGLKPQWRTDGDKRYITHYGNYIIDLAVDPIPAPHGLADYLDHTVGVVEHGLFLDMCDEVIIAHSDGTIEDKIK

SEQ ID NO: 4995 - protein, 309 aa, Oryza sativa (japonica cultivar-group)
MEETIFSSTHTRIAVVTGGNKGIGLEVCRQLAGNGATVVLTARDEAKGAAAVEKLHGLGLSSVIFHQLDVTDASSIARLAEFLESRFGRLDILVNNAAVGGIVPVDDPSFGLLPTEEKFSGMDGHQRIEWMWKNCRQTYDAAKAGLKTNYYGTKNVTEALLPLLQSSSDGRIVNVASSFGLLRFFTNEELKRELNDADSLSEERLDELLGMFVRDFEAGAVAERGWPTEFSAYKVAKAAMSAYARILARKRPALRVNCVDPGYVKTDLTRNSGLLTPEEGASRVVAVALLPAGGPTGALFDGGKEASFV

SEQ ID NO: 4996 - protein, 144 aa, Oryza sativa
MAGAAKASWMVAMSVGAVEALKDQAGLCRWNYALRSIHRAAKANARAGVSRGKKLPASAAAVAERRRAEKAEEGLRTVIEASWMVAMSVGAVEALKDQGGLCRWNYALRSHKAAKANAPASRRARSCLLRGGVRRERAEKAEEG

SEQ ID NO: 4997 - protein, 148 aa, Triticum aestivum
  misc_feature (81)..(81): Xaa can be any naturally occurring amino acid
  misc_feature (87)..(87): Xaa can be any naturally occurring amino acid
  misc_feature (109)..(109): Xaa can be any naturally occurring amino acid
  misc_feature (115)..(115): Xaa can be any naturally occurring amino acid
  misc_feature (121)..(121): Xaa can be any naturally occurring amino acid
  unsure (1)..(148): unsure at all Xaa locations
MAPTVMASSATSVAPFQGLKSTAGLPVSRRSNGASLGSVSNGGRIRCMQVWPIEGIKKFETLSYLPPLSTEALLKQVDYLXIRSKWXVPCLDSASWVHLPVEHNASPGXYYDGRXYWDNVXTAYFGCTDPPVGSQEGYLTLCISVRKS

SEQ ID NO: 4998 - protein, 307 aa, Oryza sativa (japonica cultivar-group)
MEGATSSLPSQSARVAVVTGGNKEIGLEVCRQLAADGITVVLTARDETRGVEAAERLRGMGLSSVVFHQLEVTDSSSVARLADFLKTRFGKLDILVNNAAVGGMEYAQGVDNNEEQFVGMDVLQRLQWMRKQGRETYDTAKNGVQTNYYGAKHVIQGLLPLLLSSSEGKIVNVSSALGLLRFLGNEDLRKELDDIDNLTEERLDEVLASFLKDFEAGELEAHGWPMGSAAYKVAKVAMNAYTRISARKHPALRINCAHPGYVKTDLTINSGFLTPEEGARNVVTVALLPDGGPTGAFFDEGKEASFV

SEQ ID NO: 4999 - protein, 293 aa, Trichodesmium erythraeum IMS101
MTSTLIEKIQKFYDASSSLWEQAWGEHMHHGYYGPDGKQKKTRRQAQIDMIEELLHWGSENQASSLWPPTSILDVGCGIGGSTLYLAEKFNATATGITLSPVQAKRAEERAESANLSQQTNFIVADALDMPFTDQSYDLVWSLESGEHMPNKKKFLQECHRVLKPGGRIIMATWCHRTLDGYLGQLTDDERRHLADIYRVYALPYVISLSEYEAIAENISFQNISIADWSTAVAPFWDVVIESAFDPKVIVSLLFSNWTTIQAAISLELMSRGYERGLIKFGLLRGNKQLINT

SEQ ID NO: 5000 - protein, 405 aa, Burkholderia pseudomallei K96243
MVPHRTRIYVAATVDTKGAEAHFVKDRIADAGLAAVVVDLSTRVPGLAADIGADAVAAHHPDGAAAVFCGDRGRAIAAMAVAFEHYIKSRDDVAALIGIGGSGGTALVTPAMQALPIGMPKLMISTMASGDVSAYIGSSDIAMLYSVADIAGLNRISRQVLANGAHMIAGAVRDMQPPHADLKPALGLTMFGVTTPCIQAVTSRLDARFDCIVFHATGKGGPAMEKLADSGLLDGVLDLTTTEVCDLLMGGVLACGADRFDLIARSRVPYVGSCGALDMVNFGHIDTVPPRYAQRLLYKHNPQVTLMRTTPDENRRIGEWIGAKLNACDGPVRFLIPEGGVSALDAPGQAFWNPQADEALFDALEATVVQTERRRLVRVPAHINDARFADAAVEHFLSLHAAHRN

SEQ ID NO: 5001 - protein, 282 aa, Burkholderia pseudomallei K96243
MKMKRLSRVEILEKLRATIARGEPIVGGGAGTGLSAKCEEAGGIDLIVIYNSGRYRMAGRGSLAGLLAYGNANEIVVDMAREVLPVVKSTPVLAGVNGTDPFCNFDAFLDELTRLGFSGVQNFPTVGLIDGNFRANLEETGMGYALEVDMIRLAHRKGLLTTPYVFSEADAIAMTEAGADIVVAHLGLTTGGTIGANTARTLADCVPLVRSWADAAKSVRDDVIVLCHGGPIASPEDAAYILRACPQCHGFYGASSMERLPAETALTDMTRRFKEIDRHAAS

SEQ ID NO: 5002 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 5003 - protein, 139 aa, Desulfovibrio desulfuricans G20
MAERTFAIIKPDATRRNLEGPILSVIQQNGLRVVAMKKMRLTREQAEGFYHVHKERPFFASLTDFMTSGPIVAMVLEGDNAVARWRELMGATNPENAAEGTIRRQFAEGLEANSVHGSDAAETAAFEMGYFFNAMEITG

SEQ ID NO: 5004 - protein, 161 aa, Pyrococcus furiosus DSM 3638
MNEVERTLVIIKPDAVVRGLIGEIISRFEKKGLKIVGMKMIWIDRELAEKHYEEHKGKPFFEALIDYITKAPVVVMVVEGRYAVEVVRKMAGATDPKDAAPGTIRGDYGLDIGDAIYNVIHASDSKESAEREISLYFKPEEIYEYCKAADWFYREKKQAKC

SEQ ID NO: 5005 - protein, 391 aa, Triticum aestivum
MDGARRAKGLGMHVIAHDPYASADRARAIGVDLVSMEEAMTTADFISLHMPLTPSTNKMLNDEAFAKMKKGVRIINVARGGVIDEDALVRALDAGIVAQAALDVFTKEPPAADSKLVLHENVTVTPHLGASTVEAQEGVAIEIAEAVTGALKGELAASAVNAPMVPAEVLSELAPYVMLAEKLGRLAVQLVAGGGGIKSVKVTYASARAPDDLDTRLLRAMITKGVIEPISDVFVNLVNADFTAKQRGIRVSEEKIVMDGSPETPLEYIQVQIANVESKFPSAICDSGLVTVEGRVKDGIPHLTKVGAFEVDVSMEGSLILCRQVDQPGMIGSVGSVLGEENVNVSFMSVGRIAPRKTAIMAIGVDEEPSKATLTKIGEIPAIEEFVFLKL

SEQ ID NO: 5006 - protein, 273 aa, Yersinia pestis biovar Medievalis str. 91001
MQHRNITFIGAGNMARAIIAGLVAGGYPAKMISVCAPSAKNRDALATEFGVISSDDNIRESQKAEVVVLAVKPQLMADVCQQLQKQVDFSDKLVLSIAAGVQVARFYALLGNKLNLVRIMPNTPSLVGKGMSGLYAPEQVSAADRDFTTELMSAIGKVCWVDNEDGINSIIAAAGSSPAYFFLFMEAMQQETERLGFDSETARQLVQQAASGACALVEANPHVPLSALREQVTSKGGTTAEAIRVFNEQHLPEMVANAMRAAIARAKEMEKLF

SEQ ID NO: 5007 - protein, 148 aa, Sorbus aucuparia
AVCNSSRTRCKDPPDKLFTVHGLWPSSMVGPDPSNCPIKNIRKREKLLEPQLEIIWPNVFDRTKNKLFWDKEWMKHGSCGYPTIDNENHYFETVIKMYITRKQNVSGILSKAKIEPDGRKRTLLDIENAIRNGADNKKPKLKCQKKGT

SEQ ID NO: 5008 - protein, 150 aa, Crataegus monogyna
AVCNSNSIPCKDPPDKLFTVHGLWPSDSNGHDPVNCSKTTVDAQKLGNLTTQLEIIWPNVYKRTDHISFWNKQWTKHGSCGHPTIMNDIHYFQTAIKMYITQNQNVSKILSQAKIEPEGKPRKQVDIVNAIRKGIDDKEPKLKCQKHNQV

SEQ ID NO: 5009 - protein, 368 aa, Zea mays
MDRELLETFDVAKKAADAAAGDGNSPEAGRCLDALRRLRDIRVNTDILVSTQVGKRLRPLTKHPHSGIQAVAADLFGYWKKVVLEESGKKNGGSENERSSDSSGKVEKARPVKIEKNSVSASMKLEKRDVDVRGQKPNNAKVEKTTSNGSKAQSVKVERVSKEVIRTPDAKRPASVPNGHPKLTSLVKCNDPTRDKIRELLAEAFVRVSRETSDDDRDEVKNILDEVEACDPYRVAVTVESALFERLGPSTGTHRAKYRSIMFNLRAESNTDFRRRVLIGLVAPERLPDVSPDEMASDARKQENMQIKEKALFDCERGAAPKATTDQFKCARCGQRKTTYYQLQTRSADEPMTTFVTCVNCNNHWKFC

SEQ ID NO: 5010 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVAVAVEESYSGNYIVVFDPLDGSSNLDAAVSTGSIFGIYSPNDECLPDFGDDSDDNTLGTEEQRCIVNVCQPGSNLLAAGYCMYSSSVAFVLTIGKGVFVFTLDPLYGEFVLTQENLQIPKSGEIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 5011 - protein, 149 aa, Crataegus monogyna
  misc_feature (87)..(87): Xaa can be any naturally occurring amino acid
  unsure (1)..(149): unsure at all Xaa locations
AVCYFNPTPCKDPPDKLFTVHGLWPSNLNGHHPENCTNATVNSQRLTNIQAQLKTIWPNVLDRTNNVGFWNKQWIKHGSCGNPPIMXDTHYFQTVINMYITQKQNVSGILSKAKIEPVGGKRPLVDIENAIRKSINNKKPKFKCQMKNK

SEQ ID NO: 5012 - protein, 336 aa, Pseudomonas aeruginosa PAO1
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 5013 - protein, 139 aa, Crataegus monogyna
AVCNSNPTPCNDPTDKLFTVHGLWPSNKNGPDPEKCKTTALNSQKIGNMTAQLEIIWPNVLNRSDHVGFWEKEWIKHGTCGYPTIKDDMHYLQTVIRMYITQRQNVSAILSKAMIQPNGTNRPLVDIENAIRRGTNNTK

SEQ ID NO: 5014 - protein, 124 aa, Glycine max
VGKLARVTAPGAPIIIVTWGPRGFGPFEQSFPPWGQDFLKKIWEAYSPPAGGPPFDYVKVVQTPSLRGLKSKNWSPFVAPFWPPVIRPPFPRKGLTSLLGRGQKTIKGALGFPFLIKGSQKNLI

SEQ ID NO: 5015 - protein, 298 aa, Triticum aestivum
  misc_feature (95)..(95): Xaa can be any naturally occurring amino acid
  unsure (1)..(298): unsure at all Xaa locations
MSEHPPHCQGAPKVFQTIWAKLGRVINKGFSGFKQESGDTVFPWPQSHPGIKSPQTDGDGFANALQKMGLGEVRDASTQAVDSAVRVLKEGGMEXIKLEGGAPSRISAAKAIVEAGIAVMGHVGLTPQAISVLGGFRPQGKTVDSAIKVVETALALQEAGCFSVVLECVPAPVAAAATSALKIPTIGIGAGPFCSGQVLVYHDLLGMMQHPHHAKVTPKFCKQFGNVGSVINKALSDYKQEVETRSFPGPSHTPYKITATDVDGFANALQKMGLGEAADAAAAAAENSENDGKPSENS

SEQ ID NO: 5016 - protein, 330 aa, Zea mays
  misc_feature (201)..(201): Xaa can be any naturally occurring amino acid
  unsure (1)..(330): unsure at all Xaa locations
MASAGTTAVVPEVALRSGNARTAMPMVGMGTASFPLVHEAVKDGVLSAIEVGFRHFDTASMYGTEKPLGDAVAEALRRGTLRSREDLFVTSKLWCSQNHPDLVLPSLRETLKNLQMEYVDLYLIHWPVCLKPGPPELPTRKENAVPLDLAGVWRAMEECQRLGLAKAIGVSNFTTRHLDGVLAVATVPPAVNQVELNPGVXQQRTLRAYCADRGIHVAAYSPLGGQNWDGQGSAVLDSEVLAAIAKARGKTVAQVALRWIHEQGVTCIVKSYSKERLRQNLGIFDWELTDEERLKISQIPQRKVVQTSSLFSQEGEFTAVDPAELNILEE

SEQ ID NO: 5017 - protein, 283 aa, Streptococcus suis 89/1591
MATIQWFPGHMSKARRQVQENIKHVDFVTILVDARLPLSSQNPMLTKIVGDKPKLMILNKVDLADPVRTKEWQSYFEGQGIRTLAINSKEQATVKKVTDAAKSLMKDKIERLRERGIQKETLRTMIIGIPNAGKSTLMNRLAGKKIAVVGNKPGVTKGQQWLKSNKDLEILDTPGILWPKFEDQEVGLKLALTGAIKDQLLPMDEVTIFGLDYFKANYPERLQERFKGMDLEQETPELIMDWTKKLGFRDDYDRFYNLFVKDVRDGRLGTYTLDRVSDLDGND

SEQ ID NO: 5018 - protein, 448 aa, Streptococcus suis 89/1591
MVVTTADIKRDIKEKNVTFLRLMFTDIMGVMKNVEIPATEEQVEKVLSNKVMFDGSSIEGFVRINESDMYLYPDLNTWTIFPWGDENGRVAGLICDIYTTEGEPFAGDPRGNLKKSLRRMEKEGFSSFNLGPEPEFFLFKMDEQGNPTLEVNDKGGYFDLAPTDLADNTRREIVNVLTEMGFEVEASHHEVAVGQHEIDFKYADVLKACDNIQIFKLVVKTIARKHGLYATFMAKPKFGIAGSGMHCNMSLFDKDGNNAFFDPEDPRGMQLSETAYHFLGGLIKHAYNYTAITNPTVNSYKRLVPGFEAPVYIAWAGKNRSPLVRVPASRGMGTRLELRSVDPTANPYLAMAVLLEVGLDGIEHKIEAPAPVESNIYAMSDEERREAGITDLPSTLHNALKALRKDDVVRSALGDHIYTNFLEAKKIEWASYATYVSQWEIDNYLDMY

SEQ ID NO: 5019 - protein, 141 aa, Zea mays
  misc_feature (47)..(47): Xaa can be any naturally occurring amino acid
  misc_feature (130)..(130): Xaa can be any naturally occurring amino acid
  unsure (1)..(141): unsure at all Xaa locations
QKTKDGKPLCDVLKEGGVLPGIKVDTGTIEVVGTDKETTTQGHDDLXKRCAKYYEAGARYAKRCAALKIVPNEPEQVAIDLNAHGLARYAIICHENGLVPIDEPEILCDGPHDIDRCSYLTDTVLAACYXLNAYHVLLEGT

SEQ ID NO: 5020 - protein, 376 aa, Zea mays
  misc_feature (99)..(99): Xaa can be any naturally occurring amino acid
  unsure (1)..(376): unsure at all Xaa locations
MPAASWSAPTTSFAPAPAPPWGPWRTKAAPLPIRTLPRRVLLNAVGESAMVAAGDTLLGLYEKERLGLLQYADDESKEERYWETLDADLRYWTRSLRPXVQWYPGHIAKTEKELKEQLRLMDVVIEIRDARIPLSTSHPKMDSWLGNRKRIIVLNRKDMISTEDMNAWATYFGNQGIKVVFSNGQLGMGTMKLGRMAKSVASVANTKRKEKGLLPRPVRAGIVGYPNVGKSSLINRLLKRRMCPAAPRPGVTRELKWVRFGTDLELLDSPGILPMRISDQTSAIKLAICDDIGERSYDFADVAAILVQMLIRHPAVGSEAFRRRYKIDVDSECGKTFVTKLSVHLFNGDTSQAAFRILSDYRKGKFGWVALERPPT

SEQ ID NO: 5021 - protein, 393 aa, Eucalyptus globulus subsp. globulus
MNVTTTRKDLMIVNMGPHHPSMHGVLRLILTLDGEDVIDCEPILGYLHRGMEKIAENRTVIQYLPYVTRWDYLATMFTEAITVNGPEQLGNIQVPKRASYIRVIMLELSRIASHLLWLGPFMADIGAQTPFFYIFRERELVYDLFEAATGMRMMHNYFRIGGVAADLPYGWIDKCLDFCDYFLTAVSEYQKLITRNPIFLERVEGVGIIGPEEAINWGLSGPMLRASGIQWDLRKVDHYECYDELDWEIFWQKEGDSLARYLVRIGEMRESIKIIQQALEGIPGGPYENLETRCFARERDPEWNDFEYRFISKKPSPTFELPKQELYVRVEAPKGELGIFLIGDQSGFPWRWKIRPPGFINLQILPQLVKRMKLADIMTILGSIDIIMGEVDR

SEQ ID NO: 5022 - protein, 267 aa, Desulfovibrio desulfuricans G20
MKNTVLGCIGCGNMGGAIMRGLAGVEGLQLAGFNRSAPKVEALRDEIGLEPAPDAVALARRADIILLGVKPDQICDVIGQVRPVLDAGKVLVSIAAGVSLEAMRSAAQGAAPVVRVMPNTPAMVGRGIYGMCLDDPALSAEAATAVRNLFAAIGKVIVLPEQKFEAFTAVAGCGPAYVFHMMEAVIEAAVTVGFTRQQATEMVTELFSGSCALAEQTGIHPSLLREMVTSPAGTTIAGTNHLDRTAVRGHIIDAVLAAYEKGLAMRR

SEQ ID NO: 5023 - protein, 206 aa, Prunus persica
HGTEVAVKILMEQDFHAERFKEFLREVTIMKRLRHPNIVLFMGAVTKPPNLSIVTEYLSRGSLYRLLHKPGATEALDEKRRLNMAYDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDL

SEQ ID NO: 5024 - protein, 172 aa, Prunus armeniaca
YFQFVQQWPPTNCIVHTKCSNPRPLQIFTIHGLWPSNYSNPTVPSNCNGSKFDARKYPQLQSKLKKSWPDVESGNDTKFWEGEWNKHGTCSEQTLNQYQYFEISHDMWYSFNITNILKNASILPSATQTWTYSDIVAPIKTVTKRTPLLRCKRDPARNKSLPNYQLLHEVVF

SEQ ID NO: 5025 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 5026 - protein, 139 aa, Crataegus monogyna
AVCSSNPTPCKDPPDKLFTVHGLWPSNVNGSEPKKCKTTILNPQTITNLIAQLKIIWPNVLNRKAHVRFWRKEWRRHGTCVYPTIADDMHYFSTVIEMYITKKQNVSEILSKANIKPEKKFRTRDDIVNAISPSIDYKK

SEQ ID NO: 5027 - protein, 408 aa, Campylobacter jejuni RM1221
MQIPSKLKPYYENIAFEQEDSKMIINLGPQHPSAHGNLRLILELDGEQVVKARPCIGYMHRGMEKMAENMIYQEFIPTTDRMDYIAASANNYAYCAAVEKLCGLEIPRRAAVIRMILLELNRITSHLLWLATHALDIGAMSVFLYCFREREYVLDLIEKYCGARLTHSSMRIGGVMLDLPENYLEEMLAFCDKFPNDLKDYEDLLDDNRIWRLRTENVGVVTKEQALNWGCTGVMLRGSGIKYDIRKEEPYLLYNEVEFGVPYATQGDSYARYKVYMQEFRESLKILRQCAMLYKDTSPEILATHPEYVSASKEQILTQNYSLMQHFVLITQGLKPPKGEVYVPTESPKGELGFFIHSDGTGRPYRLKARTPSYWHCAFFEEMLVGTYLADVVAIMGNVNIVLGEIDR

SEQ ID NO: 5028 - protein, 461 aa, Burkholderia thailandensis E264
MVSDQDNDSLKRGLKNRHIQLIALGGAIGTGLFLGIAQTIQMAGPSVLLGYAIAGVVAFFIMRQLGEMVVDEPVAGSFSYFANKYCGHFTGFLSGWNYWVLYVLVSMAELSAVGIYVQYWWPGVPTWISALVFFVAINAVNLASVKSYGETEFWFSIIKVAAIVGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDVAANVLNVVVLTAALSVYNSCVYCNSRMLYGLAQQGNAPRALARVSRRGIPIAALGVSAFATALCVVINYFMPGKAFELLMGLVVSAIIINWAMISVIHLRFRQAKRASGETTRFKSLGYPLTNYLCLVFMAAILVVMFRTPDLRLSVYLIPVWLVVLALGYRFRQRGAGYALGEGVSAR

SEQ ID NO: 5029 - protein, 150 aa, Crataegus monogyna
AVCNSSTTPCKDPADKLFTVHGLWPSNWNGSHPQNCTNKTMNSLTIGNLTAQLETIWPNVLNRNDHLGFWNRQWNKHGTCGAPTINDSLQYFRTVINMYITQKQNVSQILAKANIKPEGKNRTLVDIVTAIRSATNNKAPKLKCQKKAST

SEQ ID NO: 5030 - protein, 91 aa, Malus sieversii
NSNPTPCKDPPEKLFTVHGLWPSNSNGPDPVNCKPKTKIDASLKPQLEIIWPNVFNRADNESFWNKQWDKHGTCGSPTIKDKNHYFQTVIK

SEQ ID NO: 5031 - protein, 963 aa, Pseudoalteromonas tunicata D2
MSHAKSLDQLEQKQDFIRRHIGPDAAQTAAMLAELNVSSVEELISQTVPADIRLKQGLTVGESRTEVEALSYLKSVVSKNKLYKSYIGQGYHPTLVPNVILRNVLENPGWYTAYTPYQPEIAQGRLESLLNFQTLSIDLTGLDLASASLLDEATAAAEAMALAKRVAKAKKANAFFVADDVHTQTIDVIKTRAGQFGFDVVVAPAADVANHDIFGALFQYPSTTGEVVDIPALIATVQDKKAIACVAADIMSLILLKSPGSLGADVVLGSAQRFGVPMGYGGPHAAFFATRDEYKRSLPGRIIGISKDRLGNDALRMAMQTREQHIRREKANSNICTAQVLLANMAAFYAVYHGPQGLKVIAQRIHRFADILAAGLQAKGVSLKHSTWFDTLTVVAANKDEVVARALAAEINFATNHAGEYSISVNEETTRADIATLFDVILGAGHGLDVAALDAQITANGSDSIPAALVRDDAILTHPNFNSYHSETEMLRYIKRLENKDLSLNHSMISLGSCTMKLNATAEMIPVTWPEIANLHPFCPLDQAAGYQIMINELHDWLVNITGYDAVSMQPNSGAQGEYAGLIAIRKYHESRGDFHRNVCLIPSSAHGTNPATAQMASMKVVVVNCDKNGNVDMADLKAKAEEVSENLSCIMVTYPSTHGVYEATIRELCDVIHQHGGQVYMDGANMNAQVGVTSPGFIGSDVSHLNLHKTFCIPHGGGGPGVGPIGVKSHLAPFMPNHSVINVPGTTAGNGAVSAAPYGSAAILPISWAYITMMGSEGLKQATEMAIVNANYLTEKLSKHFPILYRGQNSRVAHECIVDLRPLKEATGITEMDVAKRLMDYGFHAPTMSFPVAGTLMIEPTESESKVEIDRFIEAMVSIKGEIDKVASGEWTVENNPLVFAPHTQADVLGNEWDRAYDRFYAAFPVPAVAKNKFWPTVTRIDDVYGDRNLVCACPPIDSYTE

SEQ ID NO: 5032 - protein, 150 aa, Crataegus monogyna
AVCNSNPTPCNDPPDKLFTVHGLWPSNKNGPDPKKCKNIQMNSQKIGNMTAQLEIIWPNVLNRTDHVGFWEREWLKHGTCGHPTIKGDMHYLKTVIKMYITQKQNVSAILSKAMIQPSGRNRSLVDIENAIRSSTNNMKPKFKCQKNTRT

SEQ ID NO: 5033 - protein, 594 aa, Oryza sativa (japonica cultivar-group)
MDRDEEMGHGDRSLLFIGDEDDDLEADRDGGSTPSSDPGSFSDRSDPPSVDDIDEDDDDVVGDGRRAPRDDDDDQRGTWPQSFRQSIDMMSAVPSPAMSSIITAASPNLGRLAAVGSSLLKRATSSAVGQEGSSLPLSRPLLPPSSLSQLSTASGPPVRDSADSLPPRARPPPPPLQGESVVPPPLPRPSSACLRSNYIDLPPPSTRCGQKQAILNGLNVLCGVGILTTSYGIKQGGWLSLILLPLLGCCSCYTGLLLKKCIDSSPSIDTYPDIGQAAFGIYGRIFVSVVLYLELYACGVEYITLLGDSLSSVFPSADLAFGGIYLNAHNLFAITMALAILPSVWLKNLRLLSYLSAGGVIATTTVIVCLFWVGIGEGVGFHPGGTALNLTHFPVALGLYGYCYSGHSVFPNIYSSMEERPKFTFVLLFCFIVVTFVYAGVAVAGFLMFGESTMSQFTLNMPQQFIPSKIAIGMTIINPYTKYALTLTPVALSIEEALPRRMQTYQVGMCVRTALVASTVVVALTFPYFALVMALLGSVFTMLVALILPCACYLSIKKGSTPLWEVVLCITIILLGILCACVGSYTSVSQMISR

SEQ ID NO: 5034 - protein, 469 aa, Pseudomonas aeruginosa PAO1
MSYKSHQLIKDHDVKWVDLRFTDTKGKQQHVTMPARDALDDEFFEAGKMFDGSSIAGWKGIEASDMILMPDDSTAVLDPFTEEPTLILVCDIIEPSTMQGYERDPRNIAKRAEEYLKSTGIGDTVFVGPEPEFFIFDEVKFKSDISGSMFKIFSEQASWNTDADIESGNKGHRPGVKGGYFPVPPVDHDHEIRTAMCNALEEMGLVVEVHHHEVATAGQNEIGVKFNTLVAKADEVQTLKYCVHNVADAYGKTVTFMPKPLYGDNGSGMHVHMSISKDGKNTFAGEGYAGLSETALYFIGGIIKHGKALNGFTNPSTNSYKRLVPGFEAPVMLAYSARNRSASIRIPYVSSPKARRIEARFPDPAANPYLAFAALLMAGLDGIQNKIHPGDAADKNLYDLPPEEAKEIPQVCGSLKEALEELDKGRAFLTKGGVFTDEFIDAYIELKSEEEIKVRTFVHPLEYDLYYSV

SEQ ID NO: 5035 - protein, 150 aa, Crataegus monogyna
  misc_feature (137)..(137): Xaa can be any naturally occurring amino acid
  unsure (1)..(150): unsure at all Xaa locations
AVCNSNPTPCNDPPDKMFTVHGLWPSNKNGPDPEKCKNIQMNSQKIGNMTAQLEIIWPNVLNRTDHVGFWEREWLKHGTCGYPTIRDDMHYLKTVIKMYITQKQNVSAILSKAMIQPNGKNRSLVAIENAIRSGTNXMKPKFKCQKNTRT

SEQ ID NO: 5036 - protein, 150 aa, Crataegus monogyna
AACNSNPTPCNDRTDKLFTVHGLWPSKVKGPDPHDCKTKTNKSQTIDTSLKPQLGIIWPNVFNRADNESFWETQWEKHGTCGSPTIKDKNHYFETVIRMYITEKQNVSHYLSKANINPDGIARKRKDIEIAIRNSTNDKEPKLRCHTKNG

SEQ ID NO: 5037 - protein, 465 aa, Escherichia coli
MSSIIPVIMAGGSGSRLWPLSRELRPKQFLKLDGELTMLQATINRLKNFVTTQPLVICNEDHRFLVAEQLRYLGKLENNIILEPFGRNTAPAIALAAFTALQSSSLKEDPILLVLAADHVIRDEESFKRSVQQAVPYAKSGKLVTFGIVPTHAETGYGYIQRGKELNDAYSVKQFVEKPELETAQQYFNSGEYYWNSGMFLFRASRYLDELALFRPDIYTACGKAIGAIDPDHDFVRIDKDAFNSCPSDSIDYAVMEKTSDAVVVPMDAGWSDVGSWLSLWELSKKDSMGNSFHGDVIQHSSKNNFVFTESCLVSLVGVEKLVVVQTKDAILVADQNKVQDVKNIVEKLKNSCRTEHRIHREVFRPWGKHDLIDDGDVYRVKRISVKPGERLSLQMHHHRAEHWIVVSGIAKVTNGDNIYLLKENESTFIPSGTIHALENPGEIMLELIEVQSGVCLDENDIIRL

SEQ ID NO: 5038 - protein, 341 aa, Mesorhizobium loti MAFF303099
MSAQGLPSVLAFERYDPTDASLDWLRERGVNVIFGNALWEMPFKRFTEDELIAKAHGCIALMGASGTRITRRVMQALPDLRYISKYGIGVDSIDIDAATEHGILVSSTPNDFQIFTVSEHAVALMLAVAKQLGTWTPEFMRRGGWRGLTHGATLRGATVGIVGLGRIGRGVAQRLSGWEARILAYDPFLKEAPPGIELVDFPTLVEQSDFLTLHATPSPDNHHILNAAAFAKMKPSAIVVNTGRGSLIDYTALRAALANGQIAGAALDVFDQEPPKTDDPLFSLPNVLCTPHVAAWTTEGTQAIGWHAAKNLWAMMSGEGHADIVNPQARQRRSAALLGDV

SEQ ID NO: 5039 - protein, 106 aa, Zea mays
  misc_feature (41)..(41): Xaa can be any naturally occurring amino acid
  misc_feature (72)..(72): Xaa can be any naturally occurring amino acid
  unsure (1)..(106): unsure at all Xaa locations
AGDPDELINNAAYIGTHHKAILDADEGTGTIAKRLYTVNVXNLDENRRALRELLFCCPGALQYIDGVISGSXETLYRKTKDGNPFVDVLKEGGVLPGIKVDKVTIE

SEQ ID NO: 5040 - protein, 283 aa, Arabidopsis thaliana
  misc_feature (42)..(42): Xaa can be any naturally occurring amino acid
  unsure (1)..(283): unsure at all Xaa locations
HCFTSASRAFTQKKLADLKSLFVSLASKSQSNDQYVSYPVFXGERIFDMVTQHRKDDKMTFEDLVIAKATYEKGTDDEIAEFIYQTLDVNGNGVLRRSDLESFLVVILKSVFSTESSDAESSDYKEMVDALLDAATFSKSDDGSEKGMSFEDFRSWCPLVPTIRKFLGSLLIPPGPVRPGYQVPDLLYEDSVSSDRLLLKKEYAWHIGGALPHHELVEWKLLYRSSLHGGWRDRTWPDGWTAVTADGKRSAQFEHTLLVTETGVEVLTARLPSSPDVYPWLTK

SEQ ID NO: 5041 - protein, 453 aa, Arabidopsis thaliana
  misc_feature (369)..(369): Xaa can be any naturally occurring amino acid
  unsure (1)..(453): unsure at all Xaa locations
MGTTTTTSAVYIHVIEDVVNKVREEFINNGGPGESVLSELQGIWETKMMQAGVLNGPIERSSAQKPTPGGPLTHDLNVPYEGTEEYETPTAEMLFPPTPLQTPLPTPLPGTADNSSMYNIPTGSSDYPTPGTENGVNIDVKARPSPYMPPPSPWTNPRLDVNVAYVDGRDEPERGNSNQQFTQDLFVPSSGKRKRDDSSGHYQNGGSIPQQDGAGDAIPEANFECDAFRITSIGDRKVPRDFFSSSSKIPQVDGPMPDPYDEMLSTPNIYSYQGPSEEFNEARTPAPNEIQTSTPVAVQNDIIEDDEELLNEDDDDDELDDLESGEDMNTQHLVLAQFDKVTRTKSRWKCSLKDGIMHINDKDILFNKXQQASLTSDLNTSNDASRKVLQIPTERDMSIHGKVYSGWLVVQKEKFFLSKKAYQLSPCFMNSYCLSRNGKLTSQKKKKKGRPRR

SEQ ID NO: 5042 - protein, 363 aa, Photobacterium phosphoreum
MTLSTAQEIIEDIHQGKMVILMDDEDRENEGDLIIASDKVTPEAINFMATYGRGLICLTLNKERCLQLELPMMVKSNTDKFATPFTISIEAASGVTTGISVNDRARTVQAAIAATATAKDIVMPGHIFPLMAQDGGVLARAGHTEAGCDVARLAGLEPSSVIVEILNDDGTMARRPQLEVFAKKHGLKLGTVADLIEYRNKYETMIERISECKLNTEFGEFDMITYRDKINHQIHYALQKGNIEPNSQTLVRVHLQDTFKDILQTGSTRWTLPAAMERISSENGVLVIVTKQEDPEMVISKIQNLALENKETPVVNSQSRQVGLGSQILSDLGIRKMRLLSSSSHLYHSLSGFGLEIVEYVCS

SEQ ID NO: 5043 - protein, 347 aa, Streptococcus suis 89/1591
MKTAIYEKSGKMTVAEIEKPSLQAKDDVIIKVVRACVCGSDLWGYGEDIHHDHGDTNSGHEAIGIVEEVGEDITTLVPGDFVIVPFTHGCGHCDACRAGFDGTCDNHPGYTNWGNNYQSQYIRFHYGNWALVKIPGQPSDYSEGMIKSLLTLADVMPTGYHAARVADVKPGDKVVVIGDGAVGQCAVIAAKMRGASQIVMMSRHTDRQQMALESGATAIVAERGEEGIAKVREILGGGADAALECVGTEASIDQALGVLHNGGRIGFVGVPHYNNHALGSTFAQNIIIGGGSASVTTYDKEILLDAVLKGDINPGRVFTQTYSLDNIDQAYKDMANRKTIKAMITVD

SEQ ID NO: 5044 - protein, 81 aa, Tomato big bud phytoplasma
GEAVGLPAQQMGNSEVGHLNLGAGRVVHQSLTYINRKIKDGSFFKNKCFLKVIQHVKTNKSKLHLLGLVSDGGVHSHLDHF

SEQ ID NO: 5045 - protein, 483 aa, Methylobacterium extorquens
MMEAPLKRSRRTKIVATLGPASDTPEMIEKLFHAGADVFRINMSHLAREKLPERIEVIRTIEREGKRPIGILVDLQGPKLRLGTFVGDAAVLENGQTFVLDSDPTPGDTDRVFLPHPEILSALEPSHGILIDDGKLRLIVTEVSEGRAVTRVEVGGRISNRKGVSLPHTALPVPAMTEKDRGDLEAGLAAGADWIAVSFVQRPEDVAEVKKVAAGRALVMAKIEKPQALTRLDEIIEISDGIMVARGDLGVEMPLEQVPGVQKRITRVARRLGKPVVVATQMLESMITSPVPTRAEVSDVATAVYEGADAVMLSAESAAGDFPVEAIGTMNRIAEQVERDALYWSILMAQRSEPEPTASDAIAAAAHQIVEALSLRSIMAWTHSGSTVLRLARARPNASVIALTPKRETARRLTMAWGVHPIVTKDASDVDDMAFRAAKFAVRERFAEIGDRVIIVAGVPFGIPGATNMVRIAFVTREHAERA

SEQ ID NO: 5046 - protein, 371 aa, Malus x domestica
MGKGGMSDGDHADRCYGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNALVVGAGPIGLVTLLAARAFGAPRIVIADVNDERLLIAKSLGADEVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 5047 - protein, 434 aa, Lactobacillus acidophilus NCFM
MKRQISFGQALATVVGSVIGAGVFFKIGTITAQTGSSSMTLLVWVLAGIISIASGLTISEIAASLKINGAIKYLDYTYGRVWGFLFGWAQMIVYFPAQIGALSSIFGVQFVSLFGIEAKYSNLIAVILVLFLLSINLIGTKFSSKMQSVITILKIIPIILIIVLGLFNQNKVSAPIFPVTVGSSKDLIGSLSQGLLSALFAFEGWIVVTNLANEVKNPENDLSRAIISGLSIVTLIYVLINYTFLTVLPINQLVNNDNAAFEASMKLFGQFGGKLITIGILISVYGAANAFMLTGMRTPYILAQDRLLPFSNKIGKANIHTGVPVTGALIVDAIAIIMIILGNFTVLTDMLVFVMWTFNTMLSIAVVILRKREPELRRPFKVPWYPIIPIISVLGGLFIVISTIINQFLLSLIGIGLTLIGLPIYYHMQKKNQN

SEQ ID NO: 5048 - protein, 339 aa, Dechloromonas aromatica RCB
MPIRVAINGFGRIGRMAFRAIAKEAEFADIAVVAINDLLEPDYLAYMLKYDSVHGNFAGDVAVDRNDLLVNGRRIRLSAERHPEQLAWGEVKADVVIEATGHFLTHDGCLKHVHAGARKVVQSAPAKDSTPMFVYGVNHETYAGEDIVSAASCTTNGLAPVAKVLHDKFGIRRGLMSTVHAATATQKTVDGPSGKDWRGGRGILENIIPSSTGAAQAVGKVIPALNKKLTGMAFRVPTSDVSVVDLTVELEKPASYADICAAMKAAAESGPLKGVLGYTGDSVVSTDFRGCRLPSIFDAGAGIALDPTFVKVVAWYDNEYGYTCNLLRLVRHISEAPTK

SEQ ID NO: 5049 - protein, 619 aa, Exophiala dermatitidis
MFNATQHRGNPNMGPAPPGQPNHRLNEIMDSLRAEFENQSRASEQVENQVAQQIQEMELIRNKVYQLEQNQLKMKQEYEAEIRMLRHELELRGGPQVQSHLTGPPQHGGPAQAPPSLGHGQGGLFSGIMANQGQGGPGLAPPPEQPPQQQQHPLQPPPAAGQPQGPPQPPNSFPGYQQGPTLNGYAPQPQPPTNSPGLGKNRTMAARGGPGPATPQQHPNQPQPMPYQNDRGRHPRIPRPVPPGGDMQHGHRHQMPGLPNVGNVLADLNPDDLPEHLKRTGPNGEWHAVFNPNVPRTLDIQLLHNLVHESVVCCVRFSNDGKYVATGCNRSAQIFDARDGRKVCELLDESVQDKDGDLYIRSVCFSPDGKLLATGAEDKRIRVWDIENKRIRTTFDGHEQDIYSLDFSRTGRLIASGSGDKTVRLWDIESNQQVMVLSIEDGVTTVAMSPDGRFVAAGSLDKSVRVWDCSTGYLIERLEGPQGHKDSVYSVAFSPSGRELVSGSLDKTIKMWELTPQRNLIPSTAKDGKCIRTFEGHKDYVLSVCLTPGGEWVMSGSKDRGVQFWDPTTGNAQMMLQGHKNSVISVAPCPTGQLFATGSGDMKARIWQYTTWRGAHQGI

SEQ ID NO: 5050 - protein, 140 aa, Crataegus monogyna
AACKFHHTPCKDPPDKLFTVHGLWPSNFNGPDPENCKVKPTASQTIDTSLKPQLEIIWPNVFNRADHEGFWQRQWDKHGTCGSPTIIDKNHYFETVIRMYITEKQNVSYILSKANINPDGKGRTRKDIQIAIRNSTNDKE

SEQ ID NO: 5051 - protein, 217 aa, Triticum aestivum
  misc_feature (86)..(86): Xaa can be any naturally occurring amino acid
  misc_feature (94)..(94): Xaa can be any naturally occurring amino acid
  misc_feature (100)..(100): Xaa can be any naturally occurring amino acid
  misc_feature (118)..(118): Xaa can be any naturally occurring amino acid
  misc_feature (125)..(125): Xaa can be any naturally occurring amino acid
  misc_feature (128)..(129): Xaa can be any naturally occurring amino acid
  misc_feature (152)..(152): Xaa can be any naturally occurring amino acid
  misc_feature (164)..(164): Xaa can be any naturally occurring amino acid
  unsure (1)..(217): unsure at all Xaa locations
MDAMAALARTGPSLAAAGHRSSATFRPSASLSSFASASSRNRGRVGLSTAGCNRWATRVARATPNRIVASSEVEQTYIMIKPDGVXRGLGGEIXIPRFEXKGLFGGRGLKLFQVAQKXWAQRNNXKGXXRGKNPFFPNLIDYITSGPVVCMXRKLIGATNPLQXEPGTIRGDLAVQTGRNVVHGSDSPDNGKREIGLWFKEGELAQWESVQTPWLIE

SEQ ID NO: 5052 - protein, 217 aa, Wolbachia endosymbiont of Drosophila melanogaster
MVQATYASMSLPGISSVEDVLEDARSGKLFILVDDESRENEGDLVVLAEKVKPEHMAFMVRYGTGIVFLAMTKLHMSKLNLEFMRKSNVDEKLTPHTAFTTSIDARYGITTGVSAHDRTHTILTAIDEKSTKDDIITPGHVFPIIANEGGVLARNGHTEASVEIAKLVGLNHAAVGCELVNDDCSMMRLPQLLKFAEQHKIKLTTIDKLISYVKKLN

SEQ ID NO: 5053 - protein, 139 aa, Crataegus monogyna
AVCNSKPTPCKDPTDKLFTVHGLWPSNFNGPHPENCTNTTVNLQRIQNIHAQLKIIWPNVLDRTNHVGFWNKQWIKHGSCGNPPIMNDTHYFQTVINMYVTQKQNVSEILSRAKIEPLGIQRPLVHIEKAIRNSINKKK

SEQ ID NO: 5054 - protein, 391 aa, Polaromonas sp. JS666
MTTILERTPKLETKLPAVGTTIFTVMSTLAAEKGAVNLGQGFPDFECDPQLVNAVTDAMTKGLNQYPPMTGVPVLREAISAKVAKLYGHRYNANTEITITAGATQAIITVILAVVHPGDEVIVLEPCYDSYVPNIELAGGKVVRVPLTPGTFRPDFDKIAAAITPQTRAIIINSPHNPSATVWTQADMLKLQDILAPTDVLLISDEVYEHMVFDAAKGCMHQSASLFPGLAARAFIVSSFGKTYHVTGWKVGYVAAPAALTAEFRKVHQFNVFTVNTPVQYGLAAYMADPKPYLDLPAFYERKRDLFRAGLAKTRFKLLPSEGTYFQCVDISEVSDLNEADFCQWLTTEIGVAAIPLSAFYGNGFDQRVVRFCFAKKDETLHSALGRLAKL

SEQ ID NO: 5055 - protein, 149 aa, Crataegus monogyna
AVCNSNPPPCKDPPDKLFTVHGLWPSNWNGTDPDYCKKTTFDAKRITNLHAELDIIWPNVYDRTDNAGFWGRQWEKHGICGSPTIQDDVNYFETVVNMYITEKQNVSEILSKGTIEPEGKQRAREDILKAIRKGTKGKRPKLKCKKNNR

SEQ ID NO: 5056 - protein, 459 aa, Zea mays
  misc_feature (138)..(138): Xaa can be any naturally occurring amino acid
  unsure (1)..(459): unsure at all Xaa locations
ARRNVANAFCGRSRDPVVDEHQRTASSSPEHPLSRVRGRSMLGDKQYGGAVAVSRSDGASTSNTHRARRSTNITPEISDDIVRAVRAMSESMRQNRLSREQKDGSLGSSNDSMKHEPPGDSHDDEASTRRPSALEGLXRQFNTQKAVSLPSPPNRSRILGLRSPSDYTQPHLMATCNEVVQSSPFLNQPLLPYDEWRIEFSEITVGIRVGAGVFGEVFRGLWNGTDVAIIGCLEQDLTTENMNDLCLEISILSRLPHPNVILFLGACMKPPHLSLVTEYMEVGSLYSLIHSKTQKTKLHWKRRLKMLRDICRGLMCMHRLKIVHRDLKSANCLVNKYWTVKICDFGLSRVMSNSAMNDNSSAGTPEWMAPELIRNEPFTEKCDIFSFGVIMWELCTLCRPWEGIPPVQIVYSVANDGARLEIPDGPLGSLIADCWAEPERRPCCQEILTRLLDCEYTLC

SEQ ID NO: 5057 - protein, 614 aa, Staphylococcus epidermidis ATCC 12228
MEFLSLVIVVVAAFMTPIIVHRFNINFLPVVVAEILMGIVIGHSFLNLVERDAFLNILSTLGFIFLMFLSGLEIDFNAFKKDSRPRQGEDKHEKDVPGHLKLALTVFAFIMMISVVLAFAFKWLGLVNDVLLMVIIISTISLGVVVPTLKEMNIMRTTIGQFILLVAVLADLFTMILLTVYGAIYGEGGSTIWLTGILVVFTVVFYVIGVLFKRMSFLQKLMDGTTQIGIRAVFALIILLVALAEGVGAEYILGAFLAGVVVSLLKPNEEMVEKLDSFGYGFFIPIFFIMVGVDLDIPSLIKEPSLLLIIPVLIFSFIISKLIPVFYIRRWFDTKTTIASAFLLTSTLSLVIAAAKIAEKLKAISPETSGILILSAVITCVFVPVIFKKMFPIPNEVGRRIEVSMIGKNQLTIPIAQNLTSQLYDISLYYRKDLSDSRKLSDDITMIEIADYEEDLLERLGLFERDIVVCSTNDDHINKSVALMAKKHGVKRVICRLESTNEDPTLKHQGIEVFSNYLSNKILLKSLIETPNMLNLLSNVETSLYEIQMLNYQYENIQLRNFPFGGDIIFVRIIRDNDSIVPHGDTQLRYKDRLIVTGTKEYVDELKQELEFYY

SEQ ID NO: 5058 - protein, 146 aa, Crataegus monogyna
AVCNFNPTPCKDPPDKLFTAHGLWPSNSNGNDPEYCKAPPYHTIKILEPQLVIIWPNVLNRNDHEGFWRRQWDKHGSCASSPIQNQKHYFDTVIKMYTTQKQNVSEILSKANIKPGRKNRTLVDIENAIRNVINNMTPKFKCQKNT

SEQ ID NO: 5059 - protein, 139 aa, Crataegus monogyna
AVCNSYRIPCKDPPDKLFTVHGLWPSNWNGYDPIYCKQTNLDANKIAYLQAQLDIIWPNVYNRSDNVGFWSRQWEKHGICGSTTIHDDVNYFETVINMYIAQKQNVSEILSKAKIEPEGKNRTRVEIIKAIRNGTNGKR

SEQ ID NO: 5060 - protein, 515 aa, Pseudomonas aeruginosa PAO1
MTATPKPLVLIILDGFGHSESPDYNAIYAAKKPVWDRLLATQPHGLISGSGMDVGLPDGQMGNSEVGHMNLGAGRVVYQDFTRVTKAIRDGEFFENPVIAGAVDKAVAADKAVHILGLLSPGGVHSHEDHLVAMAQMAARRGAGKIYLHAFLDGRDTPPKSAQPSLERLDATFAGLGKGRIASIIGRYFAMDRDNRWDRVQAAYELIVDGKAEFTADSSVAALEAAYARGESDEFVKATAVVPAGAEAVRVEDGDAVIFMNFRADRARELSRAFVEPAFNEFPRERAPQLAGFVMLTQYAASIPAPCAFPPEPLTNVLGEYLAKHGKTQLRIAETEKYAHVTFFFSGGREEPYEGEERILIPSPKVATYDLQPEMSAPEVTDRIVEAIEQQRYDVIVVNYANGDMVGHTGVFEAAVKAVECLDTCMGRIVEALDKVGGEALITADHGNVEQMEDESTGQAHTAHTCEPVPFVYVGKRKLSIREGGVLADVAPTMLTLMGLEQPAEMTGRSIVTLG

SEQ ID NO: 5061 - protein, 230 aa, Zea mays
VRAHSCALPLRLRLCTINTPCVRCVCLGRGRTDSQRRRDLPAVSLSLAILLAMLRRSRHGGVRLGRNLLGLWRRALCGRRRRRGGYCRLQQQQQPTCAGSGCTPGRGATARKLAPVLRWGRSLARRLRLGWRAAGGGHRMLPDGDGEPAVSTPKGQVAVYVGGEGEASQSLRYVVPVVYFNHPTFGELLREAEEEFGFQHPGVISIPCPAARFERAAALAAAAKKGFGRW

SEQ ID NO: 5062 - protein, 461 aa, Bacillus subtilis subsp. subtilis str. 168
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLSAMGIAWVFMVFSVICLLSFFFAFYMVPETKGKSLEEIEASLKKRFKKKKSTQNQVLNERTL

SEQ ID NO: 5063 - protein, 714 aa, Arabidopsis thaliana
MDDGTPKKLNILPDPFSAPSPTAESSQHDTPSSSQPKDDSSLRPYSQSRTRRNLKRAATMLNLFTLRRLPWVSDGQEKVELSAAELESLRSELSDLEEREAYLKAQLEHVDEVLRSARLSALPGEPPPIDDTEVDDWLPRFVVLQGPCLFFYLLSTDLSPQDSTLLADIVEIGSVPSYTREFDETHYCFYILTRQGLRFECSSTSKTQVDSWLSVLRLDCKSEPEERFTFLRSLFAHHSSQSSRIVSEKMSSQICRSASRAARSLLSSAKNARFFSEGRAIGAASVVHATGKVPQYASNFGKSGSGFVSNSWITGLLALPAAEPYYIRLAFFFIISVIAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTKRYFSFDLSLRSSSSSLSLIVFSCKMETGTPLIAETIALTEKKVAMALDDIIKLAKRKTNVNKGKKPRREKNKNQNFNGAARNNTSNVRHHMNSLSAVRQGAVGKRRSRFQGIQFPVTTNIARKASTAAPLDFRGRAFNGGRMTSANQSRLIAPPVQNISVQARVNAKRHEVDQKVEHRGGKRKTLDSRFASMKEQRMTINNYGVTVQVPRLPPWVRARRFSQ

SEQ ID NO: 5064 - protein, 334 aa, Xanthomonas campestris pv. campestris str. ATCC 33913
MSIEQLAETAQAMVAPGKGIIAIDESTSTIAKRFSGVGIENTEENRRAYRELLLTTPKLSDYISGAILFDETIRQKTKDGVPFAKYMADHGIIPGIKVDKGAQPLAGMPGELVTEGLDGLRARLEEYYTLGARFAKWRAVINIGEDIPSGTCIEANAHALARYAALCQEQGLVPMVEPEVIMDGDHDIETCYEVTEATLRSLFGALYEQNVVLEGTILKASMVISGKGCEEQASVEEVAESTVMCLKSTVPAILPGIVFLSGGQTDEQSTAHLNEMHQLGNLPWPLSFSYGRAMQQAALKLWSKDMTGNYAKAQQIIYERAKENGLAALGKWKG

SEQ ID NO: 5065 - protein, 508 aa, Xanthomonas campestris pv. campestris str. ATCC 33913
MPSSVRDACVKFRGFYREAIMKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 5066 - protein, 357 aa, Dechloromonas aromatica RCB
MQFGRTTLSKFVIENTRASHGELGALLIDVAAAVKTISAMVAKGALAGHHGALDSTNVQGEVQKKLDVLTNDAILRHCEWGGQLAGMASEEMDDPYPIPAEYPRGRYLLVFDPLDGSSNSDVNVSVGTIFSIFSRRAAGDAELGDYLRPGSEQVAAGYAIYGPSTMMVLTLGNGTHGFTLDRESGNFILTHANIRVPEDTREFAINTSNERFWEPPVQRYVSECKAGKSGVRGEDFNTRWIASMVAEVHRILIRGGIFMYPKDSKDPSKPGRLRLLYEANPMAMLIEQAGGAASTGRQRILDVVPDSLHQRAPVILGSKNEVERLARYHHEYDTGADRPFVSPLFSERSLFRDESRA

SEQ ID NO: 5067 - protein, 520 aa, Oryza sativa
MHLIISSIHTYTIMALSLTPSLQDLVSSLMILLVLLYISYWRSKYQSLFPVDWPIVGLLPTLVANLHRLHDKITEYLAASGHSFTGNGPAASNMRLFVTCDPDNVRHIFTTNHDNYPKGHEFAEIFDIMAGAFFTMDGDLYRRQRAKTHSILSDPRMVASMASSCVDKVRDGLLPLLTSMASTRTPFELQDLATRLMFDVTAMTVFGVDPGRLSPDMPSMHVSAAMDTIMEVGLFRHTVPPSCWKAMRRLKIGPERKLAAAHAALHVFVSEMMEKARKQEAAPSSMSMDVLSSYINDPDYVGLLHSILITYMVAGRDTVGTTLPWFFYNLAMNPRVVSGIREELAHNIATSTCNGDGVPVMFSPEDTKSLVYLHAALFETLRLYPPGWIERKTVVADDVMPSGHEVRAGDAVLISIYSMGRMESLWGEDCRVYRPERWLYDSRGGRKMRHVPSHKFLSFNSGPRMCPGKNIAVMQMKIIAAAVVWNFDLEVVEGQAVVPKLSCLLQMKNGVMVKVKKRAV

SEQ ID NO: 5068 - protein, 295 aa, Enterococcus faecalis
MTDYKEIATPSRTKEILKKHGFSFKKSLGQNFLTEPNILRKIVETAGINQQTNVVEVGPGIGALTEQLAMNAAQVVAFEIDDRLIPVLADTLSRYDNVTVVHQDVLKADLVETTNQVFQEKYPIKVVANLPYYITTPIMMHFLESSLDVAEMVVMMQKEVADRIAAKPGTKAYGSLSIAVQYFMEASVAFIVPKTVFVPQPNVDSAIIKLTRRATPAVTVTNEKEFFKLTKASFQLRRKTLWNNLTHFYGKDEQTVAWLKESLAEAEIDPSRRGETLSLEEFARLSNALEKNKPV

SEQ ID NO: 5069 - protein, 472 aa, Mycobacterium intracellulare
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKKLAEDAAVGDRVLVDDGKVCLVVDGIEGDDVICTVVEGGPVSNNKGISLPGMNVSAPALSEKDIEDLTFALDLGVDLVALSFVRSPADVELVHEVMDRVGRRVPVIAKLEKPEAVDNLETIVLAFDAIMVARGDLGVELPLEEVPLVQKRAIQMARENAKPVIVATQMLDSMIENSRPTRAEASDVANAVLDGADAVMLSGETSVGKYPMAAVRTMSRIICAVEDNSTAAPPLTHVPRTKRGVISYAARDIGERLDAKALVAFTQSGDTVKRLARLHTPLPLLAFTAWPEVRSQLAMTWGTETFIVPMMTSTGGMIRQVDKSLLELGRYKRGDLVVIVAGAPPGTVGSTNLIHVHRIGEDDV

SEQ ID NO: 5070 - protein, 271 aa, Zymomonas mobilis
MSHIHFIGSGQMSEAMIRAIIKHKTASASDITAYDIRPEREKELHDNYGITTFAKPKKNIETLQKADIVVIGVRPQDDLKAVTADIAQNAKEKALIVSIVAGVTLAQFEDLLGKERAIARIIPNTLTDTGLGYSGVVINNQADKALTEKFVSGFGKCLFLEESLIDIFTGFGVCGPNYVYYFIEALVDAGVLAGLPRDIAWETTMENLVGSVKMLEISGKHPRQLLDINNSPAGVGMNSLFALNQSDFTAGLQNSVLAAVKRTTELGQKKD

SEQ ID NO: 5071 - protein, 276 aa, Arabidopsis thaliana
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVDPNLDLVKGRGGALLREKMVEAVADKFIVVADDTKLVTGLGGSGLAMPVEVVQFCWNFNLIRLQELFKEFGCESKLRVDGDGKPYVTDNSNYIIDLYFKTPLKDGFAAAKEIGKFQGVVEHGLFLGMATSVIIAGKNGVEVMTK

SEQ ID NO: 5072 - protein, 405 aa, Enterococcus faecalis V583
MRNFKKSDKLNNVSYDVRGPVLEEAERMQEEGIRILKLNTGNPAPFGFDAPNEIVRDMIVNVRDSEGYSDSKGIFSARKAIEQYCQLKKFPNVTINDIYTGNGVSELITMCMQGLLNNGDEVLVPMPDYPLWTASVSLAGGTPVHYICDEQAEWYPDIDDIKSKITSNTKAIVIINPNNPTGALYPKELLLEIVEVARQNDLIIYSDEIYDRLVMDGLVHVPIATLAPDLFVVTLNGLSKSHRVAGFRCGWMVLSGDKSRVKGYIEGLNMLASMRLCSNVLSQQIIQTALGGYQSVDGLLLPGGRIYEQREFIYNAINDIPGLSAVKPKAAFYIFPKIDTAKFDIYDDEKFVLDFLHKHHILLVHGGGFNWQQPDHFRIVYLPKMEDLKTTADKMREFLSTYKQK

SEQ ID NO: 5073 - protein, 297 aa, Candida albicans SC5314
MGTQKKEKQRRVRENDTRDGNLRVKGENFYRDAKKVKHLNMYKQGRAIRNKKGEIIKAADLQSTDIPNARVDPNRKWFGNTRVIAQDALTHFREVMGEKSKDSYQVLLKRNKLPMSLLDEKDTTESPTAKIVETESYSSTFGPKQQRKKPRVAASSLEDLMNAAEADSTQFQEKQELDSTLGLMGGSILDKDDFTQEAKEAIFHKGQSKRIWNELYKVIDSSDVVIHVLDARDPIGTRCESVEKYIKDECPHKHLIYVLNKCDLVPTWVAVCFENVNFWTNVFPFFFLLLTFAIPGN

SEQ ID NO: 5074 - protein, 175 aa, Candida albicans SC5314
MKRIFLIDCPGIVPPSSKDTESDILFRGVVRVEHVSNPEQYIPDMLQKCERKHLERTYEIKGWSKFEEDESLLERASTEFIELIARKQGRLLKGGEPDESGVSKQILNDFNRGKIPWFVPPPKDEEKDEDKTGEDKKIGYKRKRQEREAAEKELQEKEENQDEDDKEVKKAKLEE

SEQ ID NO: 5075 - protein, 471 aa, Pseudomonas fluorescens Pf-5
MTPDKKVKILATLGPAIDGIEDIRELVQAGVNIFRLNFSHGAHADHAQRYEWIRQVERELNYPLGILMDLQGPKLRVGTFAEGKVQLVRGQALRLDLDATPGNAQRVSLPHPEIIAALEPGMDLLLDDGKLRLRVIAKQADAIETTVLNGGELSDRKGVNVPQAVLDLSPLTAKDRRDLSFGLELGVDWVALSFVQRPEDIREARALIGDKAYLMAKIEKPSAVTQLREIAELSDAIMVARGDLGVEVPAESVPQIQKNIISTCRQLGKPVVVATQMLESMRFSPAPTRAEVTDVANAVAEGADAVMLSAETASGEYPLEAVQMMSKIIRQVETGPDYQAQLDVSRPQAEATVSDAISCAIRRVCSILPVAVLVNYSESGSSTLRAARERPSVPILNLTPNLATARRLTVAWGVHSVVNDRLRQVDEVCATALEIAQAQGLAKRGDTVVITTGVPFGQPGTTNSLRVETLL

SEQ ID NO: 5076 - protein, 138 aa, Crataegus monogyna
  misc_feature (11)..(11): Xaa can be any naturally occurring amino acid
  unsure (1)..(138): unsure at all Xaa locations
AVCHFNPTPCXDPPDKLFTVHGLWPSNSTGNDPIYCKNTTLNSTKIANLTAQLEIIWPNVLDRTDHITFWNKQWIKHGSCGHPAIQNDMHYLQTVIKMYITQKQNVSEILSKAKIEPVGRFWTQKEIEKAIRKGPTIR

SEQ ID NO: 5077 - protein, 146 aa, Crataegus monogyna
AVCNSNPTPCKDPPDKLFTVHGLWPSDSNRNDPKYCQAPPYQTMKILEPQLAIIWPNVLNRNDHEAFWRKQWDKHGSCASAPIQNQTHYFDTVIKMYTTRKQNVSEILSKANIKPGRKSRRLVDIENAIRNVINNMTPKFKCQKNT

SEQ ID NO: 5078 - protein, 149 aa, Crataegus monogyna
AVCNSSRTPCKDPPDKLFTVHGLWPSSMVGPDPSNCPIKNIRKREKLLEPQLEIIWPNVFDRTKNKLFWDKEWMKHGSCGYPTIDNENHYFETVIKMYITKKQNVSRILSKAKIEPDGKKRALLDIENAIRNGADNKKPKLKCQKKGTT

SEQ ID NO: 5079 - protein, 289 aa, Actinobacillus pleuropneumoniae serovar 1 str. 4074
MSNQNSKKHLGHTARKRFGQNFLHDMNVIHNIVSAINPKNGQFLLEIGPGLGALTEPVAEQVDKLTVVELDRDLAERLRHHPFLNHKLTIIEQDALRFNFREYFESLELREGEGVRVFGNLPYNISTPLMFHLFKFHDLIQDMHFMLQKEVVKRLCAAPNSKAYGRLTIMAQYYCQVMPVLEVPPTAFKPAPKVDSAVVRLMPHKVLPHPVKDVYWLNRVTTQAFNQRRKTLRNALSTLFSPEQLEALNIDLNARAENLSIADYARLANWLYDNPPAVDNQEEIIDEDI

SEQ ID NO: 5080 - protein, 444 aa, Bacillus cereus G9241
MARYTREDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQSNEVVCGALGDHLLEHFIEAKEIEWDIFRTQVHQWERDQYMSLY

SEQ ID NO: 5081 - protein, 138 aa, Crataegus monogyna
AVCNSNPTPCNDPPDKMFTVHGLWPSSMVGPDPSNCPIRKFWKREKLLEPQLEIIWPNVFDRTKNKVFWDKEWMKHGTCGYPTIDNENHYFETVIKMYITKKQNVSEILSKAKIEPDGKKRTLLDIENAIRNGADNKK

SEQ ID NO: 5082 - protein, 249 aa, Propionibacterium acnes KPA171202
MTAKLILLRHGESEWNSKNLFTGWVDVDLNEKGEGEARHAADLLKQENLLPDIVHTSLLRRAIHTAYLALDGCDRHWIPVHRSWRLNERHYGALQGLNKAETKEKYGNDQFMAWRRSYDVRPPDLDRDSEFSQFHDPRYADIPASERPVAECLKDVVARMVPYFTSDIAADLKDGKTVLVAAHGNSLRALVKHLDEISDEDIAGLNIPTGIPLFYELDDNLKPVTRGGRYLDPEAAAAGAKAVANQGNK

SEQ ID NO: 5083 - protein, 292 aa, Bradyrhizobium japonicum USDA 110
MVMGPGLRRDDTEFVVTTVANSTLQNITGTILLAGAGKMGGAMLTGWLAGGLDPRRVAVVDPHIAPEISALAAKGVALNPDAKAAGQVETMVVAVKPQMFREAGAKLKPFVSEKTSVVSIMAGTTIASLQEVCGGAVVRAMPNTPAAIGRGITVAVAAKNVSTAQRAVADALLRATGSVEWVEDESLMDAVTAVSGSGPAYVFLLAEELARAGVEAGLPEALATKLARETVAGSGELLHQSELPSGTLRQNVTSPGGTTAAALGVLMGEPGLRDLMIRAIAAATQRSKELAK

SEQ ID NO: 5084 - protein, 462 aa, Mesembryanthemum crystallinum
MGEQELLLQQQIKEDRNVSRETEMKHPALQGKYELGRVLGQGTFARVYHARNLVTGNSLAIKVVAKDKVIKVGMMEQMKREISVMKRVKHPNIVQLHEVMASKSKIYLAMDLVRGGELFSKVSKGGKLDEDVARSYFKQLISAVDFCHSRGVYHRDLKPENLLLDEHGNLKITDFGLSASFENEDHHQTLLRTSCGTPHYVAPEVISRKGQQGYHGAKSDIWSCGIILFVLLAGFLPFHDDNIIRMYRKVFKGDFTCPSWLSSQARDLITRLLDINPATRITVSEIMQSDWYCMDTSSMTAVTTDEFDLDHNNNNNNNSNYNNIHHHKKEPEMLNAFHIISLSQGFDLSPLFEEKHREERQDMRFATTKSASTVVSRLEEVAAKAGKFIVKKFCGDSVVRLQGQERGRKGKLAIAAEIMSVSPSLLVVEVKKDNGDTLEYNQFCTKQLRPALKDIVWTCPSS

SEQ ID NO: 5085 - protein, 333 aa, Xanthomonas campestris pv. campestris str. ATCC 33913
MAIKVGINGFGRIGRNVLRSAVQNFANDIEIVAINDLLEPDYLAYMLQYDSVHGRFKAEVSVDGNTLIVNGKKIRLTQERDPANLKWDAVGAEVVIESTGLFLTKETAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGILGYTEDKVVATDFRGETCTSVFDADAGIALDSTFVKLVSWYDNEWGYSNKCLEMVRVVAK

SEQ ID NO: 5086 - protein, 482 aa, Propionibacterium acnes KPA171202
MQEGDSVTPHTSTTVDKGDAGYDKALKNRHLQMIAIGGSIGTGLFLGTGGRLAQGGPGLAISYAVCGIFAFLMVRALGEMAIRRPSSGAFVSYAREFMGEKGAYATGWFFFLDWSVTVMADITAVALYLHYWTPLRAIPQWVLALIALGVVFTLNMLSVKMFGEAEFWFAAIKVAAIILFMIAAIWAIVTGARVGNYTAGLHNIAQHGGFFPAGLAPVFALTLGVIFAFGGTEMVGVAAGETKDASKILPKAINSMILRIFVFYVGSIILMALVLPYTAYSSNESPFVTFFTGIGIPYAGDIIQVIVLTAALSSLNAGLYSTGRTLRSLAVAGEAPKAAAKLNRHHVPSGGIAMTAALGLLGVALNAFLPDSAFEIVMNLAGIGIAGTWAMVLLAHTRFVSAVRRGKDNRPEYRMPGAPVTNYISLAFLLIVVLSNVTSESGRWTLALFALVAIAMVAGWYAVRNSIKPDLLDNVVPSDEGM

SEQ ID NO: 5087 - protein, 167 aa, Medicago truncatula
MAKAHIVGVAMDFSPTSKLALRWAVDNLINKNDQIIMINVQPPSADHTRKELFEDTGSPLVPLEELREINFTKQYGIAKDPEVIDILETASKIKGQAKVVAKVYWGDPREKLCNAVEDLHLDSLVIGSRGLGTIKSVLLGSVSKHVVTNASCPVTVVKGMQSSKSRH

SEQ ID NO: 5088 - protein, 344 aa, Magnaporthe grisea 70-15
MADSNNGPETEKVNTNIVTLTRFLTEEQAKHKEATGDFTLLCHALQFSFKAIAYYIRRATLVNLTGLAGSSNTTGDDQKKLDVIGNDLFIEAMRSSGKCALLVSEEEEEIIFFTNGNGSARYAVACDPIDGSSNLDAGVSVGTIFGIHKLAEGSTGSKEDILKPGSELLAAGFTMYGASAQLVLTMKNGGVNGFTLDNAFGEFILTHPDMRMPKSRAIYSVNEGNSLYWEDHVKEYFSSLKHPQEKSGKPYSARYIGSMVADAYRTLLYGGIFAYPADKKSPKGKLRILYECAPMAMVFENAGGQAIDSNMKRMLDVVPEHIHDRSGIFMGSWDEVEKVKAYHK

SEQ ID NO: 5089 - protein, 393 aa, Streptococcus suis 89/1591
MVFSVRTFNNINQIGLKELGNKFQIDGDHAANPDAFIIRSENLHGFDFPENLKAIARAGAGTNNIPIEEATEKGIVVFNTPGANANAVKEAVIASILLSARDYIGATAWANTLSGDDVPKQVEAGKKQFAGTEISGKTLGVIGLGAIGARIANDARRLGMNVLGYDPYVSVETAWTISSHVKRVDDLKEIFTNADYITVHVPLTDKTRGLFNADSFGQMRKGTTLINFARGELVDNADLFEAIEAGVIKNYITDFGTEEVLNKDNIIVFPHVGGSTEEAELNCAIAAGQTIRRFMETGEIINSVNFPNVKQFLDAPYRITLINKNIPNMVATITTAVSELGINIDNIINKSKGDYAYTLLDLDEADKVKIEQLVAKFEATDAIVKVRVIQNKN

SEQ ID NO: 5090 - protein, 376 aa, Oryza sativa (japonica cultivar-group)
MNETLKQNRLQRDHVNEGSPSYVGEDQNNASDCPNNDDTSGGVVATNNGPRNRNGSTQKAMSLPSSPHEYRAQISETINPCDFVSKEKMVLAWNKVLQSSPFLNKPLLPFEEWNIDFSELTIGTRVGIGFFGEVFRGIWNGTDVAIKVFLEQDLTTENMEDFCNEIYILSRLRHPNVILFLGACMVPPHLSMVTEYMEMGSLYYLIHMSGQKKKLSWRRRLKIVRDICRGLMCIHRMKIVHRDLKSANCLVNKHWTVKICDFGLSRVMTDSPMTDNSSAGTPEWMAPELIRNEPFTEKCDIFSLGVIMWELCTLSRPWDGISPVQVVYTVANEGSRLEIPEGPLGKLIADCWAEPQDRPSCQEILTRLLDCEYAVS

SEQ ID NO: 5091 - protein, 267 aa, Oryza sativa
MRIAPGPAAAAAASPGAAGASSGAAAASRQAARPPVKRMDAVKQALLLFVHSKLTMCPDHRFAFASLGDTVSLVLPHALSDPPLRGMTWFTLNLKVKKDFSSDAGSAVEAIQSLDASETRYAMADLTQLFKIAYQEGKRAELQGRLLRVVLIYCRSSTKPQHQWPIKQKNFTLDIIYLHDKPTADNCPQKVYDALVDALEHVSQYEGYILETGQGLARILFRQTCILLSHPLQRCIQDDLDIPKPLAKKNMVTEAAQNEDGMPVSTQ

SEQ ID NO: 5092 - protein, 249 aa, Solibacter usitatus Ellin6076
MRKPVMAGNWKMYKTPAETIAFFEKFRPLVEKSSHCEIVICPPFTNLAAAVDAVRGTSIRVGAQNVGWAKEGAFTGEVSGPMLNAMGVSHVIIGHSERRQYFNETDETVLKRTQAALEFGLTPIVCVGELLADREGGRTEAVLAGQFQKGIAGLTEQQFAKIVIAYEPVWAIGTGKTATPEIAADTHRAIRGQVREKFGKEAADAVRILYGGSVKPDNAKVLMGQPEIDGVLVGGAALDPVSFASIVNF

SEQ ID NO: 5093 - protein, 118 aa, Musa acuminata
IFQGLKMVSVERSFAEKHYADLSAKPFFAGLVEYIISGPVVAMVWAGKNVVVTGRKIIGATNPADSAPGTIRGDLAIEIGRNVIHGSDSIESASKEIALWFPEGVAEWQSNLHPWIYE

SEQ ID NO: 5094 - protein, 301 aa, Zea mays
  misc_feature (222)..(222): Xaa can be any naturally occurring amino acid
  unsure (1)..(301): unsure at all Xaa locations
MPGGEDVRKVSRQDIQLVQNLIERCLQLYMNQKEVVDTLSFQAKIEPSFTELVWQKLEEENRDFFKAYYVRLMLMNQITAFNKLLEQQYEIMTKDHPSGMPSVPPAAPNGSNSNTLNQNMPFLPDTIPSTALQDNSLRNGGSSSIVNGAPSDDQFMYTGKVVHGLPGGMDASSSLLTAHNPAVGQFNGHNGATIKTEFGYSSNSDFGFSNEAVFLEQSVGDXQDSSSYGFLSQIPRNFSFSDLTEDFSQSAEILENYGRSPFIPSDANNFPESTAGEHTEIGNRRLDTISEGIHFEDFGSD

SEQ ID NO: 5095 - protein, 391 aa, Thermobifida fusca YX
MRALTWQGPRDVRVETVPDPTIEEPTDAIIRITSSGLCGSDLHLYEVMAPFMREGDILGHEPMGVVEAVGDAVTTLRPGDRVVVPFNIACGHCFMCVQGLQAQCETTQVRETGMGGRLFGYSSLYGSVPGAQAEYLRVPHADYGPIKVPKGPPDDRFVYLSDVLATAWQAVRYAAVPPGGSLAVLGLGPIGDMCCRVAQHLGAGQVFGVDVVPERLSRAARRGVTTFHFDEDTVDAIRDLTDGRGPDAVIDAVGMEAHGSPITRTAQRLTALLPSKAGAALITTAGVDRLTALHTAITLVRRGGTISLSGVYGGIADPLPMLTLFDKQVQIRMGQANVRRWVDEILPLLTDDDPLGVDSFATHRLPLAEAPYAYAAFQHKDNGMVKTLFHP

SEQ ID NO: 5096 - protein, 157 aa, Glycine max
MQASRARLFKEYKEVQREKAVDPDIQLVCDDSNIFKWTALIKGPSETPFEGGVFQLAFSVPEQYPLQPPQVRFLTKIFHPNVHFKTGEICLDILKNAWSPAWTLQSVCRAIIALMAHPEPDSPLNCDSGNLLRSGDVRGYQSMARMYTRLAAMPKKG

SEQ ID NO: 5097 - protein, 91 aa, Populus suaveolens
MARSFSNAKVISGLISEAINGRGFSAVASQGAAVSKARSGAAVMKKTGEEVTKTTEKISWVPDPRTGFYRPENVAQEIDAAELRAAFLKKH

SEQ ID NO: 5098 - protein, 243 aa, Campylobacter jejuni RM1221
MLYILANGSMATALAYGLKDDYEICIVGRSIEKLQALAKEGFKTLLYKDFNIEGKDVILAFKPYALENIAQMLKGQARILISVLANVDFEKLQTIKAQNYVRIIPNTAAKYKASTTPYILKNSHFENEILDILKTFGSAYKLDNEIQMNAAMAISGCAPAFLALIAESIANAGVYEGLSKELSLNLTRSLFKSSSALLEHEHPAIIKENICSPGGVTIKGIKILEQKGIRGSFFEAINASSAK

SEQ ID NO: 5099 - protein, 334 aa, Schizosaccharomyces pombe
MTLSGKPAALLVGTLKHAHKEWEALGKYAELKTYSDGTREDFLAKCKTEFQNVKAICRTYNSKFYMGIFDKEIIDNLPPSVKFICHLGAGYETVDVAACTARGIQVSHVPKAVDDATADVGIFLMLGALRGFNQGIFELHKNNWNANCKPSHDPEGKTLGILGLGGIGKTMAKRARAFDMKIVYHNRTPLPEEEAEGAEFVSFDDLLAKSDVLSLNLPLNAHTRHIIGKPEFQKMKRGIVIVNTARGAVMDEAALVEALDEGIVYSAGLDVFEEEPKIHPGLLENEKVILLPHLGTNSLETQYKMECAVLMNVKNGIVNDSLPNLVPEQRGDIE

SEQ ID NO: 5100 - protein, 255 aa, Shigella flexneri 2a str. 301
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 5101 - protein, 540 aa, Arabidopsis thaliana
MERKAIPNAHQEETGGKVRFITSNPGLRAPVKMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 5102 - protein, 256 aa, Prochlorococcus marinus str. MIT 9211
MIPKELALLKELGKPITVLTAWDSLSSAIVEAAGADVVLVGDSLAMFVHGHTSTLPVTLEQMLLHAQAVGRGFVNPAEKQPLVVCDLPFLSFQCGEDRAVSAAGTLLKHSCTSAVKIEGAEPEVLKVIERLIRMGIPVMGHLGLTPQSVNNLGYRKQAEDPISQKKIMRQGIQLEEAGCFAIVLEHVPETLALQLKSKLRVPVIGIGAGENCDGQVRVTADLLGLTKKQPPFSKPLIKGREIFVGALKNWVEQQRT

SEQ ID NO: 5103 - protein, 481 aa, Sorghum bicolor
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 5104 - protein, 360 aa, Arabidopsis thaliana
MEKHEEENGLCKAESVDGSLDVWSCQNSDSSSADHLVVMVHGILGSTDDWKFGAEQFVKKMPDKVFVHCSEKNVSALTLDGVDVMGERLAAEVRHIIQRKPNICKISFVAHSLGGLAARYAIGKLYKPANQEDVKDSVADSSQETPKGTICGLEAMNFITVATPHLGSMGNKQVPFLFGFSSIEKVAGLIIHWIFKRTGRHLFLKDEEEGKPPLLRRMVEDTDDCHFISALRAFKRRVAYSNVGHDRILYTASIRRDSELPKWEDSLNEKYPHIVYEELCKACDMEDIPEGENHSDDIEVVNCAEEMIKGLSSVSWEKVDVSFHSSRQRFAAHSVIQVKNEDMHIEGADVIEHIIDHFHA

SEQ ID NO: 5105 - protein, 165 aa, Glycine max
MGLQNQLNDVSSGSIPLLVLAQIATCVNYLRSMLFALLQTLGLCRFHSDQIVDERFLAAVGSGLAGLIMLSDQLTLSSQFFHHHHAGAGGHDHHPCVVCQATFEDGDQVRMLPCRHVFHRRCFDGWLHHYKFNCPLCRSPLFSDERVAVTERRLGQQLISWFSLH

SEQ ID NO: 5106 - protein, 485 aa, Pseudomonas syringae pv. phaseolicola 1448A
MSTLIPCIIAGGSGTRLWPVSREAMPKPFMRLPDGQSLLQKTFLRAVGLPGVDRLLTVTNREVYFRTVDDYRQLNKGNARLDFILEPFGRNTAAAVAAAALHVSQLYGDDAQLLVLPADHLITNVEEFSRAVTAAQKLATEGWMVTFGIVPTAAETGFGYIEKGPALDADACQVARFVEKPDAVTAQGYVDGGLHFWNAGMFCMRADAVLQELRTHAPDVLNAVSSCLASSPRKEGNRELQVELDSESFALTPDISIDYALMERSEKVAVVPCQLGWSDIGSWQAVRELSPVDAQGNYCNGEAVLHDVSNCYIDSPKRLVGAIGLDNLIIIDTPDALLIADGRRSQDVKVIAQELKRQGHDAYRLHRTVTRPWGTYTVLEEGKRFKIKRIVVRPQASLSLQMHHHRSEHWIVVSGIATVTNGEREFMLDTNESTFIKPGFTHRLVNPGVIDLVMIEVQSGEYLGEDDIVRFTDIYGRVPDKTVKS

SEQ ID NO: 5107 - protein, 456 aa, Streptococcus thermophilus CNRZ1066
MVFIKETPIMAITAADIRREVKEKNVTFLRLMFSDILGIMKNVEIPATDEQLDKVLSNKVMFDGSSIEGFVRINESDMYLYPDLDTWTVFPWGDENGSVAGLICDIYTSAGEPFAGDPRGNLKKALRHMEEVGYKSFNLGPEPEFFLLKLDEQGNPTLEVNDKGGYFDLAPTDLADNTRREIVNVLTEMGFEVEASHHEVGVGQHEIDFKYTEVLKACDNIQIFKLVVKTIARKHGLYATFMAKPKYGIAGSGMHCNMSLFTEEGNAFFDPEDPHGMQLSQDAYYFLGGLMKHAYNYTAIINPTVNSYKRLVPGYEAPVYIAWAGSNRSPLIRVPASRGMGTRLELRSVDPMANPYLAMAVLLEAGLDGIINKIEAPAPIETNIYSMSPEERKEAGIIDLPSTLRNALKALETDEVVRQALGNHIYTNFLDAKRLEWASYATFISQWEIDNYLDLY

SEQ ID NO: 5108 - protein, 196 aa, Mycobacterium sp. MCS
MRDDMVVAEISCGRAAVILDGERGALLFFAAEAASAQLLNFAIRYSSGLIHAAMRSDRLDRLRIHDQPVLPSEDRALGFTVSVDAVGTGTGISGQARAQTLRALGSAQTTPEDLVRPGHVLPVRCPHVPRNAQDLVWDRMVRIVERAGCTPVAAACRLVHDSGDVLDDAAAEDFAATFGLALVSAPQRVRVLAAGA

SEQ ID NO: 5109 - protein, 348 aa, Clostridium perfringens ATCC 13124
MEGKMKVAVMNGIGKMDLIERDIPIVKENEVLVKLDYVGICGSDLHYYENGRIGDYIVEPPFVLGHEPGGVVVEVGNKVKHLNIGDRVALEPGKTCGHCEFCKTGRYNLCPDVIFFATPPVDGVFQEYVAHEADLCFKLPENVSTLEGALIEPLAVGFHAAIQGGARIGQTAVVMGAGCIGLVSMMALKAMGVSNVYIVDIMEKRLEKALELGATGIINAKEKNAIEEVMKITNNNGCDLVIETAGTEITTVQAIHMAKKGSNIVLVGYSKSGEMTLPMSLVLDKELTFKTVFRYRHIYNMAIEAVASGKVNLKGIITNEFDLDDVQKAMDYSVNNKADIVKAVIKIR

SEQ ID NO: 5110 - protein, 411 aa, Irpex lacteus
MVASLVVLGSLAALVSAGPLSLYSPALGPMDIFKRVNSGCGTSGAESCSNSDDGTCCFEAPGGLLLQTQFWDTDPSTGPSDSWTIHGLWPDNCDGTFESSCDSSRAYTGIGDLLTAQGASDTLDFMNQYWVDINGQNEQFWEHEWSKHGTCYSTLETSCLPSGSPKGAEAVAFFQQVVTLFKTLPTYQWLAKAGITPDSSKTFTLSEITSALKSAAGVTPALDCDGKNLNQISWYFHLKGSLLDGKFVPIDAPKAGSCASSGLKYPPKSGSSSGGSSGGSTTTTSSGSSSTGNPGSLPSKATLHASTGGLLSAGTWSTQTLATYTISGSSSSFTLKTSKGSCGVVSSGQFECGSGVSATTFSAVTSGSSLLLASGGSTKWSSDGTPSGTTQEAIFTGSGHGTSLTLSIVSA

SEQ ID NO: 5111 - protein, 490 aa, Rhodococcus sp. RHA1
MADRTSSTGSIGSEPGDGSGTGPAGEPHLSRQLANRHIQLIAIGGAIGTGLFMGSGKTISLAGPSVIFVYMIIGFMLFFVMRAMGELLLSNLHYKSFSDFTADLLGPWAGFFTGWTYWFCWIVTGIADIIAISGYVQYWWPDLQLWIPALVAIAALLLLNLPTVRAFGETEFWFALIKIIAIVSLIVVGLVMVFTHFTSPNGSEAGFDNLWNDGGMFPTGAMGFVAGFQIAVFAFVGIELVGTTAAEAKDPEKNLPKAINSIPIRILLFYVVSLIVIISVTPWREVVPGESPFTAMFTLAGLGIAAGVIQFVVLTSAASSANSGIYSTSRMVYGLAQEGDAPGRLGRLSSRKVPANALMFSCAFLLSAIALLFSGDSVIEAFTTVTTISSVLFMFVWTMILASYIVYRKRRPELHEASKFKMPGGVVMCWVVLAFFVFLIWALTQEADTLEALLVTPVWFVVLGIAWAVIRRRAPHRARYAAFKAELEDR

SEQ ID NO: 5112 - protein, 754 aa, Streptococcus agalactiae NEM316
MTRNFTTYVEQQGKVLSELTNEEIYVELLNFVKEEAAAKSKNSSQRKVYYISAEFLIGKLLSNNLINLGIYKDVKKELELVGKSIAEIEDVEPEPSLGNGGLGRLASCFIDSISSLGINGEGVGLNYHCGLFKQVFRNNQQEAEANYWIENNSWLVPTDISYDVPFRDFTLKSRLDRIDVLGYKKDTKNYLNLFDIDGLDYNLIEKGITFDKTEIKKNLTLFLYPDDSDKNGELLRIYQQYFMVSNAAQLLIDEAIERGSNLHDLAEYAYVQINDTHPSMVIPELIRLLTEKHGFEFDEAVSVVRNMVGYTNHTILAEALEKWPLEYLNEVVPHLVTIIKKLDQMIREEQTNPEVQIIDEAGRVHMAHMDIHFSTSVNGVAALHTEILKNSELKVFYDIYPDKFNNKTNGITFRRWLEFANQDLADYLKELIGDSYLTDATQLEKLLTYADSNEVHDKLAAIKFKNKLALKRYLKENKGIELDEYSIIDTQIKRFHEYKRQQMNALYVIHKYLEIKRGHFPSRKLTVIFGGKAAPAYTIAQDIIHLILCLSELINNDPEVNKYLNVHLVENYNVTVAEKLIPATDISEQISLASKEASGTGNMKFMLNGALTLGTMDGANVEIAELAGKENIYTFGKDSDTIINLYETSGYRSKDYYDKDKVIREAVDFIISDDIVSLGNAERLKRLHDELVGKDWFMTLIDLKEYIAVKEQVLADYEDYESWNKKVIHNIAKAGFFSSDRTIEQYNQDIWHSN

SEQ ID NO: 5113 - protein, 127 aa, Oryza sativa
DSIEKLREKLPSLRAEIKDDHKFREIYNFAFAWAREKGQKSLALETALGMWQLLFAERHWPLIDHWCQFLQVRHNKAISRDTWSQLLEFVKTIDPQLSNYDEEGAWPYLIDEFVEYLTENGFVQLRK

SEQ ID NO: 5114 - protein, 255 aa, Dechloromonas aromatica RCB
MKGHVARKRFGQNFLVDQGIIAAIISAVDPKRDETVVEIGPGLGAITEPLMARVDHLHVIEIDRDLIARLKKQHTPERMTVHEGDALAFDFASIGKNLRLVGNLPYNISTPLLFHLAEYVDVVHDMHFMLQKEVVERMVAEPGNADFGRMSVMLQYRFYLEWLIDVPPESFDPPPKVQSAVVRLIPKPVSELNAKSQEKLSQVALTAFSQRRKMLRNTMKTLLSDAAFTELGIDPTCRPEDVSVEDYVRIANYLS

SEQ ID NO: 5115 - protein, 121 aa, Physalis longifolia
DNISTTLNKCIPVTYAKNMTDDKKNKLYIRWPDLLVGEANCKKDQKFWKNEYEKHGSCCEKSYNQEQYFDLAMGLKDKFDLSNSLGRYGIIPGKSYPVQTINNTVKAITQGFPRLACTDLM

SEQ ID NO: 5116 - protein, 171 aa, Streptococcus mutans
ANISEQISLASKEASGTSNMKFMMTGAVTLATLDGANIEIKDEVGDENIVIFGMTKDDVYRHYENHDYYSRGVYESNPVIKRVVDTFINGTIPNSQSEGTEIYEALITHNDEYFLLEDFIAYVQAQEKIDALYRDKETWSRMSLCNIANSDKFTSDDTITQYAKEIWHLEI

SEQ ID NO: 5117 - protein, 339 aa, Prochlorococcus marinus str. MIT 9313
MHPSMVIPRFSDRPLDVVGIGNAIVDVLVQADDAFLDAHSLSKGNMALVDEAQAEALYSISGPGLETSGGSAANTLVGLAQLGGKAGFIGRVKNDQLGSIFSHDIRSVGARFETPPASDGPSTARCLILVTPDAQRTMCTYLGASVQLDPEDLDLSMVRQAKVLYLEGYLWDSPAAKKAFIAAAQVCRDSGGQVALSLSDGFCVDRHRDSFLELVDSHVDLLFANDSEITSLYKSVSFEAALEEVKGRCKVAALTRSEHGSVVLAGDQRWDIPAYKLGNVVDTTGAGDLYAGGFLHGYTQGTTLETCGQIGSICAGQVITQLGPRSQVSLPELVAKHLN

SEQ ID NO: 5118 - protein, 350 aa, Mesorhizobium sp. ICMP 15054
DPKGKLQHVTMDVIEVEEDMFADGVMFDGSSIAGWKAINESDMVLMPDADTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKNGKPTFAGNEYAGLSESCLFYIGGIIKHAKAINAFTNPLTNSYKRLVPGYEAPVLLAYSARNRSASCRIPFGSSPKSKRVEVRFPDPGANPYLAFAA

SEQ ID NO: 5119 - protein, 1142 aa, Sorghum bicolor
MDMERGAGSEQGSPDSEMGDGDNDSVGYGAEMEVDAGSGSAGASAPASSASASASVSASAYAARAGAYDGVDPFEGMEFDDEEDAWTFYNVYAHRVGFSTRISVMHRSRRDGSVMSRQFVCAKEGFRTYRGKNEVSRADAVDPGDDDGGRGRRTRAVTRVGCKAMIRVKKQDNGRWSVTKLETAHNHPLVPANQAHCLRPHKPLSECGKQRPFGGHRNGGSLLAIEPPPPPLTPPVPHTSIPQVVPQYVSDGIGNGTRVILDYVKRMQAEDPAFFYAMQFVEGRPVGNVFWADARARTAYKDFGDAVVLDDYCKRSKHELPLVAFTGVNHHCQPVLFGCAIMAHNNEASFIWLFETFLLAMSGQQPTSLTMEHDNALKSAALKVFPLTRLQFCKWHIMNEAQDKLSYLLDAFPSFHEDFINCVNMSDTINEFETNWKALISKVSSQKTEWLDLVYNCRHQWVPVYLRDTFFGDVSLKLQCSSRSSLFEGYISAKTDSQSFIQQYEKALDCCYEKEVKEEFETKYSLPDIKTPSPIEKQGAELYTRSMFLKFQQELIDASVYTAEMVKEVGNASVYTVTRSEGSEKSVTVEFSSSGSSATCSCRMFEYFGIVCRHILTVFGVRGVSALPSHYFVKRWTKNALDRSSGKNVDEVSRVEEPKEEQRSSAEDDEQSLTWRYNSLCREALRYAEEGASSLEVYIVAMQALQEAANRVNMAKRGIGQVAPLAVMPIAAQPPESFARNQGIISNKQKKRKRNSNSSRENATSNQLMYVQQPVNFLFVAPGPGSSSALQGPSQLVAAAPVSLSSKYGQTSGANNSVDDNIPPASVVDKFSGLPDRNASAPSTGLLWQIQIKWALGGFGIFYQDISAYQLFLGYVECENYGILTTFNYRAGISEMLHAIYCSCSTSLSFTLGCIVQSNILSLVLCDKSHELSQANGSRGCSVNTLNSSAVPQLVTVPIGLCLPSTDASKISAAGMNSVNSGDISSNGKLSFGQSQSSAQQPATPSQTKTLDRIDSRANPEGSSIRAAAIAAGARIASPSDAATIIKAAQSKGAIHIRPGENLPNYLKPLAPKPLSSLPPVNPLSSAHASPGQHSFGDSAAAKDAIFGSSDGSDDDEEDTDDEEDTDDDEDEGLTGDDAEHE

SEQ ID NO: 5120 - protein, 362 aa, Pseudomonas putida
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPPEAGALIEPLAVGMHAVKKAGSLLGQTVVVVGAGTIGLCTIMCAKAAGAAQVIALEMSSARKAKAKEVGATVVLDPSQCDALAQIRALTFGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 5121 - protein, 109 aa, Brassica napus
TRQISAQARMQRGSSGIGYGLKCQATFTSDVKAHTAYTSFLTGTLSLKEEYEVHLLRLSTGGSELICYGLFAQSNDIWDIASCPFDQRIFSTVLSTGESFGPPIWDIPG

SEQ ID NO: 5122 - protein, 449 aa, Bacillus cereus G9241
MISIGGVIGAGLFVGSGAVVHSAGPGSIVSYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAIVVTLLPWNSANILKSPFVAVLEHIGIPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLNIRKKMGRVEQQNLKVKMWFFPYVTYVTIAAIIAVLIAMLAIESLRSQALLTMFVTVLIIISYFIFNRNKNSTVLNTKSKNEESIRF

SEQ ID NO: 5123 - protein, 959 aa, Photobacterium sp. SKA34
MTNTTFLQALSDDNDFSHRHNGPNALEQQRMLETIGVGSIDQLIAQTVPASIRLTEPMTLPQAQSEAAMLAELKQIAGKNIINKSYIGQGYYNTFTPNVILRNVLENPGWYTAYTPYQPEISQGRLESLLNYQQMIMDLTAMELANASLLDEATAAAEAMTLCKRAGKNKSNAFFISTDLHPQTIDVVTTRAKYIGFEIITGSVEDLAKHDVFGALLQYPASNGELKDLTDIIDAAHDKKTLVAVASDLLALTVLKAPGEMGADVVIGSAQRFGVPMGFGGPHAGFMATKDKHKRTMPGRVIGVSKDAKGNQALRMAMQTREQHIRREKATSNICTAQALLANMAAFYALYHGPEGLKKIGRRVHHFTAVLAAGLRNNGFELENQHFFDTLTIKTGTKTNTLYQKALDAGVNLRKYSDKLGVSIDETTLAEDIEQLLGLFTNQDLKVSMFSDDIAADEFAAIPPACRRSSAYLTHSVFSRYHSETQMMRYMKQLENKDYSLTHGMIPLGSCTMKLNAVAEMIPVTWPEFGQLHPFAPQAQTLGYQELAKNLSEMLCSITGYDAFSLQPNSGAQGEYAGLIAIQRYHEANGDSHRNVCLIPSSAHGTNPASAAMVSMKVVVVGCDELGNIDINDLKAKIEKHRDALSCIMITYPSTHGVYEEAVQEVCDLVHEAGGQVYLDGANMNAQVGLTSPGFIGSDVSHLNLHKTFCIPHGGGGPGMGPIGVKSHLTPFLPGHVEGTNSDEQQYAVSAAALGSASILPISYAYIAMMGEQGLTQATELAILNANYVMERLRPHYPVLYRGTEGRIAHECIIDLRPIKDASGISEEDIAKRLMDYGFHAPTMSFPVAGTLMIEPTESEDIAELDRFCDAMIAIKEEINLVQSGEWPLDDNPLVNAPHSQVDMMESEWNHAYSREVACFPSAHTKAAKYWPSVNRVDNVFGDRNLVCSCPSIENYIED

SEQ ID NO: 5124 - protein, 137 aa, Streptococcus suis 89/1591
MERTFFIIKPDALKRGLAGQILSRIERRGFQIRDLKMVTATEELISQHYDHLTDKPFFPQLVQYMTSGPMIAGIIEGPEVIKSWRDMMGATNPVNALPGTIRGDFATAPVEGIVANVVHGSDSAEAAEREIGLWLGK

SEQ ID NO: 5125 - protein, 422 aa, Haemophilus influenzae R2846
MGLIVAGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEKATFTAAVIISMLFSPIIAQIARKLIQRTEPKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 5126 - protein, 358 aa, Oryza sativa (japonica cultivar-group)
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 5127 - protein, 405 aa, Actinobacillus pleuropneumoniae serovar 1 str. 4074
MERFPKSDKLANVRYDIRGAIHKEALRLEEEGNKILKLNIGNPAPFGFEAPDEIVVDVIRNLPKSQGYCDSKGLYSARKAIVQYYQSKGIRNVDVNDVYIGNGVSELITMSMQALLNDGDEMLIPMPDYPLWTAAATLAGGKAVHYLCDENNEWMPDIEDIKAKITPRTKGILVINPNNPTGAVYSRSMLLEIAEIARQHNLMIFADEIYEKIIYDGAVHHHIAALAPDLLCVTYNGLSKAYRVAGFRQGWMVLSGPKNQARGFIEGLDMLASMRLCATTPMQHAIQTALGGYQSINEFVLPGGRLLEQRNKMYELLVQIPGISCVKAKGALYMFPKIDTEMYGIKDDAKFIYDLLQAERVLLVQGSGFNWHKPDHFRVVTLPYAHQIEEALGRLANFLKTYKQS

SEQ ID NO: 5128 - protein, 240 aa, Saccharomyces cerevisiae
MWSSLFGWTSSNAKNKESPTKAIVRLREHINLLSKKQSHLRTQITNQENEARIFLTKGNKVMAKNALKKKKTIEQLLSKVEGTMESMEQQLFSIESANLNLETMRAMQEGAKAMKTIHSGLDIDKVDETMDEIREQVELGDEISDAISRPLITGANEVDEDELDEELDMLAQGNANQETSKIVNNNVNAAPISENKVSLPSVPSNKIKQSENSVKDGEEEEDEEDEDEKALRELQAEMGL

SEQ ID NO: 5129 - protein, 812 aa, Glycine max
MKFILSLMSIILYTLFISSLVVSIAADKSSNSQFQSLSHEETIVSPNGVFELGFFPLGNSNKSYLAIRYKNYSDETFVWVANGSYPINDSSAKLTLHSSGSFVLTHNSNQVWSTSSLKVAKNPVAELLDSGNLVIREKSEANSEDKEEYLWQSFDYPSNTMLARMKIGWDLKRKINRRLIAWKSDDDPTPGDLSWVIVLHPYPEIYMMRGKEKHHRLGPWNGLRFSGMPEMKPNPVFHYKFVSNEEEVTYMWTLQTSLITKVVLNQTSLERPRFVWSEATASWNFYSTMPGEYCDYYGVCGGNSFCSSTASPMCECLKGFTPKSPEKWNSMVRTQGCGLKSPLTCKSDGFAQVDGLKVPDTTNTSVYESIDLEKCRTKCLKDCSCMAYTNSNISGAGSGCVMWFGDLLDIKLYPDPESGQRLYIRLPPSELDSIRPQVSKIMYAISVAAAIGVILAIYFLYRRKIYEKSMAEKNYESYVNDLDLPLLDLSIIIVATNKFSEGNKIGEGGFGSVYWGKLASGLEIAVKRLSKNSDQGMSEFVNEVKLIARVQHRNLVKLLGCCIQKKEKMLVYEYMVNGSLDYFIFDSTKGKLLDWPKRFHIICGIARGLMYLHQDSRLRIVHRDLKASNVLLDDTLNPKISDFGVAKTFGEENIEGNTNRIVGTYGYMAPEYAIDGQFSIKSDVFSFGVLLLEIICGKKSRCSSGKQIVHLVDHVWTLWKKDMALQIVDPNMEDSCIASEVLRCIHIGLLCVQQYPEDRPTMTSVVLLLGSDEVQLDEPKEPGHFVKKESIEANSSSCSSTNAMSITLLTAR

SEQ ID NO: 5130 - protein, 432 aa, Aeropyrum pernix K1
MDVLASGEKSRMLFERTKELFPGGVNSPVRAAVKPYPFYVKRGEGAYLYTVDGARIVDLVLAYGPLILGHKHPRVLEAVEEALARGWLYGAPGEAEVLLAEKILGYVKRGGMIRFVNSGTEATMTAIRLARGYTGRDLILKFDGCYHGSHDAVLVAAGSAAAHYGVPTSAGVPEAVARLTLVTPYNDVEALERVFAEYGDRIAGVIVEPVIANAGVIPPRREFLAALQRLSRESGALLILDEVVTGFRLGLEGAQGYFNIEGDIIVLGKIIGGGFPVGAVAGSREVMSLLTPQGKVFNAGTFNAHPITMAAGLATLKALEEEPVYSVSREAAKALEEAASEVLDRTGLPYTINRVESMMQLFIGVEEVSNAAQARKADKKFYVKLHEEMLRRGVFIAPSNLEAVFTGLPHQGEALEIAVEGLRSSLKTVLGS

SEQ ID NO: 5131 - protein, 775 aa, Schizosaccharomyces pombe
MSTISEVGPWELGLSLGSGGPNSSRLAKHRETGQLAVVKPIVGWSELTSSQQARIEGELVLLRLIEHPNVLQLIDVISAQEQLFVVVEYMPGGELFDCMLRKGSFTEQDTAKFLWQILCGLEYCHKLHICHRDLKPENLYLDAHGSIKIGEFGMASIQQPGKLLQTSCGSPHYASPEIIMGRSYDGCASDIWSCGIIFFALLTGKLPFDDDNIRSLLLKVCQGQFEMPSNISPQAQHLLYRMLDVDSSTRITMEQIREHPFLSCFVHPNISIPIISAPIQPIDPLIVQHLSLVFRCSDDPMPLYEKLASQSPLVEKTLYTLLSRHLHPPSSAAVDRNRAVVDDLLGTAASNGQQMDEEEIEQAINIPTLAPYPISYAAESVPRPATSASPFLTPVTTSGTFNYSFNATNPQSILQRPATTSSAVPQLPKSVTPGLAYPHDSSMLSSNYRPPSALSPRNFNVSINDPEVQLSRRATSLDMSNDFRMNENDPSIVGNLAASNFPTGMGPPRKRVTSRMSEHTGNRVVSFPRGSAFNPRVTRFNVGNEQFSNNIDNNNYNQPYANATMNNSRRLRTPSGERSMRADLSQSPASYDSLNVPKHRRRQSLFSPSSTKKKLSGSPFQPKRSFLRRLFSSEPSCKCVYASLVASELEHEILEVLRRWQLLGIGIADIIYDSVSASISARIKRQNSLNLKPVRFRISVLAEFFGSQAVFVLESGSSTTFDHLATEFQLIFEDKGFLDNLELSYFQASASRPVSRMSVSSSPFAVFRQRQSVQS

SEQ ID NO: 5132 - protein, 145 aa, Brassica napus
MAVTDAESPHLGEITCGTLLQKLQEIWDEVGESDGQRDKMLLQIEQECLDVYKRKVEQAAKSRAELLQTLSDANAELSSLTTSLGDKTFANGIPDKSHGTIKEQLAAIAPALEQLWPQKEERVRDFSDVQSQIQKISGEIAGGLS

SEQ ID NO: 5133 - protein, 358 aa, Methanosarcina barkeri str. fusaro
MTTVIPFGPQHPVLPEPVSLKLEIDDDVVVGVLPSLGYVHRGLETFINTKDFNQTTYVCERICGICSALHGITYTRTVEKLFDTEIPERAQYIRVIVGELNRLHSHLLWLGLFADGFGFESLFYECWKYREEVLDVAERICGNRVIHSISKVGGVTRDLTKEHIDMLLKMCDSLETEIKNIEKVFVNNYTVKQRLVGLATLSKQVAYEVGTAGPTLRGSGNAIDVRETPDWDIYKDLGFKTAVEKDGDCYARTKVRITELLNSLTIIRNAISKMPEGEIEVRVKGFPTGEAIMRTEQPRGEVIYYVKGNGTKKLERLKVRTPTFANIPSLLLMLPGVKLADVPIVVLTIDPCVSCTER

SEQ ID NO: 5134 - protein, 179 aa, Chrysanthemum x morifolium
MASISSSAVATVNRTTSAQASMVAPFTGLKSNVAFPVTKKSNDFSSLPSNGGRVQCMKVWPPLGLKKYETLSYLPPLTETQLAKEVEYLLRNKWVPCLEFELEHGFPYRENNRSPGYYDGRYWTMWKLPMFGCNDASQVLKELNECKKEYPQSWVRIIGFDNVRQVQCISFIAHKPDGY

SEQ ID NO: 5135 - protein, 675 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVPGDVVLDLSNMNNQTIKLGSGLLQDNDAISAMRAGKLSYSKPNKYWLESSHKRYIPRPDDHVLGIVVDSRADNFWVDIKGPQLALLPVLAFEGGTRRNIPKFEACRHSALSPGCQDKHRNESGAVLYRGLLNSPTRPVIEALGKKLSFEIAVGLNGRVWVNATAPRIVIIVANAIMNSESLSGTQQRIMVEKLLAIISD

SEQ ID NO: 5136 - protein, 174 aa, Thermococcus kodakarensis KOD1
MADKQIERTLIILKPDAVVRGLMGEIISRFEKRGLKIVGMKMIWIDRKLAEKHYAEHKGKPFFEPLIDYITKAPSVVMVVEGRYAISVVRKMAGATDPKDAEPGSIRGDYGLDVGDAIYNVIHASDSPESAEREINLYFKPEELFEYCKAADWFYHTHARSKKEYLDSMDCLER

SEQ ID NO: 5137 - protein, 541 aa, Enterococcus faecalis V583
MEKHWWQEVVVYQIYPRSFKDSNGDGIGDLPGIIEKLDYLETLGIGAIWLSPVYQSPNDDNGYDISDYEAIMTEFGTMADMDRLIEEAKKRKIEIIMDLVVNHTSDEHRWFIEAKKSKENPYRDYYVWADPASDGGAPNRLKSAFSGSAWTFDEASGQYYLHLFSKKQPDLNWGNQQMRQSVYEMMNFWIDKGIGGFRLDVIDLVGKIPGEEITANGPHLHRYLQEMNAATFGGKELLTVGETWGATPEIAKMYSSPERHELSMIFQFEHMSLDQQPGKEKWDLQPMEVAKLKQVFAKWQTELGNDGWNSLFWNNHDLPRMISRWGNDQEYWLESSKLFAILLHMMKGTPYIYQGEEIGMTNTPITDIREARDIETINMYHEYLEKGYSKEEILLKINTKGRDNARRPMQWTAEKNAGFTTGTPWIDVNPNYQTINVAAALADKNSLFYTYQEMIRLRKEHPLIVWGNFELLETVEEVISFYRTYGEERWLVVTNFSDKVQPFSADVSVEQVMIENMPTDVTALADYSLAPWQAFVVKVSQ

SEQ ID NO: 5138 - protein, 537 aa, Enterococcus faecalis V583
MDQWWKNAVGYQIYPRSFKDSNGDGIGDLQGIIEKLPYLKELGVDFLWLNPIYTSPNVDNGYDIADYQGIQPEFGTMEDFQELLDQAHQLGLKIILDLVVNHTSDQHPWFVEAKKSLDNPYREYYLWADATPDRMPNEWQSFFGGSTWTYDEGTKQAYFHVFAKEQPDLNWKNPKVREEIYAMIRWWLDLGIDGFRLDAISHIQKEPWDFKITTNPWAPFMNVKGIEDYMLDLKVIFAEYDIMTVGEASGVSSKKAVEWTNDAGYLNMIFELEHNVREGKPGEERLNILGYKKVMARWQKHLGTEGWNALYVENHDNPRINSILGNETSHSAKAIGTIALLLRGTPFIYQGQEIGMVNYPFQQIDELDAKDSHNHYRLLIESGYDAKQALKEVAHWTRDHSRTPMQWTSQEASSFTSGHPWLAIHPNFKEINVADQETDAQSVLNYYKKLIALRKDNPVFTDGQFELLAPNHPSVFAFLRKTTEATALVIVNLSGEKCQFDLPNKLLGRKWQQLLGNQDFTVKKRMQLAPYQAGVFQ

SEQ ID NO: 5139 - protein, 213 aa, Brassica napus
MAVGEVMRMEIPAGGDLTVTSPDLHVLAVDDSIVDRKVIERLLRISSCKVTTVESGARALQYLGLDGDTGASDLKDLKVNLIVTDYSMPGLTGYDLLKKIKESSTFREIPVVIMSSENILPRIEQCLREGAEDFLLKPVKLADVKRIKELIMRNEAEDCKTLSHSYKRKFAEYIDDASSPSPSSSSTHDESAAKDFPSSKRMKSEDDKFSSLL

SEQ ID NO: 5140 - protein, 278 aa, Thermococcus kodakarensis KOD1
MLDLVVIGHVSIDTLIFPDGRRVTMPGGAAAGVATSAALAGAKVGLVTKIGTDFPKEWLQALSSVLDISGVQILPGKTIHIQMIYHEDGSVDAPVEMGVAQKMGEIPIPEEYLDAKVFHISPIPPEEQLKLLNRLKGKRVTVDFNPTYKEEYIKRRDLLREIVSRVEIVFPNEREALMITGAEDVKDAARILHGWGAKLVVITRGEKGVLVYDGSFREFPALPIKPEEIVDPTGGGDAFAGGFLAGYSRGRPLEECVRLGLERAREVLKKWGDWSITV

SEQ ID NO: 5141 - protein, 511 aa, Bacillus subtilis subsp. subtilis str. 168
MSKKPAALIILDGFGLRNETVGNAVALAKKPNFDRYWNQYPHQTLTASGEAVGLPEGQMGNSEVGHLNIGAGRIVYQSLTRVNVAIREGEFERNQTFLDAISNAKENNKALHLFGLLSDGGVHSHINHLFALLKLAKKEGLTKVYIHGFLDGRDVGPQTAKTYINQLNDQIKEIGVGEIASISGRYYSMDRDKRWDRVEKAYRAMAYGEGPSYRSALDVVDDSYANGIYDEFVIPSVITKENGEPVAKIQDGDSVIFYNFRPDRAIQISNTFTNKDFRDFDRGENYPKNLYFVCLTHFSETVDGYVAFKPINLDNTVGEVLSQHGLKQLRIAETEKYPHVTFFMSGGREAEFPGEERILINSPKVATYDLKPEMSAYEVKDALVKEIEADKHDAIILNFANPDMVGHSGMVEPTIKAIEAVDECLGEVVDAILAKGGHAIITADHGNADILITESGEPHTAHTTNPVPVIVTKEGITLREGGILGDLAPTLLDLLGVEKPKEMTGTSLIQK

SEQ ID NO: 5142 - protein, 253 aa, Bacillus subtilis subsp. subtilis str. 168
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 5143 - protein, 225 aa, Bradyrhizobium sp. BTAi1
MQKYRPVMLVVLDGWGWREEVADNAIRQARTPNFDHLWGTGPHALVQTSGLDVGLPQGQMGNSEVGHLNIGAGRVVMQDLPRISAAITDGEIKSASALIDLMERLRRTGGTCHLLGLISPGGVHSHQDHATALAEILAETGVSAVVHAITDVRDTPPRSADVYVSRLSAALPLSIPIVSVCGRYYAMDRDHRWERVAKAYCTIVEAYAYDEGRLIDACARARRGL

SEQ ID NO: 5144 - protein, 335 aa, Bacillus subtilis subsp. subtilis str. 168
MAVKVGINGFGRIGRNVFRAALNNPEVEVVAVNDLTDANMLAHLLQYDSVHGKLDAEVSVDGNNLVVNGKTIEVSAERDPAKLSWGKQGVEIVVESTGFFTKRADAAKHLEAGAKKVIISAPANEEDITIVMGVNEDKYDAANHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQEVTAEEVNAALKEAAEGDLKGILGYSEEPLVSGDYNGNKNSSTIDALSTMVMEGSMVKVISWYDNESGYSNRVVDLAAYIAKKGL

SEQ ID NO: 5145 - protein, 397 aa, Trifolium pratense
MASASASLFKSSLVLDKSEWVKGQTLRQPMSVVRCSPAAPSSLTIRAGAYTDELVKTAKTIASPGRGILAMDESNATCGKRLASIGLENTEVNRQAWRTLLVTVPSLGEYISGAILFEETLYQSTVDGRKIVDVLVEQNIVPGIKVDKGLVPLAGSNDESWCQGLDGLASRLAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRIENVKAAQEALLHRAKSNSLAQLGKYAGDGESEEAKKELFVKGYVY

SEQ ID NO: 5146 - protein, 464 aa, Bacillus subtilis subsp. subtilis str. 168
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 5147 - protein, 290 aa, Streptococcus thermophilus CNRZ1066
MRIADYSVTKAVLERHGFTFKKSFGQNFLTDTNILQKIVDTAEINKNVNVIEIGPGIGALTEFLAENASEVMAFEIDERLVPILEDTLRDHDNVKVINEDVLKADLQTRVKEFENPDLPIKVVANLPYYITTPILMHLIESKIPFSEFVVMMQKEVADRISAEPNTKAYGSLSIAVQYYMTAKVAFAVPRTVFVPAPNVDSAILKMTRRKQPLVEVKDEDFFFRVSKASFLHRRKTLWNNLTSHFGKSEEVKNKLDQALENAAIKPSIRGEALSISDFARLSDALREAGL

SEQ ID NO: 5148 - protein, 345 aa, Propionibacterium acnes KPA171202
MKALVKTRPEPGLELVEVPDPVAGPNDVIVKVMRTGICGTDVHIDKWDGWAAKTVHTPLVLGHEFCGEIVELGSEVNDLEVGQFVSGEGHYVCGRCRACLAGKRHLCRNTQGIGYAVNGAYCQYFVMPAGNVWVHHIPDLDPDVAAIFDPFGNAVHTALQFPCLAEDVLVSGAGPIGIMAALVAQFQGARNVVVTDLSDERLELAQQLGLKNAVNVSREGLETVWDRFDMKEGFDIGLEMSGSGTALTSMIDNMTHGGRIALLGTPSTDITLDFSKIIFNMITIQGVTGRQIFETWYTMASLIRSGLDISGIITDRYPITEFREAFDVAGSGHGGKVVMNWECLD

SEQ ID NO: 5149 - protein, 968 aa, Lycopersicon esculentum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPSSLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 5150 - protein, 545 aa, Magnaporthe grisea 70-15
MRLHFFTELLAAGSLLLSSVNALEAKLTQQEDKREKCVGMYSRSAWGGDIDPFILVRFNKVEEEGDHRASMLIFEWMDQDLVLFQSSPDTPKKLAICNPENVSAGNCNETHLGEYIVSANVNKESHNIVHTQVVDLKDPKPFNYPIKNTGYYCIFTAEYTRSDYEAIVEFRNAFGELPAAQIPKLPFYGGITILYALVAVFWGLLYYRHRSDILPVQNYITAILIFLVVEMLLTWAFYDYLNRHGSNTLSKFLLVLVAVLNAIRNSFSFFLLLIVCMGYGVVKHTLGKTMIYVRYLAIAHFFFGLVYAVASLVITPDSAGPFVLLIVLPLAGTLTAFYVWTLNSLNLTLKELNERKQHVKEGMYKKLWWCILISIIVIFGFFFFSSFSFTSMRDPDYVPFHWKTRWFMLDGWLNLVYFADVAFIAYVWRPTANNRRFAMSDEIAQEDDGTFDMTNMDIGAPDDSDDEEANIGTKPATSTHTATQTNGGAPSNARSGPTATRNAGPAARDSLDGETIFAVGEDLDKFSDDDEDSEEERGLVKKSNK

SEQ ID NO: 5151 - protein, 826 aa, Lycopersicon esculentum
MMMVSSKIFSLLQFFALLNLFTVTFASTEEATALLKWKATFKNQDNSLLASWTQSSNACRDWYGVICFNGRVKTLNITNCGVIGTLYAFPFSSLPFLENLNLSNNNISGTIPPEIGNLTNLVYLDLNNNQISGTIPPQTGSLSKLQILRIFGNHLKGSIPEEIGYLRSLTDLSLSTNFLNGSIPASLGNLNNLSFLSLYDNQLSGSIPEEIGYLRSLTDLYLSTNFLNGSIPASLGNLNNLSFLSLYDNKLSGSIPDEIGYLTSLTDLYLNNNFLNGSIPASLWNLKNLSFLSLSENQLSGSIPQEIGYLRSLTNLHLNNNFLNGSIPPEIGNLWSLSIIDLSINSLKGSIPASLGNLRNVQSMFLDENNLTEEIPLSVCNLTSLKILYLRRNNLKGKVPQCLGNISGLQVLTMSRNNLSGVIPSSISNLRSLQILDLGRNSLEGAIPQCFGNINTLQVFDVQNNKLSGTLSTNFSIGSSLISLNLHGNELEGEIPRSLANCKKLQVLDLGNNHLNDTFPMWLGTLLELRVLRLTSNKLYGPIRSSGAEIMFPDLRTIDLSNNAFSKDLPTSLFQHLEGMRTIDKTMKVPSYEGYGDYQDSIVVVSKGLKLEVVRILSLYTVIDLSNNKFEGHIPSVLGDLIALRVLNMSHNGLKGHIPPSLGSLSVVESLDLSFNQLSGEIPQQLASLTSLGFLNLSHNYLQGCIPQGPQFRTFENNSYEGNDGLRGYPVSKGCGNDPVPDTNYTVSALDDQESNSEFLNDFWKAALMGYGSGLCIGLSIMYFMISTGNPIWLARIIDEMEHQINTRRRKKQQGQRNHRRRNNHF

SEQ ID NO: 5152 - protein, 179 aa, Zea mays
MTEVALLRGPTNLASTASRAPASPSPSPSSSLRYLANADSDVLQGSDSPERTAGSAGSRRLLELRGQEAAEEEEERWSFLALLFELLRKSLLGCRTVGGGEGEHGGCGMEIGLPTDVQHVAHVTFDRFHGFLGLPVEFEPEVPRRAPSARVYLCNNMDGVCSNLNFRLDGVCTFFPPFL

SEQ ID NO: 5153 - protein, 944 aa, Lycopersicon esculentum
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTYLDLGENALNGSIPASLGNLNNLSRLDLYNNKLSGSIPEEIGYLRSLTYLDLGENALNGSIPASLGNLNNLSRLDLYNNKLSGSIPEEIGYLRSLTYLDLGENALNGSIPASLGNLNNLSRLDLYNNKLSGSIPEEIGYLRSLTKLSLGNNFLSGSIPASLGNLNNLFMLYLYNNQLSGSIPEEIGYLSSLTNLYLGNNSLNGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEVPSYERYYDDSVVVVTKGLELEIVRILSLYTVIDLSSNKFEGHIPSVLGDLIAIRVLNVSHNALQGYIPSSLGSLSRVESLDLSFNQLSGEIPQQLASLTFLEFLNLSHNYLQGCIPQGPQFRTFESNSYEGNDGLRGYPVSKGCGKDPVSETNYTVSALEDQESNSKFFNDFWKAALMGYGSGLCIGISIIYFLISTGNLRWLARIIEELEHKIIMQRRKKQRGQRNYRRRNNRF

SEQ ID NO: 5154 - protein, 621 aa, Citrus unshiu
MKTKVWALCLILVVHSSWLASANMEGDALHSLRSNLIDPNNVLHSWDPYPCQSLHMVSCYMQMNNSVILVDLENAALSGQLVSQLGLLKNLQYLELYSNNITGPIPSDLGNLTSLVSLDLYLNSFTGPIPDTLGKLSKLRFLRLNNNSLSGPIPMSLTNISSLQVLDLSNNRLSGVVPDNGSFSLFTPISFANNLDLCGPVTGRPCPGSPPFSPPPPFIPPPPISSPGGNSATGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSQLPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNNYVEAEVEQLIQVALLCTQGSPMDRPKMSEVVRMLEGDGLAERWDEWQKVEVLRQEVELAPHPNSDWIVDSTENLHAVELSGPR

SEQ ID NO: 5155 - protein, 268 aa, Candida albicans SC5314
MTDVSPNSKIEHLTPDNITVTAPSEPPFSSSSSTSASASTPTPIAEEKLSTPIPTPSPSHRRGSSIGSSTSPSSSTRNRSNSNSANALTPTPSHHQPAHSITRQRRSSSLIQHLEPDTLDTKIDQALNPNVNANWVHQKGAWVIHVVIIILVKMIFNFISVLNNDWKWTLTNLTYNIGSYIMFHQVKGTPFEFNSGAYDNLTMWEQIDNGDQYTPSKKFLMLVPIGLFLISTHYSSYNLNLFILNGLSCLCVVVPKLAFAHRLRVTLY

SEQ ID NO: 5156 - protein, 506 aa, Aspergillus oryzae
MAVSLSFLTYLFLIVAGVYLARKISRAVQIRQFKKRHGCLPPPRDHHKDPVLGLDEVRSMLRVFREDYLMEYTLEKYRRHGNTFATSVLGDDDIFTAEPENIKTILAVKFKQFDLGETRRRTFHPLLGDGIFAADGPQWEHSRTLLRPSFTRTQIAATDLHERHIQRLISRIPRDGSTVDLQELFFNLTLDTATEFLFGESVESLRLGSSAGSSSFAHHFNVAQDEIAFSMVIAPFDQLIFRPRFRESVREARGYVGNFVKKAIEYRHSLDAEKHAGDTTDSQSRYVFLEELAKETDNPSDITDQILNILLAGRDTTASLLSMVFYNLARRPDIWDLLRSEVATLDGKCPSFEELKQLKYLSWVINETLRLYPVVPSNSRTANEDTFLPVGGGPDGKSPVFVAKGQRVAYDVYVMHRRHDIFGPDAEEFRPERWETIRPGWGYLPFNGGPRICLGQQFALTEASYTTVRIVQSFKEITSRDPEPYRERLALTLASRHGTKVAMVPA

SEQ ID NO: 5157 - protein, 473 aa, Synechococcus sp. PCC 7002
MTQTATDVLRLIQEENIQIIDLKFVDLPGIWQHCSFYQDQLDEASFVDGVPFDGSSIRGWKAINESDMAMVPDPTTAWIDPFCKEKTLSLICSIKEPRTGEWYSRDPRSIAQKAVDYLAPSGIGDTAYFGPEAEFFVFDDVRFDQTENKGFYYVDSVEGRWNSGRKEPGGNLAHKPGYKQGYFPVPPTDTLQDMRTEMLLTMAKCGVPIEKHHHEVATGGQNELGFRFATLLKAADYLMTYKYVIKNVARKYGRTVTFMPKPLFNDNGSGMHTHQSLWKEGQPLFWGDRYANLSQLALHYIGGILKHAPALLAFSNPSTNSYKRLVPGFEAPVNLAYSQGNRSASVRIPLSGPNPKAKRLEFRCPDATANPYLAFAAMLCAGIDGIKNAIDPGDPLDVDIYDLTPEELSKIPSTPASLEAALEALQQDHDFLTAGGVFTTDFIENWIEYKLDAEVNPLRLRPHPYEFALYYDC

SEQ ID NO: 5158 - protein, 281 aa, Alkaliphilus metalliredigenes QYMF
MKQRIGFIGTGNMATAIVQGLVKDYVGMENYISVNNRPTTQDKMSKAESLHKKFNVNLEASNLDIVKKSKIIFLTVKPNIYPKVLEEIREFITSEHVIVSVAAGVSIALIEGFFDKPVKVIRTMPNTPVFVGEGMTAVTPNNYVTDDELRTVVEIFSSMGEVEIIGEGIMDAIPAISGSSPAYVYTFIEALADGGVSLGIPRDKAYKFAAQAVYGAAKMVLESNEHPGVLKDQVCSPAGSTIEALYVLEKNGFRGTIIEAMKACTHRAKELGLSEHKTHIE

SEQ ID NO: 5159 - protein, 355 aa, Oryza sativa
MTNGAGGGGGGGGLGHEGVPTWRERENNRRRERRRRAIAAKIYAGLRAYGNYNLPKHCDNNEVLKALCNEAGWTVEPDGTTYRKGCKPPQAERPDPIGRSASPSPCSSYQPSPRASYNPSPASSSFPSSGSSSHITIGGNSLIGGVEGSSLIPWLKTLPLSSSYASSSKFPQLHHLYFNGGSISAPVTPPSSSPTRTPRLRTDWENASVQPPWASANYTSLPNSTPPSPGHKIAPDPAWLSGFQISSAGPSSPTYNLVSPNPFGIFKEAIASTSRVCTPGQSGTCSPVMGGMPAHHDVQMVDGAPDDFAFGSSSNGNNESPGLVKAWEGERIHEECASDELELTLGSSKTRADPS

SEQ ID NO: 5160 - protein, 255 aa, Thiobacillus denitrificans ATCC 25259
MHTPRKRFGQNFLIDDGIVHAIVNAIHPQAGETVVEIGPGLGALTRPLLERLPHLHAVELDRDIIARLRRAWPPERLTLHAGDALKFDFGSLGDDLRIVGNLPYNISTPLLFHLLEFAPRIRDMHFMLQKEVVERMVASPATADYGRLSIMLQRRFHMEWLLDVPPTAFDPPPKVESAVVRLIPKSTAEVPSVDEALFARVVAAAFAQRRKTLRNTLSALMRPEDFVALGIDPGLRAEALHVADYEAITAYLATR

SEQ ID NO: 5161 - protein, 716 aa, Yarrowia lipolytica CLIB122
MGQSPSKNANSTSSLTTTNGQASGAGLGVISDEGGDDPSSSGCSGTSAHNKTPHHQKSSSSSTRPPTGRSRSSKSSTGGSRKERTSMSFDHDFSIDNASAADFMSKPKRRVSSGASKSAKTDMRHDPTGSERKSRRDKAEEAGLVAAMGEVVISRPHDSQSSSDTDNASLASTNSEGSTSSLTAPVAPIQNSNSEPGTAPGAHTEPISIPGNNDSLAHSKFLSAKRTPATTLPPPGSSGPVATPVIAVSHHDNNGSLTSNVTSEGSLSAISIASSSATSNASPENADKSKMSPQSSQSSSSSEEDLSDLSGLKSPIPTTHIGSSRANAVALSSKPSASTPQRVDLPAGYQSSLSVSVDSVTGSPARNIKNPKIEPAVSGASVASTASSKKATKKQPLPFDVNDFIKRLLDAGGKSGGAAPVPLRPNEIVQLCAAARTVFMSQPVLLELGTPVKVVGDIHGQFGDLIRIFQMSGFPPKTNYLFLGDYVDRGRQSLETILLLFCFKVKYPENFFMLRGNHECASITKVYGFYDECKRRATTKIWKSFVDTFNTLPIAATIGGKIFCVHGGLSPYLNSMDDIRKITRPTNVPDVGLLSDLLWSDPERSIMEWSENDRGVSYCFGRSVVNKFCTKFKFDLVCRAHMVVQDGYEFFNKRKLVTVFSAPNYCGEFDNWGAVMCVSKQLLCSFELLKPMDSASIKDAVRRGIKKTQKVKLGES

SEQ ID NO: 5162 - protein, 357 aa, Thermococcus kodakarensis KOD1
MKARKAWRVVREVVDEADIVVEVVDARDPIGTRNRKLERLILEEGKPLLIVMNKADLVPKEWAEEYKRKSEVPVVFISARERKGTGILRKEIKKLAKPLLDEKEKVKVALIGYPNVGKSTIINTLKGKRAVGTAPIPGYTKGKQLIRLSKKIWLLDSPGVIPIDDFDELVIRGGFPADKIEEPVKPAVKLIGRILETRKEAITEKFGITEFESEEDILRKIGERRGLIKAGGEVDIEETARWFLREWQTGRFTLFGSEEEGKRDFIWDFEDVLNGVEKDLLLDPRRILWKYGDELREKLDGQKRAGVREIEGITVGIATGFKKCDSAVKFLEELTGKHALASECFGKKWKGVVAVLD

SEQ ID NO: 5163 - protein, 389 aa, Blastopirellula marina DSM 3645
MKAVRWHGKSDVRVEDAPDPKIEDPGDVVIQITSTAICGSDLHLYNGFMPGMKAGDIIGHEPMGVVVEVGRDVRRLAKGDRVVVPFTISCGHCWFCEQTMFSLCDNSNPNAEQARKQMGHSPAGLFGFSHLLGGFPGGQAEYLRVPSADVGPIKVPEGLSDEQVLFLSDIFPTGYMAAENAEIAPGDTVAVWGCGPVGQFAIQSAWMFDAGRVIAIDRIPERLRMAETNGRAETINTDEVDVYEKLMEMTNGRGPDRCIDAVGAEAHASSSVWSAMDTMREAIHLESDKPYVLQEAIRCCRKGGTISVPGVYVGSVQLPFGAAMNKALTFRMGQTHVQRYLDPLMKKIEEGKIDPSFVITHRVPLMDAAKAYETFRDKEDECIKVVLKP

SEQ ID NO: 5164 - protein, 447 aa, Bacillus subtilis subsp. subtilis str. 168
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 5165 - protein, 408 aa, Bacillus subtilis subsp. subtilis str. 168
MGGMALTGNKAVVYKGKGTVAVEDIGYPELILRDGPGVPKANVNRKCEHGVILKVITTNICGSDQHMVRGRTTAPEGLVLGHEITGEVIETGRDVEFIKKGDIVSVPFNIACGRCVMCKTQKTHVCLNVNPDRPGSAYGYVDMGGWVGGQSEYVMVPYADFQLLVFPDKEQALEKILDLTMLSDIFPTGFHGAYTAGVQTGSTVYIAGAGPVGLAAAHSAQLLGASTVIVGDLNEDRLAQARSFGCETVNVQKHDRLGEQIEQILGEPTVDAAVDCVGFEASGHGNQGEAPAAVLNSIMDVTQVGGSLGIPGLYVTEDPGAKDADAKTGSLKIRFGLGWAKAHTFVTGQTPAMTYNRNLMKAILSGRAQIAKAVNATVISLDDAPKGYSDFDKGAAKKFVIDPHGTLK

SEQ ID NO: 5166 - protein, 448 aa, Rhodospirillum rubrum ATCC 11170
MRYLPHSEADRAAMLATIGAASVEDLFRDVPREALDQAAFDALPDHGGEMEVERALSALAARNLTAGSVPCFLGAGSYRHHVPAAVDALIQRGEFLTSYTPYQAEVSQGTLQYLFEFQTQVALITGMEVANASMYDGATACAEAAAMAVRITRRRKVLMAGGLHPHYTATTQTLLACLGHEGEGLPPDPLALGDLIGRVGSDTACVIVQNPDFFGRLRDLSPLAEACHAAGALLVVAVCEPVSLGLVAPPGAMGADIVVAEGHALGSPTGFGGPGVGLFATREKYLRQMPGRLAGETLDESGKRGYVLTLSTREQHIRREKATSNICTNSGLIALAFTIHMTLLGEAGFTRLAWINHANAVALAEKLARVKGVKVLPETFFNEFTLRLPKPAAEVVEALAARSILAGVPVSRFLPTYPELANLLLVNATELTTPEDADALVAALKEVL

SEQ ID NO: 5167 - protein, 153 aa, Oryza sativa
IDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVL

SEQ ID NO: 5168 - protein, 799 aa, Lycopersicon esculentum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTYLDLKENALNGSIPASLGNLNNLSRLYLYNNQLSGSIPEEIGYLSSLTNLYLGNNSLIGLIPASFGNMRNLQALFLNDNNLIGEIPSFVCNLTSLELLYMPRNNLKGKVPQCLGNISDLLVLSMSSNSFSGELPSSISNLTSLKILDFGRNNLEGAIPQCFGNISSLQVFDMQNNKLSGTLPTNFSIGCSLISLNLHGNELEDEIPWSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYEIYYDSVVVVTKGLELEIVRILSLYTVIDLSSNKFEGHIPSVLGDLIAIRVLNVSHNALQGYIPSSLGSLSILESLDLSFNQLSGEIPQQLASLTFLEFLNLSHNYLQGCIPQGPQFRTFESNSYIGNDGLRGYPVSKGCGKDPVSEKNYTVSALEDQESNSKFFNDFWKAALMGYGSGLCFGISIIYFLISTGNLRWLARIIEELEHKIIMQRRKKQRGQRNYRRRNNRF

SEQ ID NO: 5169 - protein, 196 aa, Oryza sativa
MYCHTFVSPGIGATLQTLLERNVLITDDCPGVVYQNNDSETDIVLKGVVRVTNLADASEHIGEVLRRVKKEHLKRAYKIEDWVDDNDFLVQLSKTTGKLLRGGEPDLTTTAKMVLHDWQRGKIPFFVPPPQQGEDSPSETAEPVDKSDEEGVSSDRTAAAMKAIAGIISSQQQMNVPCQKEFGVTNEDSEVAEQSE

SEQ ID NO: 5170 - protein, 1016 aa, Lycopersicon esculentum var. cerasiforme
MMMVTSKVFSSLQFFTVFYLFTVAFASTEEATALLKWKATFKNQNNSFLASWTTSSNACKDWYGVVCLNGRVNTLNITNASVIGTLYAFPFSSLPFLENLDLSNNNISGTIPPEIGNLTNLVYLDLNTNQISGTIPPQIGSLAKLQIIRIFNNHLNGFIPEEIGYLRSLTKLSLGINFLSGSIPASLGNMTNLSFLFLYENQLSGFIPEEIGYLRSLTKLSLDINFLSGSIPASLGNLNNLSFLYLYNNQLSGSIPEEIGYLRSLTKLSLGINFLSGSIPASLGNLNNLSRLDLYNNKLSGSIPEEIGYLRSLTYLDLGENALNGSIPASLGNLNNLFMLYLYNNQLSGSIPEEIGYLRSLTYLDLGENALNGSIPASLGNLNNLSRLDLYNNKLSGSIPEEIGYLRSLTYLDLGENALNGSIPASLGNLNNLFMLYLYNNQLSGSIPEEIGYLSSLTELYLGNNSLNGSIPASLGNLNNLFMLYLYNNQLSGSIPEEIGYLSSLTELFLGNNSLNGSIPASLGNLNNLSRLYLYNNQLSGSIPASFGNMRNLQTLFLSDNDLIGEIPSFVCNLTSLEVLYMSRNNLKGKVPQCLGNISDLHILSMSSNSFRGELPSSISNLTSLKILDFGRNNLEGAIPQFFGNISSLQVFDMQNNKLSGTLPTNFSIGCSLISLNLHGNELADEIPRSLDNCKKLQVLDLGDNQLNDTFPMWLGTLPELRVLRLTSNKLHGPIRSSGAEIMFPDLRIIDLSRNAFSQDLPTSLFEHLKGMRTVDKTMEEPSYESYYDDSVVVVTKGLELEIVRILSLYTIIDLSSNKFEGHIPSVLGDLIAIRVLNVSHNALQGYIPSSLGSLSILESLDLSFNQLSGEIPQQLASLTFLEVLNLSHNYLQGCIPQGPQFRTFESNSYEGNDGLRGYPVSKGCGKDPVSEKNYTVSALEDQESNSEFFNDFWKAALMGYGSGLCIGISIIYILISTGNLRWLARIIEELEHKIIVQRRKKQRGQRNYRRRNNRF

SEQ ID NO: 5171 - protein, 472 aa, Escherichia coli
  misc_feature (450)..(450): Xaa can be any naturally occurring amino acid
  unsure (1)..(472): unsure at all Xaa locations
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETXNVTLEHIERKLMAGEKLRNIGV

SEQ ID NO: 5172 - protein, 178 aa, Arabidopsis thaliana
  misc_feature (74)..(74): Xaa can be any naturally occurring amino acid
  misc_feature (116)..(116): Xaa can be any naturally occurring amino acid
  misc_feature (125)..(125): Xaa can be any naturally occurring amino acid
  misc_feature (171)..(171): Xaa can be any naturally occurring amino acid
  unsure (1)..(178): unsure at all Xaa locations
SGIFGANHPSGLKTQWSFHPWFPKISVSFPVTRKARDDITSITSNGGRVSCMKAWPPIGKKKFETLSYLPDLSXTVELVNEADYLLRNKWIPCVEFELEHGFVYREHGISLGYYDXRNWTSLKLXLVGGTDSAQRATEVEDCQKEYPGAFFLIIGFDNTRQVQCISFIAHXPPSFTEA

SEQ ID NO: 5173 - protein, 302 aa, Oryza sativa
MLGLRGARAAQLPYASAAVAPTPTPSFSGFARRLPLLASAALSPLPPSFSFSSASAVRRDRDPPMRPVSGALSRSRPTTRVFCSAAATAPREGKELLVQHLLVGEQDVRLLVDLEKNIITGGADLSDLAVEYSLCPSKENGGMLGWVRRGQMVPEFEEAAFGAPLNKVVRCKTKFGWHLLQVLAEREQCVVEDIPPEELHAKMQDPNFLEEAQLIDVREPDEVDKASLEGFKVLPLRQFGTWGPVMTDEFDPQKDTYVLCHHGMRSMQVAKWLQSQGFRKVYNVAGGIHAYAVKADSSIPTY

SEQ ID NO: 5174 - protein, 382 aa, Xylella fastidiosa Temecula1
MQVTSKLPQVGTTIFSVMSQLADVYGAVNLGQGFPDFPVPLRLQEALAGAVREGHNQYPPMIGVAGLRQGIAAKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPSALSAEFRKVHQYNTFTSFGPAQYAFAAMLHEEPGYVEQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 5175 - protein, 163 aa, Zea mays
MSKQSSASIKTLFAGWYYLFNAGEKRKEAEMIELEGSLGKSNAVNQELVALEKELSTHRRTGSIDSFGLYLYGIVLRDKGCEGLARTILVESVNTYPWNWSAWSELQSLCTSSDILNNLNLKNHWMKDFFLASAYLELKMHEEALKRYERLMGVFRCRSTHRG

SEQ ID NO: 5176 - protein, 654 aa, Geobacter sulfurreducens PCA
MAIRYIDEISELKDKKVFIRVDFNVPLDEHQNITEDTRIRAVLPTINFALDAGAKVVLASHLGRPKGERKPKYSMAPAAKRLSRLLGKEVLLAPDCIGSEVRQMIDAMKSGDIIMLENVRFYEGEEKNDENFARELANGCEIYVNDAFAVSHRAHASVEAITKFFPVVAAGFLMKNEMNYFEKAMQKPIRPLVAILGGAKVSGKLEVLESLLNKVDKIIIGGGMAFTFLKALGYNVGKSLVEEDLIETARSTYAKAREKGIKFYLPVDCVAADRFNPEAETKVTTIQEIPEEWMALDIGPATVALFTEALQSAKTIIWNGPMGVFEMDAFSRGTFAMVTAVANSYALTIVGGGDTDSAVHRAGEYAKISYISTGGGAFLELLEGKKLPRHQGAGRKRKIGGAAMRTPVIAGNWKLFKKRAEARELVNGLVSLVKDVQGVEIVVAPVFTVLAAVKGALDGSAIKLAGQDCFWEEEGAYTGEISPGMLVDAGCSHVIIGHSERRQYFGETDETVNRKIKAALKAGLAAIACIGESLAEREAGTTFDVLRTQLNGGLAGLSADDLKDVIIAYEPVWAIGTGKTATDAQAQEAHAFIRGVVSELLGKPAAEAVRILYGGSVKPENIKGLMTQPDIDGALVGGASLKADSFAAIASFSM

SEQ ID NO: 5177 - protein, 461 aa, Ralstonia eutropha JMP134
MVESNNDGTLKRGLKNRHIQLIALGGAIGTGLFLGIAQTIKMAGPSVLLGYAVAGIVAFFIMRQLGEMVVDEPVAGSFSYFANKYCGHFAGFMSGWNYWVLYILVSMAELSAVGIYVQYWWPGIPTWISALAFFLIINAINLSSVKSFGEMEFWFSIIKVAAIIGMIGFGGYLLMSGNAGPQASITNLWQHGGFFPNGLGGLVMAMAVIMFSFGGLELVGITAAEADQPEKSIPKATNQVIYRILIFYVGALAVLLSLYPWENVVTGGSPFVLIFHALNSNWVANVLNVVVLTAALSVYNSGVYCNSRMLFGLAQQGNAPKSLLKVSKRGIPLTALGVSAAATGLCVLINYFMPGKAFELLMGLVVSALIINWAMISIIHLKFRADKRKAGQETRFKSFGYPLTNYLCLAFLGGILVVMYLTDGLRISVYLIPVWLAVLGISYRLRQKNAVPALQGSVSAQ

SEQ ID NO: 5178 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRVSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 5179 - protein, 124 aa, Physalis longifolia
DTGRRLIYCIPNYVFLKIEQGEKSDILDKSWPQLEYNKTDGLDKQAFWERQYKKHGTCCKNKYTQEAYFNLAIKLKDRFDVLKILGDQGIIPGNKYAFQKVHDAIKKVIRRPPKLMCTEASQVL

SEQ ID NO: 5180 - protein, 151 aa, Prochlorococcus marinus str. MIT 9313
MIALHQTAIQDHPYQWRSKWNEMNETHIEANHLTMNQPTPTPISAKDLHRWLSDSSSLPICVDVREDQELELAPFPADVLHLPLSRSSDWMETLPQLLPNDRPVVVICHAGIRSWNFGTWLLEQEISYQVWNLEGGIDAWSINVDSSVPRY

SEQ ID NO: 5181 - protein, 835 aa, Thermococcus kodakarensis KOD1
MIFGKEDEKVDEIKLRVAEALKRDVGRGIVRFDRKYQRKLGVEPGDIVALKGERVTAAIVANAHPDDRGLDIIRMDGYIRRNAGVSIGDYVTVSRAEVQEAKKVVLAPAQKGVFIQIPGEIVKQNLLGRPVVKGDLVVAGGQNEAVYSPFDELLRGFFEAMPIGFGELKFVVVNTVPKGIVQITYNTEVEVLPQAVEVKEESIPEVTYEDIGGLSDAIQKIREMVELPLKHPELFERLGIEPPKGVLLYGPPGTGKTLLAKAVANEANAHFIAINGPEIMSKFYGESEERLREIFKEAEENAPSIIFIDEIDAIAPKREEVVGEVEKRVVSQLLTLMDGLKSRGKVIVIAATNRPDALDPALRRPGRFDREIEVGVPDKQGRKEILQIHTRGMPLEPDYDKEAVLRVLREIREKGNFDAERVDKIIAEVENAKNESEVKEALKKDAEIYSEVRNRLIDKMLDELAEVTHGFVGADLAALAREAAMVVLRRLIKEGKISPEQERIPPEVLQELRVRRDDFYEALKMVEPSALREVLIEVPNVRWEDIGGLEDVKQELREAVEWPLKYPKAFERLGIEPPKGILLYGPPGTGKTLLAKAVANESQANFIAIRGPEVLSKWVGETEKRIREIFRKARQAAPTVVFIDEIDAIAPARGSEGDRVTDRLINQLLTEMDGIQENSGVVVIGATNRPDIIDPALLRPGRFDRLILVPAPDEKARLEIFKVHTRRVPLAGDVDLRELAKKTEGYTGADIAALVREAALIAMRRIMRELPREVVESESEEFLERLKVSKKDFEMAMKKVKPSVTPYMMEYYRSFEENRKKQAGKERGGPDYYTF

SEQ ID NO: 5182 - protein, 571 aa, Candida albicans SC5314
MGNSPSKDDPLPKSSSSNKSSNGGSSSSSSTVSGTDLDPDEMAPALSQLMINDKLNYKKSNSPQRSSSLNVGNSTKYNKTSNNNSNKTNRVFELETSSTSVSATATTTPQRIPSVRSRQSSEAYDFDLEIGMSMAKLLKNQQDFPSSFESSNASVSSPVFTTLGVDTKDEDSLSSINSSPCDTTKSNVIANKQLSHPENMSTVKKLDVIDEINSLESSPSNSSKLSQANLRKHNKTLVHQLTKRISDSSTSSASGSPPLVGTSQKLEVDIDDIIARLLATKKRSTSRKSNKTRLPVETNELKYVLAKSRQIFLDQPTLLRLSPPVKIVGDIHGQFHDLIRIFNCCGYPPHSNYLFLGDYVDRGEKSLETILLLLCYKIKYPENFFMLRGNHESANITKIYGFYDECKRRLPNHKLWKNFIDVFNALPIAAVINEKIFCVHGGLSPDLNNFDQIENIKRPTDVPDKGLLADLLWSDPDASVKNFSLTNWPKNDRGVSYVFGKKHVDYFCSKFKLDLIVRGHMVVEDGYEFFNKRKLVTVFSAPNYCGEFNNFGAIMSVDKHLYCSFELIKPN

SEQ ID NO: 5183 - protein, 477 aa, Methanosarcina barkeri str. fusaro
MQIPDHKTKIVCTIGPASSSEEVIRKLVLAGMNVARINFSHGSFESHSEVIQRVRKVAEELDRTVAILADLPGPKIRIGKLEKEPIMLHKGNSVTLTVAETTGNETRIPVSYKQLPESVVPGSLIYLSDGFIQLRCLEVSGKDVLCEVLIGGQLYSHKGLNLPGAKILVDSVTGKDLEILGFALSKGIDTFSISFIESAEDIRNVRNFAAARGKSVYIVSKIERRQAVENIQDILKETDALMIARGDLGVEIPIQEVPSVQKELIHSAKLLGIPVITATQMLASMTDNIRPTRAEATDVANAILDGTDAVMLSEETAVGNYPVEAVEMMAKIAKTTEDWRSGTKWGLDAIIKGITARDMSVDEVITLQVHEALQKLPVAAVLTPTRSGATPRRISRFKPDTWILAFSRVPRTCGFLSLSYGVYPITVNENIESWEKETTEKAKDLGFVKSGEIVIFTQGPSSGSPGGTNMLKILTLK

SEQ ID NO: 5184 - protein, 428 aa, Prochlorococcus marinus str. MIT 9313
MNTTRSQAIFSAAQRLMPGGVSSPVRAFRSVGGQPIVFDRVKGAYAWDVDGNRFIDYIGSWGPAICGHAHPEVIVALQDALEKGTSFGAPCELENQLAEMVIDAVPSVEMVRFVNSGTEACMSVLRLMRAFTGRDKLIKFEGCYHGHADMFLVKAGSGVATLGLPDSPGVPRSTTSNTLTAPYNDLEAVKELFAENPDAISGVILEPVVGNAGFITPEPGFLEGLRELTREHGALLVFDEVMSGFRISYGGAQARFGVTPDLTTMGKVIGGGLPVGAYGGRAEIMEMVAPAGPMYQAGTLSGNPLAMTAGIKTLELLKQEGTYERLESTTERLIKGILEAAKAAEVPITGNSIGAMFGFFLCEGPVRNFEDAKATDTELFGKLHRAMLERGIYLAPSAFEAGFTSLAHSEADIETTLKAFRESFAAVA

SEQ ID NO: 5185 - protein, 243 aa, Staphylococcus aureus
MNQKNPKDTQNFITSKKHVKEILNHTNISKQDNVIEIGSGKGHFTKELVKMSRSVTAIEIDGGLCQVTKEAVNPSENIKVIQTDILKFSFPKHINYKIYGNIPYNISTDIVKRITFESQAKYSYLIVEKGFAKRLQNLQRALGLLLMVEMDIKMLKKVPPLYFHPKPSVDSVLIVLERHQPLISKKDYKKYRSFVYKWVNREYRVLFTKNQFRQALKHANVTNINKLSKEQFLSIFNSYKLFH

SEQ ID NO: 5186 - protein, 467 aa, Bacillus subtilis subsp. subtilis str. 168
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 5187 - protein, 141 aa, Haemophilus influenzae R2846
MMTERTFSIIKPDAVKRNLIGAILTRFEQNGFKIIASKMVRLTREQAEGFYAEHQGKEFFAPLVEYMMSSPIVVSVLEKENAVKDYRTLIGTTNPETAAEGTIRKEFALSQRENSVHGSDSIENANREIAYFFTDCEIFER

SEQ ID NO: 5188 - protein, 334 aa, Haemophilus ducreyi 35000HP
MAIKIGINGFGRIGRIVFRAAQLRDDIEVVGINDLIDVDYMAYMLKYDSTHGRFDGTVEVKDGQLVVNGKTIRVTSERDPANLKWDEIGVNIAVEATGLFLTDETARKHITAGAKKVVLTGPSKDATPMFVNGVNFDTYAGQDIVSNASCTTNCLAPLAKVIHNKFGIKEGLMTTVHATTATQKTVDGPSAKDWRGGRGAAQNIIPSSTGAAKAVGKVLPALNGKLTGMAFRVPTTNVSVVDLTVNLEKAASYQEICAEIKRASENEMKGVLGYTEDAVVSTDFNGATETSVFDAAAGIALTDTFVKLVSWYDNETGYSHKVLDLVAHVYNYRG

SEQ ID NO: 5189 - protein, 253 aa, Acidovorax sp. JS42
MKHIPRKRFGQHFLSDQGIIDAIVRAIAPEPGQPMVEIGPGLAALTQPLVERLGRLTVVELDRDLAARLRQHGQLDVIESDVLKVDFAQVAQALNASKIRVVGNLPYNISTPILFHLLAHVRVIADQHFMLQKEVIDRMVAAPATSAYGRLSVMLQWRYAMENVLFVPPESFDPPPRVDSAVVRMVPHEAPEALSMPVLEELVQVAFSQRRKLLRHTLGRWLEARQFAGTFDTQRRAEEVPVSEYVALAQECS

SEQ ID NO: 5190 - protein, 302 aa, Neurospora crassa
MTTAAAADSKTIVLITGATRGIGFETAKHLSTSPDQNYHIILCGRRPSSVESAITILRSLPNLHASTTFEFLNLDLTSDTSTISAAAAAAHIAAKHGHLDTLVHSAAISSSFLHTNVTDPRAPERVRENWHSILDTNLIGPALLTDALLPLLSASQKPERKIIFVSSGLGSIPYTFNNDGDDDEGAVNSRSSLVDLDNVTSKYTEYSASKAALNMYAKHLAWRLENSKEGKTLGDTKGGQEKNKKWKVNVVCPGYTSKTAGGLDSFRGKQEPWEAAETVVRVVQEQGEKTGTFRDKEGEVPW

SEQ ID NO: 5191 - protein, 253 aa, Zea mays
MEDVLTPPPQPELAGEKRKREESSLDASIEDAPSAPASTCSAEDAAGSDVARHPMWKTSLCSFFRRRGAGAEGCSHGDSCRYAHTEEELRPRPDGTWDPTSDRAKELRKVAAEAQEEAEEEVTVDEQSLDKCLVGLPRGWTADRLKSLLQDQGISYATAKKKKGMTVGFVTFQSVEQLTNAVQVLKENPSGGKQIKIVDANRRSHQKAHAGAPVSNTGTATENGSRPTTPAEETSVPESVSSSKKGARDAVTP

SEQ ID NO: 5192 - protein, 215 aa, Xylella fastidiosa Temecula1
MSEAKRRAAEKAIEYVENDMIIGVGTGSTVAYFIDALGHTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 5193 - protein, 261 aa, Debaryomyces hansenii CBS767
MPQNEYIEQHIKQHGRRLDYEERKRKKAAREGHRIAKDAQELKGWRGKQFAKKRYSEKVAMKKKIKTHQESKVKGPATPKEDDGEALPTYLLDRQTNNSAKAISSSIKQKRLEKADKFAVPLPRVKGISEEEMFKVIKTGKQKSKAWKRMITKHTFVGEGFTRRPVKMERIIRPSALRQKKANVTHPELAVTVFLPILGVKKNPQSPMYTQLGVLTKGTIIEVNVSELGLVTAGGKVVWGKYAQITNEPDRDGCVNAVLLV

SEQ ID NO: 5194 - protein, 446 aa, Mycobacterium sp. MCS
MTTPPGPPNAGGDARTGTDTVIVVGGEDWEQVVAAAEQAQAGERIVVNMGPQHPSTHGVLRLILEIEGETITEARCGIGYLHTGIEKNLEYRNWTQGVTFVTRMDYLSPFFNETAYCLGVEKLLGVTDAIPERVNVIRVMLMELNRISSHLVALATGGMELGAMSAMFYGFREREEILSVFEMITGLRMNHAYIRPGGLAADLPDGAVPRIRELLALLPGRLRDLENLLNENYIWKARTQGIGYLDLAGCMALGITGPVLRSTGLPHDLRRAQPYCGYEDYEFDVITDDGCDAYGRYLIRVKEMRESLKIVEQCVDRLKPGPVMIADKKLAWPADLELGPDGLGNSPAHIARIMGQSMEGLIHHFKLVTEGIRVPAGQVYTAVESPRGELGVHMVSDGGTRPYRVHYRDPSFTNLQAVAAMCEGGMVADAISAVASIDPVMGGVDR

SEQ ID NO: 5195 - protein, 333 aa, Geobacter sulfurreducens PCA
MALRVAINGFGRIGRSVLRAAAKEKGIEIVAINDLTDAKTLAHLLKYDSVHGPFPGKVEVGDGAIVVNGKPITIIAERNPELLPWKKMKIDVVLEATGLFTAREKAELHLKAGAKKVIISAPATNEDITIVMGVNHDAYDPKKHNIISNASCTTNCLAPVAKVLHETFGIEKGLVTTVHSYTNDQQILDLPHKDLRRARAAAMSMIPTTTGAAKAVSLVLPELKGKLDGMAIRVPTPNVSVVDLVVTLKKKTDAEKVNAALKKAAKGSLKGILRFEEEPLVSIDFNGTTHSSIVDALSTKVIDGTMVKVLSWYDNETGFSNRVVDLMKLIASK

SEQ ID NO: 5196 - protein, 175 aa, Triticum aestivum
  misc_feature (170)..(170): Xaa can be any naturally occurring amino acid
  unsure (1)..(175): unsure at all Xaa locations
LVPNSARAGTEMNFTTDEKYASICDDKNMYVDYKNITKVIEPGRIIYVDDGVLAFDVLKIVDEQTIHVRCRNNGKISSKKGVNLPNTDVDLPALSEKDQADLRFGVKNNVDMIFASFIRRGEDIKHIREILGEEGKHIQIIAKIENRQGLNNFAEILKETDRVMGAKGDXGIEIT

SEQ ID NO: 5197 - protein, 318 aa, Triticum aestivum
  misc_feature (130)..(130): Xaa can be any naturally occurring amino acid
  misc_feature (184)..(184): Xaa can be any naturally occurring amino acid
  unsure (1)..(318): unsure at all Xaa locations
MAGLSLEHPWAFAFGLLGNIISFTSLLAPIPTFYRIFKSKSTEGFQSVPYVVALFSAMLWIFYALVKTGEGLLISINAAGCVIETVYIVMYLVYAPRKAKIFTAKIVVLLNVAGFGLILLLTLFAFHGEXRVISLGWICVGFSVCVFVAPLSIIGRVIKTKSVEYMPFSLSLTLTLSAVVWFLXGLLIKDKYVALPNILGFTFGMIQMVLYMFYMNATPGGERSEGGERGAEDVGGGARGGDQRWQERKELWRRGSPGHRRWSKPSRRRRGQQVMALDSARSVGCGVNSRMQACLMHEFVQALIFVQLFWRVTPAGHA

SEQ ID NO: 5198 - protein, 174 aa, Candida albicans SC5314
MAEKRLFKEYNQYQKHLPQLNNDQIVSLSPLSPDKNILLWEATIAKPTKKDSPYYYGGQWKLSINVPTSYPIDPPTIKFVTPIVHPNINLGSGEICLDILKKESWSPAWNLEHLVVAILMLLDQPEPDSPLNIDAANLYRQDKVAYESIVQFNIWKHNNFYSAFVRDTSGVRSL

SEQ ID NO: 5199 - protein, 143 aa, Salmonella enterica subsp. enterica serovar Typhi
MAIERTFSIIKPNAVAKNVIGSIFARFEAAGFKIVGTKMLHLTVEQARGFYAEHDGKPFFDGLVEFMTSGPIVVSVLESENAVQRHRDLLGATNPANALAGTLRADYADSLTENGTHGSDSLESAQREIAFFFGEGEVCPRTR

SEQ ID NO: 5200 - protein, 350 aa, Glycine max
MATVVRIPTISCIHIHTFRSQSPRTFARIRVGPRSWAPIRASAASSERGEIVLEQKPKKDDKKKLQKGIAEFYDESSGLWENIWGDHMHHGFYDSDSTVSLSDHRAAQIRMIQESLRFASVSEERSKWPKSIVDVGCGIGGSSRYLAKKFGATSVGITLSPVQAQRANALAAAQGLADKVSFQVADALQQPFSDGQFDLVWSMESGEHMPDKAKFVGELARVAAPGATIIIVTWCHRDLGPDEQSLHPWEQDLLKKICDAYYLPAWCSTSDYVKLLQSLSLQDIKSEDWSRFVAPFWPAVIRSAFTWKGLTSLLSSGLKTIKGALAMPLMIKGYKKDLIKFSIITCRKPE

SEQ ID NO: 5201 - protein, 733 aa, Arabidopsis thaliana
MKVHSLFLMAIFFYLAYTQLVKAQPRDDCQTRCGDVPIDYPFGISTGCYYPGDDSFNITCEEDKPNVLSNIEVLNFNHSGQLRGLIPRSTVCYDQQTNNDFESLWFRLDNLSFSPNNKFTLVGCNAWALLSTFGIQNYSTGCMSLCDTPPPPNSKCNGVGCCRTEVSIPLDSHRIETQPSRFENMTSVEHFNPCSYAFFVEDGMFNFSSLEDLKDLRNVTRFPVLLDWSIGNQTCEQVVGRNICGGNSTCFDSTRGKGYNCKCLQGFDGNPYLSDGCQDINECTTRIHNCSDTSTCENTLGSFHCQCPSGSDLNTTTMSCIDTPKEEPKYLGWTTVLLGTTIGFLIILLTISYIQQKMRHRKNTELRQQFFEQNGGGMLIQRLSGAGPSNVDVKIFTEEGMKEATDGYNESRILGQGGQGTVYKGILQDNSIVAIKKARLGDRSQVEQFINEVLVLSQINHRNVVKLLGCCLETEVPLLVYEFISSGTLFDHLHGSMFDSSLTWEHRLRIAIEVAGTLAYLHSYASIPIIHRDVKTANILLDENLTAKVADFGASRLIPMDQEQLTTMVQGTLGYLDPEYYNTGLLNEKSDVYSFGVVLMELLSGEKALCFERPQSSKHLVSYFVSAMKENRLHEIIDGQVMNEYNQREIQESARIAVECTRIMGEERPSMKEVAAELEALRVKTTKHQWSDQYPKEVEHLLGVQILSTQGDTSSIGYDSIQNVTRLDIETGR

SEQ ID NO: 5202 - protein, 343 aa, Ralstonia eutropha JMP134
MDTASELQATIRAMVQPGKGLLAADESGPTIAKRFTTIGVESNEENRRAWRSLLLSTPGLGAHISGVILYEETLGQRADDGTPLPELCARQGIVPGIKVDKGKVPLVNAPGDEITEGLDGLPKRLEAYRQQGARFAKWRAVFNVSDTLPSALAVQANAQVLAAYAAICQASGIVPIVEPEVLMDGDHGLARSAAVTERVLHAVFHALHRYGVVLEHMVLKPSMVIAGKKSAQQTSVQDVATETVRVLKRTVPGAVPGIFFLSGGQTPEQATANLDAMNRLGPLPWPLSFSYGRALQEPPLAAWRGQAANVGKAQQALLQRSLLNGEACQGQYEAAQESMEKVG

SEQ ID NO: 5203 - protein, 757 aa, Oryza sativa (japonica cultivar-group)
MRGAVLVAVAAAIGNYLQGWDNATIAGAVLYIKREFALETQPAVEGLVVAMSLIGATIITTFSGPVSDLVGRRPMLIASSLLYFAGGLIMLWSPNVYVLLLARLVDGFGVGLAVTLVPVYISETSPPEIRGRLNTLPQFTGSGGMFMSYCMIFAMTLSPSPNWRIMLGVLFVPSLLYLFVTVFYLPESPRWLVSKGRMKEARVVLEMLRGREDVSGEMALLVEGLGTGGDTEIEDYVVGPSEGDAGENEQARDTVTLYGPEQGLSWVAQPVAGGRGSMLGSSLGLQASRHGSMYEQMKDPVVALLGSVHERLPESGGGATGSMRGSTLFPNLGSMLSVNDRPGGSSWDEENVQPGDDDLDEEEEEYLSDDGKDDDDGGGLQAPLLSRQSTDVETKNEPASGQVAMQRHSSIGGGGGVETASTMGIGGGWQLAWKWTENVGPDGVKRGAVKRMYLHEESEAAPGGDSGAAGDAQSTAYVHAAALVSRSMLYTKDVLIGQSPTEPAFANPPEAVAAAASTGPAWRELLEPGVRHALFCGVTIQILQQFSGINGVLYYTPQILDQAGVSVLLASLGLSGDSTSILISGLTTLLMLPSIGVAMRLMDASGRRALLLWTLPVLVASLAVLVVANVVPMAATAHAALSTGSVIVYFCCFVMGFGPIPNILCAEIFPTRVRGLCIAICSLTFWLGDIAVTYSLPVMLSSVGLAGVFSFYAAVCCVALVFVALKVPETKGLPLEVIIEFFNVGAKAGTLPDEEFH

SEQ ID NO: 5204 - protein, 222 aa, Petunia x hybrida
MFKLQLASVLCVFLFACSPISGSFDHWQLVLTWPAGYCKVKGCPRPVIPNDFTIHGLWPDSISVIMNNCDPTKTFVTITEINQITELEKRWPELTTTAQFALTSQSFWRYQYEKHGTCCFPVYSQSAYFDFAIKLKDKTDLLSILRSQGVTPGSTYTGERINSSIASVTRVKPNLKCLYYRGKLELTEIGICFDRTTVAMMSCPRISTSCKFGTNARITFRQ

SEQ ID NO: 5205 - protein, 469 aa, Brucella suis 1330
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEVRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 5206 - protein, 179 aa, Glycine max
INDVLIHCDIVFKFLFYAAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTAPAAPVHVPAGRQPTRPVSSKPTAEEDELAALQAEMAL

SEQ ID NO: 5207 - protein, 591 aa, Ustilago maydis 521
MAAQYMLAVVIAALSLFNTISAQFVQPPTDLKTTKGYLDIPVRYKQVPTGTCETNPNVKSFTGYVDVQEDEHIFFWFFEARNEKPENAPLTVWINGGPGSSSMIGLFQELGPCSVDSNGTVVNNPYAWNNASNMIFIDQPATTGFSYTKLVPGYVDPSTESLVALPSNECPEYAQAYGTCGTYSAANVTLTANTTGSAAENFYRTLQGFMGAFPQYSREDFHFATESYGGHYGPIFNKYIEEQNAHRSSKAHKIKLKSVMIGNGWYSPEVQYAAYYNFTVSPGNTYDYRPFNSSVEHMMYNNLFGPGNCLDQIRDCYSTGTNQACSTADTFCADNVESILDLYANRDEYDIRELSPDPFPYSFYIDYLNTPAFQKAIGAFQNFSESSSTVSNAFSNTGDDGREEGTIEDVRALLDQGVQVVMYAGDADYNCNWLGGEVIAEQVQHKGFDQAGYQDLETSDGVTHGQVKQSGQFSFVRIYESGHEVPFYQPLASLELFQRVLKGTDLATGKDKISRDSTYKTIGPAKSTYREGNGTVQFEVLPPDATYNTTLNAPNKSNQAPRDATVQEAYRFQRVGEMLRSRYSFQRTFML

SEQ ID NO: 5208 - protein, 381 aa, Acidobacteria bacterium Ellin345
MSTAIEVTPSDLENKTFLDSNELVLNMGPQHPSTHGVLRVILKLDGERVLGTECVIGYLHRGVEKIAENRTYVQFNPYVDRMDYVAAVSNGLGYCEAVEKLIDVQAPPRAQFLRVILTELNRLASHMVWLGTHALDIGALTPLFYTFRDREEVLKIFEKYCGARLTTHAFRIGGCIYEAYEGFEKDVLDYCDKLGPRIDEYEGLLTGNRIWLQRTKGIGILNAADCKALGVTGPVLRAAGVKWDLRKAQPYAAYDQVDFDVPTGENGDTFDRYMVRMQEMRQSIRILRQAVEKLPAGPTMAKVPKVLKPPVGRIYHSIEAPKGELGYFIVSDGSLQPYRVRVRPPSFVNLQALDKMVRGALIADVVAVIGTLDIVLGEVDR

SEQ ID NO: 5209 - protein, 323 aa, Bacillus halodurans C-125; identical to SEQ ID NO: 373

SEQ ID NO: 5210 - protein, 245 aa, Bacteroides uniformis
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGSIPYHLSTQIIKKVVFESHASDIYLIVEEGFYKGTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 5211 - protein, 472 aa, Haemophilus influenzae R2846
MPNANAIANVFKLIEENNVKFVLLRFTDIKGKEHGVSIPVSLVDEEMFEDGKMFDGSSVEGWKTINKADMLLMPMAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGFEAPVLLAYSASNRSASIRIPAVTNPKAIRIEARFPDPLANPYLAFAALLMAGLDGVVNKIHPGDAMDKNLYDLPPEELKDIPAVASSLEEALNSLEKDYEFLTQGGVFAKDFIDVFISIKRKEVERLNMAPHPVEFEMYYA

SEQ ID NO: 5212 - protein, 279 aa, Bacillus halodurans C-125
MKTTASFKKMKQQKEKIAMMTAYDAPSARLVEDADVDMILVGDSLGMVVLGYDSTIPVTLDDMIHHTKAVKRGAKNTFIVTDMPYLTYHGSFNETLVGAKRLMQEAGADALKLEGNGDIIDTIERLTLAGVPIVAHLGLTPQNVAVEGGYRVQAKDAKSAKQLLADAKAVEAAGAFALVLECVPEQVATQISEELTIPVIGIGAGAGCDGQVLVYHDVIGYGAGHVPSFVKQYVNITKPIEEAMKQYVQEVKAGTFPDKDHAFSLKENVIQELYGGALT

SEQ ID NO: 5213 - protein, 369 aa, Rhodospirillum rubrum ATCC 11170
MSVLSQDRPRERPPMLATDRTTLAQFLVEECRGRAGDDSELLGLLLDVAQACKTISKMTAMGSLAGVHGYNGDVNPQGENQARLDLMSNQAFVRATERTGHAAGLASEEMEEVLGFPESYARGTLLLVFDPLDGSSNIDINGTVGSIFSILPMPRPGEAPQTADFLQSGRQQVAAGYALYGPSTMFVLTIGSGVHGFTLDPLLGDFILTHPSMTVIPESGEFAINSSNSRFWEPPIRAYVDELLAGRSGPRSKDYNMRWIAALVADVHRILLRGGIYLYPRDTKTPDLAGRLRLLYEAAPVAFLMEQAGGRCTTGTRTMLDLVPGSLHERVPLIFGSAVEVERVETLYREPQRREFATPLFNQRGLFRD

SEQ ID NO: 5214 - protein, 256 aa, Actinobacillus pleuropneumoniae serovar 1 str. 4074
MARRPLVMGNWKLNGSKAFTKELIAGLKAELADVKGCDVAIAPPVMYLAEAEAALAGQSVIALGAQNVDVNVQGAFTGDISTEMLKDFGAKYIIIGHSERRTYHKECDTFIAKKFAALKAAGLVPVLCIGETEAENEAGQTEAVCAKQIDAVIDALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAEKAKA

SEQ ID NO: 5215 - protein, 1073 aa, Streptomyces avermitilis MA-4680
MTTQPETDLRPIRSPRGVPLFGHTPQIPSTNPVEYFGKLSKQFPEGLYGMEIAGIEQVFVWDPDLVAEVCDETRFFKQIDKTPLAHVRDYAGAGLFTAHQHEEEWGMAHRVLLPVFSQRAMKGYFGQMLEIAQNLVGKWERKEGQPVNITDDYTRLTLDTIALSGFGYRFDSFAKEDLHPFLNALLQALVESLRRSQELPVMTKMRKADDKKYRENIRLMRDLVENVIKERREGKGTGEDDLLGLMLEATDPETGKGLDDDNVRDQVVTFLIAGHETTSGLLSFATYSLMRNPHILAQAYAEVDRLLPGDTVPDYDTIMQMDVIPRILEETLRLWAPIPMIGKSPLEDTVIGGCYGLKKGARVNILEGPLHTHPKAWERPEEFDINRWLPENRVNHHPHAYKPFGNGVRACIGRQFALTEARLALALVLQKFKFADTDDYKMDVKEALTRKPGGFELNVRARQEHERTVFGAADLQTDDTQAQAAVSGVGVNLTVAYGSSLGSCEDLARTIADRGERSGFGTTLVGLDELGDNLPTEGLLVVVASSYNGKAPDNAQRFDDLLAAGLPEGSLSNVRFALLGAGNTQWVATYQGFPKRIEAGLLAAGATRVIERGIADAAGDFDGMATRWMDTLWTTLAEEYAADTSETTGPRFEVQLLTEAEVRPAIVSEQAYPLTVVANEELVSDATGLWDFSIEPPRPAAKSITIELPDGVTYDTGNHLAVFAKNEPVLVNRALARLGVDRDQVLRLDQPGGGRTHLPVGTPVTTGLLFTEFVELQDVATRSQIQELAEHTQCPWTRPQLQAYTADTAEAEERYQKEILGKRVSVLNLLERFPAVELPLAVFLEMMGPIRPRFYSISSSPLANPRHVRLTVGLLEGPALSGDGRYRGTCSSYIAGLESGDVFYGYVRVPSPTFAPPADPATPLLLIGPGTGIAPLRGFLEERAHQHAHGTQVGLSQVFVGCRHPEHDYFYRQEMQDWEQAGIAQVHTAFSAVTGHPARFVQDAIVGAADTVWQAIQDGAYVYVCGDGRRMAPAVREALAAIYRKHTGSDDEAAQQWLAQLEADERYQQDVFA

SEQ ID NO: 5216 - protein, 149 aa, Pisum sativum
MAEQTFIMIKPDGVQRGLVGEIISRFEKKGFYLKGLKFVNVERAFAEKHYADLSAKPFFSGLVDYIISGPVVAMIWEGKNVVTTGRKIIGATNPAQSEPGTIRGDFAIDIGRNVIHGSDAVESANKEIALWFPEGAANWQSSLHSWIYE

SEQ ID NO: 5217 - protein, 796 aa, Escherichia coli
SQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNAFEGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 5218 - protein, 260 aa, Glycine max
MPQGDYIERHRRDYGYRLDHFERKRKKEARQVHKRSSIAQKALGIKGKMIAKKNYAEKAQMKKTLAMHEESTSRRKTDDNVQDGAVPAYLLDRDNTTRAKVLSNTIKQKRKEKAGKWDVPLPKVRPVAEDEMFKVVRTGKRKTKQWKRMVTKATFVGPGFTRKPPKYERFIRPTGLRFTKAHVTHPELKCTFNLELIGVKKNPNGPMYTSLGVITRGTIIEVNVSELGLVTPAGKVVWGKYAQVTNNPENDGCINAVLLV

SEQ ID NO: 5219 - protein, 290 aa, Debaryomyces hansenii CBS767
MDAKEIKSAVSSLDKSTDDATILKLLNILNDGVEPTEKLLRETKVGVAVNKFRGNSNPEVSSLVKKMIRNWREVVQNEKTKKKTGSATPDKDSKPVNNNTKQSSTESKFHSGPRNPKTDGINTTLYDNTTRNASVSALYTALAIERNDSGEHILAVSRDIENEVFKAEYLSVNDNYRNKLRTFTMNLRNKKNPDLRDRLLTNKIKPSNFIKMTPNEMAPESLKKEIEKLHKQNLFDAQGATEKRAVTDRFTCGKCKHKKVSYYQMQTRSADEPLTTFCTCENCGNRWKFS

SEQ ID NO: 5220 - protein, 233 aa, Sulfolobus tokodaii str. 7
MMCISMLIFKFPSVTSTQDLAEAIYQIINADEFVIVAEEQTRARGRYKREWYSPKGGLWFTYVIKNYNAEKIPFLTFRSSLAVRKVLSTFLNVKIRWPNDIVYGKRKISGILIEGISEGANSTVFIGIGIDTNVKSLPEELSATSLYLELNREVDNDKMLNEIINEIKNYEKISDKEIIDEINEHLSIKDKKVKLISKSEERNCLALFVDYYGRLVTECGIFEVEDILRVIEE

SEQ ID NO: 5221 - protein, 280 aa, Wolinella succinogenes
MLEAIFEKIKECAPYIQGVIGESAGEYFETKNATGDQQLKADLKADMIIEQEFAKIPSIKGLCSEEKEGCLILNPEGRYMIAYDPLDGSSLVEVNMSVGTIFGIYEGEFGAKNLIASAYIVYGPGIELVIAHEKVELYTFQFGRFEHRKTLALQEKGKINAPGATQACWHPKHKEFIDSLFAEGYRLRYSGGMVPDLHNILIKGGGLFSYPGASDNPKGKLRMLFEALPFAFIFEKAGGAAIDGKKRLLELEHSHLHDTTPCFFGSIHEIERVRSVYQEL

SEQ ID NO: 5222 - protein, 353 aa, Nanoarchaeum equitans Kin4-M
MGMGIMIIADPIYRIIEVDDKLKPIIDSKAFQRLRYIKQTALTYLAYPSMNHTRFEHSLGVYYLTKLLANQLDLDTTYYSLVGLLHDIGHCPFSHTGEMALQKYLNKNHEELSYYWLETLKEEIESLGYTINEIYKGIIGENIVTFSLGTDRLDYLQRDSYYSANGNPNINYHYVIKNIVKIDNTYAFREKALSLIEQILILRSHLRKTVYFHKSSLAGDVLLERAITKLLDYYKPMEIALMNDYELVGLFKYYKIGEWERIENRDLPKLLAKYNEENEDLEEQLEKSNINYYKIRIVSKNKIEDIKIYDNEIKPITEVSQVAKYLEYIDNQLYGYYYFVDRKDWQKALKLIQ

SEQ ID NO: 5223 - protein, 245 aa, Bacillus thuringiensis serovar konkukian str. 97-27
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKTLKKGEFPLTECLVDTEKRVLAYWHSEIAPKLKDGNKVIISSHGNTIRSLVKYLDNLSSDGVVSLNIPTSIPLVYELDENLRPIRHYYLSMDGEVPEGEIPKHITF

SEQ ID NO: 5224 - protein, 317 aa, Arabidopsis thaliana
MVEKGVLDDIIRRLLEGKGGKQVQLSESEIRQLCFNARQIFLSQPNLLDLHAPIRICGDIHGQYQDLLRLFEYGGYPPSANYLFLGDYVDRGKQSLETICLLLAYKIRYPSKIYLLRGNHEDAKINRIYGFYDECKRRFNVRLWKVFTDCFNCLPVAALIDEKILCMHGGLSPDLDNLNQIREIQRPIEIPDSGLLCDLLWSDPDQKIEGWADSDRGISCTFGADKVAEFLDKNDLDLICRGHQVVEDGYEFFAKRRLVTIFSAPNYGGEFDNAGALLSVDESLVCSFEIMKPAPASSSHPLKKDFHNRTLGYNLSA

SEQ ID NO: 5225 - protein, 797 aa, Shigella flexneri 2a str. 301
MSQPIFNDKQFQEVLSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVMKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLTDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRQQYREIKQANKVCLAEFVKVRTGIEINPQAIFDIQIKRLHEYKRQHLNLLHILALYKEIRENLQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 5226 - protein, 249 aa, Roseovarius nubinhibens ISM
MMNWPEGYGRRVLARVDSTNAEAARIAPTLAGPEWILALEQTAARGRRGRAWANPVGNFAATLVMRPTESPDQVALRSFVASLALFDAVVDATGRAAGVSLKWPNDVLLNGGKLAGILLESAGSGGGLSHFAIGIGVNLREAPGAGEVEPGAVRPVSLLSEAGVMVTPEEFLDLLAPAYARYETQFVTYGFAPIREAWLARAAKIGEVITARTTRDSHEGTFETVDATGNLVLSTAHGRIAIPAADVFF

SEQ ID NO: 5227 - protein, 635 aa, Roseovarius nubinhibens ISM
MEGMLFQATIYLVAAVIAVPLASRLGLGSVLGYIAAGILIGPVLGLVGHETHDLQHVGEFGVVMMLFLIGLELEPKALWDMRHKLIGLGGMQVVLTTLAVMVVAMQLGQVWSVALAIGMIFALSSTAIVLQTLSEKGLMRTGGGRSSFSVLLTQDIAVIPMLAFIPLLALPQTPESVLGDALKKLMAGEGKHEVAPAHEAAVHFIESLPSWGVTLVTFGAVAGIIVFGVYLTRPIFRFIHAAKLREMYTALALLIVVSISFLMNLLGLSPALGAFLAGVVLANSEFRHELESDIEPFKGLLLGLFFITVGAGINFAVLFALPALILGLTLAVIVIKGIVLYCLGRVFGLRRRDLWLFTLSLAQAGEFGFVLISFSKQQNVLPRQIDEVLLLVVALTMLITPLLFLLYDWMSRRMTETNDLPEPDQIDDKGQVIIVGIGRFGQIVHRLVRSAGFSTVVLDRDLSAIQRMRRFGIKSFFGDPTRPEMLIAAGLREARVLVVAIDDPQASVRLVHFARRERPDLHIICRARDRTHVFRLYQAGANDIVREMFDASLRAGRYALENLGLSEFEAAELETTFYHHDRHSVKELAALWNPDIPTVENAAYIARAKELESELETMLLSAMEEAAATEDKKTA

SEQ ID NO: 5228 - protein, 488 aa, Bacillus thuringiensis serovar konkukian str. 97-27
MNSATNQATSKTEATKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 5229 - protein, 465 aa, Pyrococcus abyssi GE5
MKTLILAGGKGTRLWPLSREAMPKQFIKVFSDRSLFQKTVERALLFSKPKEIFIVTNKEYKFRVLDDLNELGLKVPEENILLEPVGKNTLPAIYWGLKVIDENYGDSVVAVLPSDHAIKVNDNYMEAFKKAEKLAEKYLVTFGIKPTKPHTGYGYIKPGEKIKVEGKTIGYLVDEFKEKPDLETAKKYVENGYYWNSGMFMFRTSVFMEEARKHAPETVRAFEEGKSIEEIYELVPEISVDYGIMEKTDKAAVVPLNTYWNDLGSFDAVYEALDKDENGNAVQVAGFKAKYININSRNNLILTERLTATVGVEDLIIVDTGDALLVAKRGETQKVKEVYKRLREENDERAIVHRTAYRPWGSYTVLEEGERYKIKRITVLPGKRLSLQIHYHRSEHWVVVRGTAKVVVGDKEFILRPGESTFIPAGVPHRLENPGKVVLEVIETQIGEYLGEDDIVRLQDDFGRE

SEQ ID NO: 5230 - protein, 394 aa, Solibacter usitatus Ellin6076
MKLAERMSRIGIESAFDVLVRARALEAQGRSVIHLEIGEPDFPSPPHVIEAGKKALDEGWTHYGPTQGLPDLREAIAAHISRTRGISVGPQHVSVVPGGKPIIFFPMLALLEEGDEVIYPNPGFPIYESMIRFCGATPVPLPLEESRGFSFDLDRFESLLTPRTKMVVLNSPQNPTGGVIPREDLKAIAGLLGDRDIIVLSDEIYSEICYGERPVSITEFPGMLEKTIILDGFSKTYAMTGWRMGYGVMPEWLVEAVNKLMVNSNSCTASFTQRAGIAALTGPRDAVDAMVAEFRRRRDAFVAGLNQIPGFHCALPGGAFYAFANITGTGISSRELADYLLYEAGVAGLNGGCFGEYGDGYIRFSYANSLPNLMEAVSRIQKVSARWHSAVAAR

SEQ ID NO: 5231 - protein, 232 aa, Brucella suis 1330
MDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIGLARAAIIAGTDGIRTMNRS

SEQ ID NO: 5232 - protein, 218 aa, Thiobacillus denitrificans ATCC 25259
MTQDEMKRAVARAAVDYAKGGIIGVGTGSTANHFIDALAEVKGRIEGTVASSEATAARLKSHGIQVLDLNSVGELEVYVDGADEITQHFAMIKGGGGALTREKIVAACSKQFVCIADDSKLVDVLGKFPLPVEVIPMARSHVARELVKLGGQPRLREGFTTDNGNVILDVHNLSIIDPVSLETAINQIVGVVTNGLFARRGADVLLLGTSTGVKTFTR

SEQ ID NO: 5233 - protein, 471 aa, Polaromonas sp. JS666
MAKTVADVMKMVKENEVKFVDFRFTDTRGKEQHVTVPVSHFDEDKFTSGHAFDGSSIAGWKGIEASDMQLMPDPNTANIDPFFEETTLFMSCDVLEPSDGKSYDRDPRSIAKRAESYLKASGLGDTAYFGPEPEFFIFDDVRWNTDMSGTFFKIEEYEAPWNSGSKLEGGNRGHRPTVKGGYFPVPPVDSTQDMRAEMALILESLGIPVEVFHHEVAGAGQNEIGTRFSTLVQRADWTQILKYVVQNVANAYGKTATFMPKPIVGDNGSGMHVHQSIWKDGKNLFAGDGYAGLSDFALYYIGGIIKHARALNAITNPGTNSYKRLVPGYEAPVKLAYSAKNRSASIRIPYVANPKGRRIEARFPDPLANPYLCFSALMMAGLDGVENKIHPGEAATKDLYHLPPEEDAKVPTVCHSLDQALDCLNADRGFLTKGGVFTDSMLDAYIELKMGEVTRLRMATHPIEFEMYYSL

SEQ ID NO: 5234 - protein, 562 aa, Yarrowia lipolytica CLIB122
MDKSTIEKTEYSGSIVDLPNESLSSTQSASFEDHEAQKEGGHTTKRALKSRHVQLIALGGCIGTGLFVGSGAMLSNSGPASIFIAYIIMSFVIYVVMNALGEMTTYLPLAGAAPPMYVNRFVDDSLAFACGWNYWYAYAILVASEVTAASIVVEYWTDKVPVAVWITIFLVSIVILNIIAVSVFGECEFWFASIKILGIIGLIIVGIVIFFGGAPTHDRLGFRYWKHDAFKEYIVKGDSGRFCGFWNALIRSGFSFILSPELVTISAGETEAPRRNIPKATKRFAYRLIAFYVLGSLVIGVIVSGNDPRLLGAVNSGGEDAAASPFVIGIQNAGIPVLNHIINAVILTSAWSAGNSFLYAGSRTMYSLACHGEAPAVFKRCTPNGVPYLCVAATAAVGCLAFLNVSSGSSEAFTWLSNISTISGFLAWLCVLTAMIRFRKAIWFNHGTFDVLPFKTPFQPWSTWFVLCLVALMCITNGFTVFVGGSFTGSDFVAAYITLPLFAAIYVGHRYIYKRAGFKTPFARPIDEIDITTGLKEAQEVEDMFPERLPRNWLEKVWFWIA

SEQ ID NO: 5235 - protein, 297 aa, Zea mays
  misc_feature (39)..(39): Xaa can be any naturally occurring amino acid
  unsure (1)..(297): unsure at all Xaa locations
MSGHGDTATSAKMAKLKELLQKSENHICADCGASDPKWXVLSVTLDKWSDSEVDSMIEVGGNSQANAIYEAFIPEGYQKPHSDSTQEEREKFIRSKYELQEFLKPSLRIVSHQPSDSGKHAGNASHSDGSKSQVGMIEFIGILNVKVIGGTNLAIRDMSSSDPYVVLTLGQQKAQTSVINGNLNPVWNEELKLSVPQQYGPLKLQVFDHDMVSKDDLMGEAEIDLQTMINAAAAFGDPELLGNIQIGRWLKSEDNALVRDSAVVVSGGKVKQGMALKLQHTESGELELEMEWMPLNV

SEQ ID NO: 5236 - protein, 395 aa, Bacillus halodurans C-125
MELAKRVSTLTPSSTLAITAKAKELKEQGHDVIGLGAGEPDFNTPQYIIDAAVRSMEEGHTKYTPSGGLPKLKEAIIEKFKQDQGLTYTAKEIFVGTGAKHVLYTLFQALLNEGDEVIIPSPYWVSYPEQVKLAGGEPVFVEGKESNDFKLTPAQLEPVLTDRTKAIIINSPSNPTGSLYTQEELAALGEVCLKHNVLIISDEIYEKLVYDGAKHTSVAEISPQLKENTVVINGVSKSHSMTGWRIGYAAGPEALIQAMTNLASHSTSNPTTSAQYGAIAAYTEDDGSVEKMRVAFEERLHTIYDKLVAIPGVSCVKPKGAFYLFPNVEEAAALTGHETVDDFVKVLLEEEKVALVPGSGFGAPDNVRLSYATSLELLEAAIDRIFRFVEAKRSK

SEQ ID NO: 5237 - protein, 483 aa, Brucella suis 1330
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGVLAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKR

SEQ ID NO: 5238 - protein, 283 aa, Triticum aestivum
  misc_feature (87)..(87): Xaa can be any naturally occurring amino acid
  unsure (1)..(283): unsure at all Xaa locations
HYRTSLYKKAGWYRSGIPGISSTHASALAHQPHDHRSARRRERFDSETREWRRRRPSPPPASPPPPRPRSTTTTRTTSSASAAPAAXAQRLVAMAGSGKFFVGGNWKCNGTKVSITKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWENVVIAYEPVWAIGNRKGASPRASEVMPWSDG

SEQ ID NO: 5239 - protein, 371 aa, Acinetobacter calcoaceticus
MSELKDIIAAVTPCKGADFELQALKIRQPQGDEVLVKVVATGMCHTDLIVRDQKYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSFVTWGAGAVGLSALLAAKVCGASIIIAVDIVESRLELAKQLGATHVINSKTQDPVAAIKEITDGGVNFALESTGSPEILKQGVDALGILGKIAVVGAPQLGTTAQFDVNDLLLGGKTILGVVEGSGSPKKFIPELVRLYQQGKFPFDQLVKFYAFDEINQAAIDSRKGITLKPIIKIA

SEQ ID NO: 5240 - protein, 276 aa, Ashbya gossypii ATCC 10895
MSIVSLLGVKVVNNPAKFTDPYEFEITFECLEPLKHDLEWKLTYVGSSRSLEHDQELDSILGGPIPVGVNQVLVTADPPSAELIPASELVSVTVILLSCSYDGREFVRVGYYVNNEYDTEELRNDPPQKVQVDHVVRYILAEKPRVTRFNIVWYIEAEDEYPPEQPGVDDEEVDDEDEDEDEDEEGADEEGADEEGASDGPDAKKRKVQTEDEEDDEAEEIDLEAEEEEDEDEEDEDGDEAEEVDEEEEDDDGEPVGASEGGADTVPTPQDTTESK

SEQ ID NO: 5241 - protein, 180 aa, Coccidioides immitis RS
MSQTKTGRRRRSSSIIYQEPQESIEHTSDQAALPNLNANWVNAKGAWTIHFVLIIALKIFYDIIPGVSQETSWTLTNISYMFGSFLMFHWVRGVPFEFNAGAYDNLNMWEQIDNGDQYTPAKKFLLSVPIVLFLLSTHYTHYDLTYFIINFLAVLGVVIPKLPISHRMRIGWFVEEDEDS

SEQ ID NO: 5242 - protein, 313 aa, Geobacter sulfurreducens PCA
MPFSEPGKTKFQVDLRRHLRNQDISDNLVHLICEIAEASKYVINAVRTGDLGVAGTSNLYGEEQLALDVLSDRIIRKRLIHSGVVCNIASEEMDEIFQAQADADGLYSVAYDPLDGSSLVDVNLAVGTIVSIYEGCNLLQKGRNQVAAMYILYGPRVSLVYSVGKGVHEFTMNHLMEYTLSRENVTMKPDGDIYSPGGLRKKYLPETEKFVQHLESKGSKLRYSGGFVPDINQVLMKGKGIFMYPALNGSPNGKLRVLFELNPMAYLIENAGGAATDGKTPILDIEPQSLDQRAPIFIGCSNDVATAMEFMGG

SEQ ID NO: 5243 - protein, 348 aa, Arabidopsis thaliana
MKATLAAPSSLTSLPYRTNSSFGSKSSLLFRSPSSSSSVSMTTTRGNVAVAAAATSTEALRKGIAEFYNETSGLWEEIWGDHMHHGFCDPDSSVQLSDSGHKEAQIRMIEESLRFAGVTDEEEEKKIKKVVDVGCGIGGSSRYLASKFGAECIGITLSPVQAKRANDLAAAQSLAHKASFQVADALDQPFEDGKFDLVWSMESGEHMPDKAKFVKELVRVAAPGGRIIIVTWCHRNLSAGEEALQPWEQNILDKICKTFYLPAWCSTDDYVNLLQSHSLQDIKCADWSENVAPFWPAVIRTALTWKGLVSRLRSGMKSIKGALTMPLMIEGYKKGVIKFGIITCQKPL

SEQ ID NO: 5244 - protein, 957 aa, Escherichia coli CFT073
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLARAEAAEINLRSDILNAVGITLDETTTRENVMQLFSVLLGDNHGLDIDTLDKDVAHDSRSIQAAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMSGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 5245 - protein, 175 aa, Triticum aestivum
MAPTVMASSATSVAPFQGLKSTAGLPVSRRSNGASLGSVSNGGRIRCMQVWPIEGIKKFETLSYLPPVSTEALLKQVDYLIRSKWVPCLEFSKVGFIFREHNASPGYYDGRYWTMWKLPMYGCTDATQVINEVEEVKKEYPDAYVRIIGFDNMRQVQCVSFIAFKPPGCEESGKD

SEQ ID NO: 5246 - protein, 314 aa, Glycine max
  misc_feature (25)..(25): Xaa can be any naturally occurring amino acid
  unsure (1)..(314): unsure at all Xaa locations
MGANSLSSAESTLDLDEQISQLMQXGPLSEQQVRGLCEKAKEILTDESNVQPVKSPVTICGDIHGQFHDLAELFRIGGKCPDTNYLFMGDYVDRGYYSVETVSLLVALKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 5247 - protein, 93 aa, Prosopis juliflora
MARSFSNLNGLSVLLVNAISRRGFASSSQGFATTAARVGAASMSGKVAKKSVEERVTAEKEAWVPDPVTGYYRPENTKEIDVAELRATLLGKK

SEQ ID NO: 5248 - protein, 267 aa, Triticum aestivum
  misc_feature (175)..(175): Xaa can be any naturally occurring amino acid
  misc_feature (204)..(204): Xaa can be any naturally occurring amino acid
  misc_feature (209)..(209): Xaa can be any naturally occurring amino acid
  misc_feature (214)..(214): Xaa can be any naturally occurring amino acid
  unsure (1)..(267): unsure at all Xaa locations
REQKLELHRGGGRSRTSGSPGLQEFGTRANSAALLHSLLSTAWTPRRRLDRASATRLAPSPGLSCRSSRPTRSVRPMASSTTAARADAAPPGLKEGIAGLYDESSGLWESIWGEHMHHGFYDSGEAASMSDHRRAQIRMIEEALAFAAVPDDPTNKPKTIVDVGCGIGGSSRYLXANKYGAQCSGITLSPVQAERGNAPRGSAXVSGQXSFQLXDLWEQPFPGWAFDLVGRVTHAEQTDLLPAGTLATPRQLSHRDWCIGTRASEDH

SEQ ID NO: 5249 - protein, 344 aa, Oryza sativa (japonica cultivar-group)
MSRSGAMDLASGLGGKITKDEVKSAVDEYEKYHGYYGGKEEARKSNYTDMVNKYYDLATSFYEYGWGESFHFAHRWNGESLRESIKRHEHFLALQLGVKPGMKVLDVGCGIGGPLREIAKFSLASVTGLNNNEYQITRGKELNRVAGVSGTCDFVKADFMKMPFSDNTFDAVYAIEATCHAPDPVGCYKEIYRVLKPGQCFAVYEWCITDHYEPNNATHKRIKDEIELGNGLPDIRSTQQCLQAAKDAGFEVIWDKDLAEDSPVPWYLPLDPSRFSLSSFRLTTVGRAITRTMVKALEYVGLAPQGSERVSNFLEKAAEGLVEGGKKEIFTPMYFFLVRKPISE

SEQ ID NO: 5250 - protein, 837 aa, Arabidopsis thaliana
MDFASSVQRQSMFHGGADFASYCLPNRMISAKLCPKGLGGTRFWDPMIDSKVRSAIRSKRNVSYRSSLTLNADFNGRFYGHLLPAKPQNVPLGFRLLCQSSDSVGDLVGNDRNLEFAKASFNKSSRFFSASFFSSNPDGTATVFGSLVGSVKQQWPKLVLGLALLGAGLTLYSNGVGGNNQLLQQPDVTSTSTEDVSSSTKPLIRQVQKLPKRIKKLLEMIPHQEVNEEEASLFDFLWLLLASVIFVPLFQKIPGGSPVLGYLAAGILIGPYGLSIIRNVHGTRAIAEFGVVLLLFNIGLELSVERLSSMKKYVFGLGSAQVLVTAAVVGLLAHYVAGQAGPAAIVIGNGLALSSTAVVLQVLQERGESTSRHGRASFSVLLFQDLAVVVLLILIPLISPNSSKGGIGFQAIAEALGLAAVKAAVAITAIIAGGRLLLRPIYKQIAENRNAEIFSANTLLVILGTSLLTARAGLSMALGAFLAGLLLAETEFSLQVESDIAPYRGLLLGLFFMTVGMSIDPKLLLSNFPVIVGTLGLLIVGKTMLVVIMGKLFGISIISAIRVGLLLAPGGEFAFVAFGEAVNQGIMSPQLSSLLFLVVGISMAITPWLAAGGQLIASRFELHDVRSLLPVESETDDLQGHIIICGFGRVGQIIAQLLSERLIPFVALDVSSDRVTIGRSLDLPVYFGDAGSKEVLHKIGAGRACAAVVALDAPGANYRCVWALSKFYPNVKTFVRAHDVVHGLNLEKAGATAVVPETLEPSLQLAAAVLAQAKLPTSEIANTINEFRTRHLSELTELCEASGSSLGYGYSRTSKPKPQPSDASGDNQIIEGGTVVI

SEQ ID NO: 5251 - protein, 233 aa, Aquifex aeolicus VF5
MFKNLIWLKEVDSTQERLKEWNVSYGTALVADRQTKGRGRLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 5252 - protein, 221 aa, Petunia inflata
MFRLQLLSALFILLFSLSPVSANFDYFQLVLTWPASFCYPKNFCKRKSNNFTIHGLWPENKHFRLEFCTGDKYSRFKEDNIINVLERHWIQMRFDEKYASTKQPLWEHEYNRHGICCKNLYDQEAYFLLAIRLKDKLDLLTTLRTHGITPGTKHTFGEIQKAIKTVTNNKDPDLKCVENIKGVKELNEIGICFNPAADSFHDCRHSKTCDETDSTQTLFRR

SEQ ID NO: 5253 - protein, 332 aa, Ustilago maydis 521
MSDWLAVPRARLAERVNLGYPEAWPASAPCWLLDAWIAHLSECKQLSENDIKRLCDKAREILLGESNVQPVRCPVTVCGDIHGQFHDLSELFRIGGNSPDTNYLFMGDYVDRGYYSVETVTLLVALKVRYRDRVTILRGNHESRQITQVYGFYDECLRKYGNANVWKYFTDLFDYLPLTALIDDQIFCLHGGLSPSIDTLDHIRSIDRIQEVPHEGPMCDLLWSDPDDRCGWGISPRGAGYTFGQDISEAFNHNNGLTLVARAHQLVMDGFNWSQERNVVTIFSAPNYCYRCGNQAAIMEIDENLKYTFLQFDPAPRAGEPLVSRRVPDYFL

SEQ ID NO: 5254 - protein, 488 aa, Bacillus cereus G9241
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 5255 - protein, 463 aa, Photorhabdus luminescens subsp. laumondii TTO1
MDREFMADQQHSLQRGLEARHIELIALGGTIGVGLFMGSASTLKWAGPSVLLAYIIAGIFVFFIMRSMGEMLFLEPVTGSFASFGHKYLSPYWGCLTAWGYWFMWVAVGISEITAIGVYAEFWFPELPQWVSALIAVALVALANLAAVRLYGELEFWFAMIKVTTIIVMILIGLGLIFFGIGNQWQPIGLDNLTVHGGFFAGDWQGFLFALCIVVASYQGVELVGITAGEAKNPQVTLKKAINNILWRILIFYVGAIFIVVTLFPWTEVGAQGSPFVMTFTKVGITSAAAVINFVVLTAALSGCNSGMYSGGRMLYALAQNRQLPSSLTKLSKNGVPVIGIAITILCLIVGSSLNYLIPNPQAVFVYVYSASVLPGMVPWFVILMSQLRFRQYHQQALKQHSFKSILFPYVNYLTLAFLCCVLVGMAINPDTRFSLLVGGGFLLIVSLIYWLVKLFNGKKPKA

SEQ ID NO: 5256 - protein, 174 aa, Triticum aestivum
  misc_feature (90)..(90): Xaa can be any naturally occurring amino acid
  misc_feature (124)..(124): Xaa can be any naturally occurring amino acid
  misc_feature (140)..(140): Xaa can be any naturally occurring amino acid
  misc_feature (150)..(150): Xaa can be any naturally occurring amino acid
  misc_feature (153)..(154): Xaa can be any naturally occurring amino acid
  misc_feature (158)..(158): Xaa can be any naturally occurring amino acid
  unsure (1)..(174): unsure at all Xaa locations
VLPDGDHDLQRCQYVTEKVLAAVYKALNDHHVYLEGTLLKPNMVTAGHSCPKKYTPQDVAVATVTTLLRTVPAAVPGICFLSGGHREEEXASLHLNAMNQSPLPKPWKLAFSYGRALQASALGXWLGKSENKKAAQEASXKRAHLKIWLXGTXXTLGXMKKLPSHFNASSLETK

SEQ ID NO: 5257 - protein, 552 aa, Pisum sativum
MVAAPISTVKLTDANLHTRFHSSSSSTPSTLSLPLSLHFHFSSHSKRFSSIRCQSVNGEKRKQSSRNVFDNASNLLTSLLSGANLGSMPIAEGAVTDLFDRPLFFSLYDWFLEHGSVYKLAFGPKAFVVVSDPIVARHILRENAFSYDKGVLADILEPIMGKGLIPADLETWKQRRRVIAPGFHTSYLEAMVQLFTSCSERTVLKVNELLEGEGRDGQKSVELDLEAEFSNLALEIIGLGVFNYDFGSVTNESPVIKAVYGTLFEAEHRSTFYIPYWKFPLARWIVPRQRKFQDDLKVINTCLDGLIRNAKESRQETDVEKLQQRDYSNLKDASLLRFLVDMRGVDVDDRQLRDDLMTMLIAGHETTAAVLTWAVFLLAQNPDKMKKAQAEVDLVLGMGKPTFELLKKLEYIRLIVVETLRLYPQPPLLIRRSLKPDVLPGGHKGDKDGYTIPAGTDVFISVYNLHRSPYFWDRPNDFEPERFLVQNNNEEVEGWAGFDPSRSPGALYPNEIISDFAFLPFGGGPRKCVGDQFALMESTVALVCCYRISMWN

SEQ ID NO: 5258 - protein, 134 aa, Zea mays
MDGGGGGGGGGGGVGAGVMVGGGVVPGGGGGDVELVSKTLQFEHKLFYFDLKENPRGRYLKISEKTSATRSTIIVPIDGVAWFLDLFDYYIRTDERDVFSKELRLQTKVLARFLRGWPGSAAGSRAVAANFGVA

SEQ ID NO: 5259 - protein, 481 aa, Propionibacterium acnes KPA171202
MASNGHARVEMKPGDSGSAGATRNSQTSRAVFIAVTAAALGITYGYDISNTAAALQFVQRDFGIYSAINTASVVGQIAGAILGGPMANAIGRKKSMLVIAAGYTIFAILTAISPSAGLFLAMRVLLGITIGLSITVVPVFIAESAPASRRGGLATAYQVTCVVGIILGYLVGYSLLPTDTWRWILGVAAVPAFIVLLMLVRTQETPSWYMLKGREDEARRAMERIEVAELVEPSLDEIRNSLSSRPSGSVWGRLREMFHGGMARATIFAIVLGFSIQITGINATIYYAPGIYSRMGFTDTATTYLVPSLVQFLSLISVVISMLVIDKVGRRFVLITGISTMIVATIVLIVTYLASGFEGAVAGIIGLVGMSLFTMGFTFGFGSIVWVYAGEIFPARYRSLGASLVLTADLIANAITAQLGAAMLDGIGLAGTFGVYGGLLVVALLFLLRYAPETSGRSLEEIQDYWNNGARWPKADSPSMG

SEQ ID NO: 5260 - protein, 116 aa, Crocosphaera watsonii WH 8501
MNQFQSPPVISVEELGIRLDQDPDGLQLIDVREPQEVEIAYIEGFEVLSLSKFEQWSREIAQNFDPHKETLVLCHHGMRSEQMCLWLLNNGFTNVKNITGGIAAYSAKVDRRIPQY

SEQ ID NO: 5261 - protein, 147 aa, Triticum aestivum
  misc_feature (16)..(17): Xaa can be any naturally occurring amino acid
  misc_feature (19)..(19): Xaa can be any naturally occurring amino acid
  misc_feature (24)..(24): Xaa can be any naturally occurring amino acid
  misc_feature (28)..(28): Xaa can be any naturally occurring amino acid
  misc_feature (46)..(46): Xaa can be any naturally occurring amino acid
  misc_feature (54)..(54): Xaa can be any naturally occurring amino acid
  misc_feature (60)..(60): Xaa can be any naturally occurring amino acid
  misc_feature (65)..(65): Xaa can be any naturally occurring amino acid
  misc_feature (71)..(71): Xaa can be any naturally occurring amino acid
  misc_feature (75)..(75): Xaa can be any naturally occurring amino acid
  misc_feature (77)..(78): Xaa can be any naturally occurring amino acid
  misc_feature (81)..(83): Xaa can be any naturally occurring amino acid
  misc_feature (88)..(91): Xaa can be any naturally occurring amino acid
  misc_feature (96)..(99): Xaa can be any naturally occurring amino acid
  misc_feature (103)..(103): Xaa can be any naturally occurring amino acid
  misc_feature (108)..(108): Xaa can be any naturally occurring amino acid
  misc_feature (111)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (124)..(124): Xaa can be any naturally occurring amino acid
  misc_feature (130)..(131): Xaa can be any naturally occurring amino acid
  misc_feature (134)..(134): Xaa can be any naturally occurring amino acid
  misc_feature (138)..(138): Xaa can be any naturally occurring amino acid
  misc_feature (145)..(146): Xaa can be any naturally occurring amino acid
  unsure (1)..(147): unsure at all Xaa locations
PSRKPLPAGGGGRRRXXEXHQKRXGRRXDHEERKRKKEARAGKKNXKEARKGRXAKGKRXAGRGXAEKAQXKKTXKXXDEXXXRQKGXXXXEEGAXXXXGREXEPTQXAKXXSXTXKQKRKEKXGKGEGXXPKXRPGXEEEKGKXXR

SEQ ID NO: 5262 - protein, 511 aa, Oryza sativa
MANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGVASVIKICIVK

SEQ ID NO: 5263 - protein, 395 aa, Musa acuminata
MALQASFLPSALSARKEGKVACTVKESAFLGSSILEHHKSHPVLRTKRESNHSVGVVKAQTTAVAAPGLNQSAVHGKKVLRKGVVVITGASSGLGLAAAKALAETEKWHVVMACRDFLKAEKAAQSAGMAKENYSIMHLDLASLDSVRQFVHAFRQSGRPLDVLVCNAAIYRPTARTPTYTADGYEMSVGVNHLGHFLLANMLLEDLKKSDYPSRRLIILGSITGNTNTLAGNVPPKAGLGDLRGLAGGLDGRNSSAMIDGGAFDGAKAYKDSKICNMLTMQELHRRFHEDTGITFASLYPGCIATTGLFREHIPLFRLLFPPFQKFITKGFVSEDESGQRLAQVVGDPSLLKSGVYWSWNNNSASFENQLSEEASDAVKAQKLWEISEKLVGLA

SEQ ID NO: 5264 - protein, 243 aa, Escherichia coli CFT073
MPTGSESLFLYIMRVKFHTTGETIMTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 5265 - protein, 401 aa, Acidobacteria bacterium Ellin345
MAHMNPTPVLEAGQDKTMVLNMGPQHPSTHGVLRLLLEIDGETIVRIMPDIGYLHTGIEKTCEAKFYQQVVPMTDRIDYLCPMTNNLAYVLAVEKLLGLEIPERAQWIRVLCNELTRINSHLVWLGTGAMDLGAMTVFLYCFREREELLKLFEAVAGQRMMTSYFRVGGVSLEPPLGWFDRVKKFADTFPSKMDEYEGLLTQNPIFVMRTKGVAKITKEDALALGASGPTLRGSGIDFDLRRDMPYSGYDKFKFNVPVKTEGDVYARYQCRIAELRESCKIVQQALAGMPEGSIKADAPKVVLPDREKMKTQMESLIYHFKIVTEGFTVPPGEVYSAIESPRGEMGYYIVSDGTAKPYRVHMRSPSFANLQMLPSMCTGQLLADVVAAIGSIDIVLGDCDR

SEQ ID NO: 5266 - protein, 150 aa, Oryza sativa
RMEQSFIMIKPDGVQRGLIGDIISRFEKKGFYLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 5267 - protein, 735 aa, Thermococcus kodakarensis KOD1
MLVEDLLKNNYLITPSAYYLLSDHYKKAFTLAELIKFAKNRGTFVVDSNLAREFLAEKGIISSGNGALDGSVLSGISVSESPVKPNGEAVLESESDESGAIESSLQEGVEDGVESIAEPSAASVEDVVVAGESSLASEGSSLEDEINTEPELSSSMDDGAEVVQSSEGDETSISTGNALGSVDYGGSDSESEALEEASSGGESFISTGTPEDEALLEESPEGEFPDENGFSDESLPVENGSENGYGDSEEYYENGDNGVKPKIVYGDYGVPIAYVADETPEEEKAYSTYSDLVIAPKEGFHYRAKEIPDEWELAFDVKNVKFEVPKVKNAQSKEGEVIIQAYSSYFKSRLKKMRRIFRENPEIGTIVDIAKLSYVREDDVTIIGLVNEKRETRKGYLFEIEDATGRIKVFIGSDKEGANEAYSTIMPDSVVAFRGTPGKGIFFANRVFLPDVPKFKRSKPPLEEKVYAILLSDIHVGSNKFCEEAFIKFLEWLNGEVNSRTEEELVSRIKYIIIGGDVVDGVGIYPGQYNELAIPDIFDQYEALANLLKQVPDHITMFIGPGNHDAARTALPQPGFYEEYAKPLYKLKNAVIISNPAVIRLHGRDFLVAHGRGIEDVVDFVPNRSHHRPAEAMVELLKLRHIAPTFGNKVPIAPDPEDTLVIESVPDLFQAGHVHVMQYKTYNGVFVINTGTWQAQTEFQKMVNIIPTPARVPIIDVETARLRAVVRFDQFCEGV

SEQ ID NO: 5268 - protein, 407 aa, Triticum aestivum
  misc_feature (28)..(28): Xaa can be any naturally occurring amino acid
  unsure (1)..(407): unsure at all Xaa locations
STHASVIMEPSLKWAANPNITVVADAWXYGLKATVQIVDLQVFASPRITLKPLVPTFPCFANISVSLMEKPHVDFGLKLFGADLMAIPVLYKFVQDTIKKQVGNMYLWPKTLEVPIMDPSKASKRPVGILLVKVVRAQNLKKKDLLGKSDPYAKLKMTDDKLPSKKTSVKRSNLNPEWNEDFKFVVTDPENQSLEVDVFDWEQVGKHEKMGMNRVLLKELPPEETKVLTLNLLKTMDPNDIQNEKSRGQIILEATYKPFKEEDMEKESVDGVDEVQKAPDNTPAGGGLLFVVVHEAQDLEGKHHTNPYAKIIFKGEEKKTKVIKKNRDPRWEDEFEFVCEEPPTNDKLHVEVLSKAGKKGILHGKEALGYIDISLADVISNKRINEKFHLIDSKNGQIQIELQWRTS

SEQ ID NO: 5269 - protein, 262 aa, Thermotoga maritima MSB8
MSWYPGHIEKAKRQIKDLLRLVNTVVEVRDARAPFATSAYGVDFSRKETIILLNKVDIADEKTTKKWVEFFKKQGKRVITTHKGEPRKVLLKKLSFDRLARVLIVGVPNTGKSTIINKLKGKRASSVGAQPGITKGIQWFSLENGVKILDTPGILYKNIFSEDLAAKLLLVGSLPVERIEDQRIFERAFEIFARSIGIESSFSEFFEDFARKRGLLKKGGVPDIERALMLFFTEVAQGKAGRVSFERPEDITPVQQEQTRGV

SEQ ID NO: 5270 - protein, 129 aa, Glycine max
  misc_feature (93)..(93): Xaa can be any naturally occurring amino acid
  unsure (1)..(129): unsure at all Xaa locations
VPPTGRLSFCSFSFPSASGRRRFAAVRASAETMATEKLGIKVERNPPESRLSELGVRQWPKWGCEKSKFPGTYSAKETCYLLQGKVKVYPEGXGEGFVEIAAGDLVVFPKGMSCTWDVAEAVDKHYKFE

SEQ ID NO: 5271 - protein, 482 aa, Streptomyces avermitilis MA-4680
MSILNDVPKQLFIGGTWADAADGATMPVDDPATGEILCHVADAGPKDARLAADAAVEAQDGWARTAPRERSEILRRAYEIIVSRTGELALLMTSEMGKPLAEARGEVAYAAEFFRWFSEEAVRIDGGYGVLPDGRNRMLLMRRPVGPCLLVTPWNFPLAMGTRKIGPAIAAGCTMVLKPAPQTPLSSLALAGILKEAGLPDGVLNVVTTSRAGEVVEPLLTGGRIRKLSFTGSTRVGRLLLAQCADAVVRTSMELGGNAPFIVLDDADLSAAVDGAMTAKMRNMGEACTAANRFFVHRSVADEFGRRLAERMGALVVGPGTRDGVDVGPLIDEAGRAKVEELVADAVERGARVLVGGVAPDGPGRFYPPTVLADVDPGSRLMETEIFGPVAAILVFDDEDEVVRRANDTPWGLVGYVFTQGLDRALRVSERLEVGMVGVNTGLVSNPAAPFGGVKQSGLGREGGRVGIEEFLEYKYLAVPLR

SEQ ID NO: 5272 - protein, 261 aa, Neurospora crassa
MPQNEYIERAQKLHGKRLDTEERARKKAAREGHKQSENAQNLRGLRAKLFAKERHAQKIQMRKAIKQHEERNVKGAPEEKDPSNPVPAYLLDRSNPTSAKALSSQIKSKRAEKAARFSVPIPKVKGISEEELFKVVKTGKKVHKKGWKRVVTKPTFVGPDFTRRPVKYERFIRPMGLRYKKANVTHPTLNVTVQLPILGVKKNPSNPLYTQLGVLSKGTIIEVNVSDLGMVTASGKIAWGRYAQITNNPENDGCLNAVLLV

SEQ ID NO: 5273 - protein, 273 aa, Sinorhizobium meliloti
MSVQTTKRRLSPASIEALKGERPIVSLTAYTTPIARLLDPHVDFLLVGDSLGMVLYGLDTTVGVTLDMMIAHGQAVMRGSERCCVVVDLPFGAYQESKEQAFRSAARILKETGCSAVKLEGGAEMAETVEFLVSRGIPVLGHVGLMPQLVNTTGGYRSVGRNEKEVAKIRRDAKAIDDAGAFAIVVEGTVEPVAREITATLRAPTIGIGASPACDGQILVSDDMLGLFNDFKPRFVKHFAELAPTISKAAEAYANEVKARSFPGIEHTFQVKR

SEQ ID NO: 5274 - protein, 437 aa, Streptococcus suis 89/1591
MIEKVFRDPVHNYVHVDHELIYKLINTKEFQRLRRIKQLGTTSYTFHGGEHSRFSHCLGAYEIARRITQKFEDKYPQIWDTNESLLTMVAALLHDVGHGAYSHTFERLFDTDHEEMTCAIITSPETEINALLKQVSPEFPDKVASVIKHTYPNKQVVQLISSQIDVDRMDYLLRDSYFTGANYGEFDLTRILRVIRPTENGIAFKESGMHAVEDYVLSRYQMYMQVYFHPASRSMEVLLQNLLNRAKLLYTSEQEFFARTSPRLLPFFEHRIRLTDYLSLDDGVMNTYFQSWIDGPDRILSDLAQRYINRKVLKSITFKAEEEEALDRLRSLVADVGFDPEYYTAIHHNFDLPYDIYRPNAEKKRTQIEIYRKDETLVELSSLSPIVHSLSGTIHGDSRFYFPKEMLEETGIFAPQIADFNSHIHNDHFIIGESNEH

SEQ ID NO: 5275 - protein, 561 aa, Bacillus subtilis subsp. subtilis str. 168
MSEWWKEAVVYQIYPRSFYDANGDGFGDLQGVIQKLDYIKNLGADVIWLSPVFDSPQDDNGYDISDYKNMYEKFGTNEDMFQLIDEVHKRGMKIVMDLVVNHTSDEHAWFAESRKSKDNPYRDYYLWKDPKPDGSEPNNWGSIFSGSAWTYDEGTGQYYLHYFSKKQPDLNWENEAVRREVYDVMRFWMDRGVDGWRMDVIGSISKYTDFPDYETDHSRSYIVGRYHSNGPRLHEFIQEMNREVLSHYDCMTVGEANGSDIEEAKKYTDASRQELNMIFTFEHMDIDKEQNSPNGKWQIKPFDLIALKKTMTRWQTGLMNVGWNTLYFENHDQPRVISRWGNDRKLRKECAKAFATVLHGMKGTPFIYQGEEIGMVNSDMPLEMYDDLEIKNAYRELVVENKTMSEKEFVKAVMIKGRDHARTPMQWDAGKHAGFTAGDPWIPVNSRYQDINVKESLEDQDSIFFYYQKLIQLRKQYKIMIYGDYQLLQENDPQVFSYLREYRGEKLLVVVNLSEEKALFEAPPELIHERWKVLISNYPQERADLKSISLKPYEAVMGISI

SEQ ID NO: 5276 - protein, 756 aa, Arabidopsis thaliana
MVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPILGFFFAGVVLNQFGLIRNLTDVKVLSEWGILFLLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 5277 - protein, 272 aa, Xylella fastidiosa
MSIYTNSKPWTVPALAEAKRNGSKIVMLTAYDAGFARILDANGVDLVLVGDSLGMVVQGHDSTLPVSVHDMVYHTACVARGVRQAMLVVDLPFQADASPERALEAATPLLRVGAQMIKIEGAGHKLEVISYLVEREIPVCSHLGLTPQSVLRFGGYKVQGRGEEAGGRLRAEARAAVEAGATLLLLECVPSQLAAQITTDVSVPTIGIGAGAGCDGQVLVLHDLLGLDSGHPRPKFVKDFLAHGGSVAGAVRAYANAVRDGSFPDVEHTYTS

SEQ ID NO: 5278 - protein, 281 aa, Triticum aestivum
MKKNMRLGGRNDVTQQQKTGQEPYRNARKKKANTIAITGCKAQLIVTKKDEKWVITTINLQHNHDLSPHTEVKYLRSHNYMTEEEKLLIRTFNAVKLPTRQIIAILSYLRGGNTPYTKKHVSNVRTAIGKESNQNDMMQVLTYFRKRQAEDPQFYYAFKTTKVSDDASKVLCIFWADGYSRKMYELYGDCLSFDTTFKTNRYTLPFAPFVGVTGHGQNCLFACSIIENETAAPFQWLFETLLHFMGGKSPSPIIPDEDDGMKTTIPIVFPHICHMRCFVSY

SEQ ID NO: 5279 - protein, 312 aa, Pasteurella multocida subsp. multocida str. Pm70
MQNVLALLASYQQLSLAELTALLGYSEQDILHNIEKLKQQGIQIEQQVQHFRLIPQLSRLNESYLTQALAPYPLYIKPIINSTNQFLLDNIAHLEKGAICLAEYQTAGRGRRGRQWLSPFAGQVIMSLYWTCDQKVNLEGLSLVVGMAIAETLKQAGALNIGLKWPNDVLLHGRKLAGILVEIANRQNNQHNLVIGFGINLSFPKQTQQIYQPWAELIEVLPTIDRNKLIAELGKKLIARLQHFEQAGIDEAFRQDWRDMDAYFGEEVHVLTENQKITGIAQGIDKRGYLQLITSEGIQYFNGGEVSLRKAS

SEQ ID NO: 5280 - protein, 902 aa, Arabidopsis thaliana
MKFQEGVFLVVIFFLAYTQLVKGQHQPREDCKLKCGNVTIEYPFGISTGCYYPGDDNFNLTCVVEEKLLLFGIIQVTNISHSGHVSVLFERFSECYEQKNETNGTALGYQLGSSFSLSSNNKFTLVGCNALSLLSTFGKQNYSTGCLSLCNSQPEANGRCNGVGCCTTEDFSVPFDSDTFQFGSVRLRNQVNNSLDLFNTSVYQFNPCTYAFLVEDGKFNFDSSKDLKNLRNVTRFPVALDWSIGNQTCEQAGSTRICGKNSSCYNSTTRNGYICKCNEGYDGNPYRSEGCKDIDECISDTHNCSDPKTCRNRDGGFDCKCPSGYDLNSSMSCTRPEYKRTRIFLVIIIGVLVLLLAAICIQHATKQRKYTKLRRQFFEQNGGGMLIQRLSGAGLSNIDFKIFTEEGMKEATNGYDESRILGQGGQGTVYKGILPDNTIVAIKKARLADSRQVDQFIHEVLVLSQINHRNVVKILGCCLETEVPLLVYEFITNGTLFDHLHGSIFDSSLTWEHRLRIAIEVAGTLAYLHSSASIPIIHRDIKTANILLDENLTAKVADFGASKLIPMDKEQLTTMVQGTLGYLDPEYYTTGLLNEKSDVYSFGVVLMELLSGQKALCFERPQASKHLVSYFVSATEENRLHEIIDDQVLNEDNLKEIQEAARIAAECTRLMGEERPRMKEVAAKLEALRVEKTKHKWSDQYPEENEHLIGGHILSAQGETSSSIGYDSIKNVAILDIETGTLGYLDPEYYTTGLLNEKSDVYSFGVVLMELLSGQKALCFERPQASKHLVSYFVSATEENRLHEIIDDQVLNEDNLKEIQEAARIAAECTRLMGKERPRMKEVAVELETLSVKTTKHNWSDQYREENLHLLGSNIVSSQGDTNSRGYDSVKNVALLDIEAGR

SEQ ID NO: 5281 - protein, 88 aa, Oryza sativa
MAICGAKAAAPSLVVAASMGAVEALKDQAGLCRWDYALRSLYLRAAASSPRLRSPLSNTAAAAARPPAEEAADVRLRKVHHLVCWGPN

SEQ ID NO: 5282 - protein, 256 aa, Novosphingobium aromaticivorans DSM 12444
MSHRPYIVGNWKMNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAGTGEA

SEQ ID NO: 5283 - protein, 228 aa, Ralstonia metallidurans CH34
MLTLTKSTSLPDSTAALAPSDADARPLAERIAQALDAMRDGRPVVLLDDDDRENEADLILAAERLTNSNMAMMIRECSGIVCLCLTPEKVRQLGLRPMVENNRSQYGTAFTVSIEAREGVTTGVSAADRITTIRAAIADEAGLDAVVSPGHVFPLVAVEGGVLARRGHTEGSVELARMAGLSPAAVLCELMNPDGTMARRPEALAFAEMYQLPVLTIADLVAWREINA

SEQ ID NO: 5284 - protein, 258 aa, Pyrobaculum aerophilum str. IM2
MKETWRLVRRVVEDGDIVLEVLDARDPEATRSVEVEKIAEELGKRLLVVLNKADLVEREIAEQWKSYLESRGMNVVYISAKYRLGTRKLITHIRALAPRIPATVVVVGYPNVGKSTIINYLKGRHVAPTSPKPGWTRGEQLVKAKSWLTVLDTPGIVRTKSTGDLALDVIRGLVDPGTVDDPVPYAYALLKRVVKHNPDALKEAYGIESDIDNALVEIGKVKRRLLKGGRINIEEAARIVLKDWIVGKLRYALPPPNV

SEQ ID NO: 5285 - protein, 605 aa, Prochlorococcus marinus str. MIT 9313
MVVSAMFQVPLMAQIDLTRRTKIVATIGPATESAERIRELVEVGATTFRLNFSHGDHDEHAKRISTIRQVSDELGMHIGILQDLQGPKIRLGRFDKGPITLANGDSFALTSKQVQCNQSVATVTYDKLADEVTTGSRILLDDGRVEMKVLKIDQSEQTLHCIVTVGGVLSNNKGVNFPDVQLSVRALTEKDRQDLAFGLQQGVDWVALSFVRNPSDMKEIRKLIRDHGHSTPVIAKIEKFEAIDQIDSILPLCDGVMVARGDLGVEMPAEEVPLLQKDLIRKANSLGIPIITATQMLDSMASSPRPTRAEVSDVANAILDGTDAVMLSNETAVGDYPVEAVQTMATIARRIERDYPQRPIETYLASTISNAISSAVSSIASHLNAAAIVPLTESGATAHNVSKFRPAAPILAVTNKLAVARKLQLAWGVTPLLVPTQKSTTATFSDAIAVAQELGLLKEGDLTIQTAGTLAGVSGSTDLVKVGIVSAVLGQGIGIGNGTVSGKVRFAFSPNDSTKIEPGEILVIHETSDDYLDAIRKSAGVITEQEGEEYHAEMISKRLGIPFIIGIAHATRNLLEGEVVTMQLSNGKVHRGTGGKLPMKLDSMD

SEQ ID NO: 5286 - protein, 141 aa, Aeropyrum pernix K1
MAVQRTLLVVKPDGVERGLIGEVVSRVERKGLKIVAMKMMRLTREKAEEFYSVHRDKPFFGELVEFITSGPVVAMVVEGDEAVSVVRLMIGSTDGRKAAPGTIRGDFSLDIMKNIVHASDSPESFEREFRVLFSESEIVEW

SEQ ID NO: 5287 - protein, 602 aa, Pseudomonas syringae pv. phaseolicola 1448A
MPHEGSLLQAAVVFLLAAVLTVPLAKRLKLGAVIGYLFAGVIIGPSVLGLIGDTESVSHISELGVVLLLFIIGLELSPKRLWVMRKSVFGVGMAQVLLTGLVIGGIALFAFGQSLNTAVILGLGLALSSTAFGLQSLAERKQLNSPHGRMAFAILLFQDIAAIPLIAMVPFLAGADHAMDTGESINHGLRVLGSIAIVVIGGRYLLRPVFRIVAKTKIQEVSTATALLVVIGTAWLMELVGVSMALGAFLAGLLLADSEYRHELEAQIKPFKGLLLGLFFISVGMGANVGLLLSSPLAVLSLTLLLIGIKLPMLFLIGRTAGGLNNRSALQLGLVLAAGGEFAFVVFKIGSAQGLFEAGLYDMLVLTITLSMAITPLLFIALARWIKPRIKPVEVPDEYRDIQTDKPRVVIAGMGRMGQIVARILRAQKIPFIALDTAVESIEFSRSFGNVPVFYGDPLRPEILRAAKVDEAEYFVIATDDPDTNIKTAELIRKLYPHMKIIARARNRQHVHRLMDIGAHAVRETFYSSLEMSRQTLMGLGLTEAQADARISRFKRHDEQVLAAQHEVYDDDAKVLQTAREARADLAQLFEADRLDEEAAKS

SEQ ID NO: 5288 - protein, 336 aa, Streptomyces avermitilis MA-4680
MRELTYTGRNTVEWREAPDPKLQSDQEAIVVPVAATSCDVDSMILAGHGFIDPPFALGHECVGRVVETGDAVTTVAPGDLVVVPWSINCGTCDNCRAGLTAHCTAVPHMAMYGAPIGGSWGGLFSDLVRVPWADAMLVPLPAGLDPVAMASASDNWSLSWRLVAPHLKNKPGARVLVVARGSIGLYVCDIARALGASDILYVDPDPEHREIARGYGAATAETLEPFPHGFDIAVEATGRVDQLALAVKSLAPEGICESAGNHFRPGELPLLDMYLTGVTLRIARDNVRNHIPDALELAASGKVAPERVVSHVLDWEQLPDALPEKHLKPVFVRADS

SEQ ID NO: 5289 - protein, 418 aa, Neisseria gonorrhoeae FA 1090
MANKLRNYTINFGPQHPAAHGVLRMILELDGEQIVRADPHIGLLHRGTEKLAETKTYLQALPYMDRLDYVSMMVNEQAYCLAVEKLAGIDVPIRAQYIRVMFAEVTRILNHLMGIGSHAFDIGAMTAILYAFRDREELMDLYEAVSGARMHAAYFRPGGVYRDLPGFMPKYESSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCADWLRVNPGPVITANHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 5290 - protein, 278 aa, Sinorhizobium meliloti
MAFRRAFTILGCGSSPGVPRITGDWGACDPSNPRNRRMRAALLVEQFAPDGGKTTVVIDTGPDFRAQMIAANVRHIDAVLYTHAHADHLHGIDDLRGFVIENRRRVPIWADAFTMARIRDGFRYCLESPPGSGYPPIVEPYVIPDDLPPLTIHGAGGPISFEPLMQFHGNVHSLGFRIGGFAYCSDVSDFPVETVSKLGGLDLLVIDTLQYKFHPSHLSLVQSLVWINRLQPKRAVLTHMHVPMDYETVCGETPDHVEPAYDMMRLEFDIDRPTVDDA

SEQ ID NO: 5291 - protein, 589 aa, Bacillus subtilis subsp. subtilis str. 168
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPDVNDFFGGDLQGIVDKLDYLEDLGVNGIYLTPIFSAPSNHKYDTLDYFSIDPHFGDPELFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLNGENDPLCRKCMVWEKEKQNQDMLQFMKRLIALRKQENTLLTEGHLEWNLLDDKNDFISFSRTLDEKILIYFFNQGNVVQHVSLRELNIDRNKKICDAWTEQPLQHHDVIAVQPGEFLILSAAAPV

SEQ ID NO: 5292 - protein, 376 aa, Photobacterium profundum SS9
MTEQFIKSKAAIAWGPNQPLSIEEVDVMLPKAGEVLVRIVATGVCHTDAFTMSGDDPEGIFPVILGHEGGGIVEMIGEGVTSVEVGDHVIPLYTPECGECKYCKSGKTNLCQKIRETQGKGLMPDGTTRFYKDGQPIFHYMGCSTFSEYTVLPEISLAKVNKEAPLEEVCLLGCGVTTGMGAVLNTAKVQEGDTVAVFGLGGIGLSAIIGAQMAKASRIIAIDINESKFDLARQLGATDCINPTKFDKPIQDVIVELTDGGVDYSFECIGNVNVMRSALECCHKGWGESVIIGVAGAGQEISTRPFQLVTGRVWRGSAFGGVKGRSELPEIVERYMAGEFKLNDFITHTMGLDDINKSFELMHKGESIRTVIHFNK

SEQ ID NO: 5293 - protein, 367 aa, Arabidopsis thaliana
MEKHEEENGLCKAESVDGSLDVWSCQNSDSSSADHLVVMVHGILGSTDDWKFGAEQFVKKMPDKVFVHCSEKNVSALTLDGVDVMGERLAAEVLDIIQRKPNICKISFVAHSLGGLAARYAIGKLYKPANQEDVKDSVADSSQETPKGTICGLEAMNFITVATPHLGSMGNKQVPFLFGFSSIEKVAGLIIHWIFKRTGRHLFLKDEEEGKPPLLRRMVEDTDDCHFMCATLCPICHKSALRAFKRRVAYSNVGHDHVVGWKTASIRRDSELPKWEDSLNEKYPHIVYEELCKACDMEDIPEGENHSDDIEEEMIKGLSSVSWEKVDVSFHSSRQRFAAHSVIQVKNEDMHIEGADVIEHIIDHFHA

SEQ ID NO: 5294 - protein, 327 aa, Geobacter sulfurreducens PCA
MIQKPNIVILDGYTINPGDNPWTPLEKLGDCTIYDRTPPELRVERAKDADIVLTSKVKLDEATLAALPKLRYISMLATGYNNVDVEAAGKRGIPVANIPAYSTESVVQTTFALLLELAVHVGIHDSAVKAREWVRSPDHSFWKTPIVELDGLTLGIVGYGTIGRAVARVGAAFGMKIMAYAPRVPADLGPVPVRFVSLDELFAGSDVVSLNCPQTAENTGFVNSRLLSLMKPSAFFLNVARGGLVNEVDLAAALHSGKLAGAGLDVVAHEPMSPDNPLLGAPNCIFTPHLAWASLAARRRLMGILAANVATFLAGEPQNVVNSRFLK

SEQ ID NO: 5295 - protein, 541 aa, Crocosphaera watsonii WH 8501
MDRTVKLWTFDGEPLRTLNTNKPVYDVTFSPDDQILIAATGNDLQIWTVEGKLLKTLEEHDAEVYDVEFSNNGQFFLSSSKDKTIKLWNKNGQLLKTFRDHNNTVWEVEWGEDDSYFLSASEDGTIRKWNLDGTVIKTIVAHNSAVMDIEIVPQSKVFFSVGEDKTIKFWSPQGELIDSFDGHQDGILDLAIHPKREFWVSASWDKTVKLWKPNKPLWINYLEHQGEIRGIAFSPDQNRIVTASRDHTLKLWNPQQDSIISLEDHEDGVSTVVYSPDGQFFASGSRDETVRLWNNQGENFRTLEGHTDWVLTVAISPNNQLIASGGLDRTIKLWRKDGTLITTITEHERGVLDLAFSPDGKYLVSSSRDQTIKIWRLDGSLVRNIEGHQAPVRTIAISPDGSKIVSGSRDNTVKVWSWDGELLHTLQEHQERVWDVAFSPNGEMIASGSDDGTVRFWNLDGQLIKTLYSYSSMVRSLAFSPDGQQLAVGSRESMLILWDLNEVLALDELRYGCAWIKDYLEFNASLSESDRRLCDGIKVVH

SEQ ID NO: 5296 - protein, 452 aa, Desulfitobacterium hafniense Y51
MSNQENGMHRGLKNRHIQMIALGGAIGTGLFYGSAATIELAGPAITFSYLIGGLVIFFIMRMLGEMAVDEPVSGSFSHFAYKYWGEFPGFLSGWNYWFNYIVVSMAELTAVGIYINFWFPDIPHWLTALVCLVLVTLLNLISVGTFGEFEFWFAIVKVVAIIGMIVFGLFLIFSGINGEATGFDNLWIHGGFIPNGMIGILFSLVPVMFSFGGIELIGITAGEADNPQKSIPKAINQVMWRILIFYVGALSVLMVLYPWNQVGADGSPFVMIFSKIGIPAAATLLNIVVLTAALSVYNSGVYSNGRMLYSLAMQGNAPKLFAKLNKRGIPVAGVLVSSGITLVGVILNFLLPGKIFTYLMAVAIIAAVITWTTIIIVNLKFRKAKIAQGEGDALHFKTPLHPYTNYFCAAFLVMIVILMAFTESMKMAVLVLPIWLLILWISFKIKKSRESK

SEQ ID NO: 5297 - protein, 480 aa, Roseovarius nubinhibens ISM
MTETAHPTIHPVILCGGSGTRLWPLSRKSYPKQFTALVGDESLFQASARRLSGEGFGAPVVLTGEPFRFIVMEQLAAIESAPRGVLIEPEGRNTAPAVLAAALWLAEVDPEGLMLVAPSDHVIPDGAAFRAAVRAAAPRAAAGDLVTFGIRPTRAETGYGWLELQEPGHAEADAPQPLVRFVEKPDAETAEALLAAGHYLWNGGLFLFSVQGIIAAFEAHAPEMIAPVRAAVAQGEADLGFTRLAAEPWGQVAEDSIDYAIMEKAGNLAVMPFAAGWSDLGDWQAVWQESGPDGAGNVVTDHATALDCEGSLLRSENAAQELVGIGLRDMIAVAMPDAVVVAPRGESQRVKEAVAALKSRKARQATEFPVDHRPWGWFESLVIGERFQVKRIVVKPGAALSLQSHHHRSEHWIVVQGTARVTVDDDVRLVGENESVYIPLGAVHRMENPGKVEMVLIEVQTGSYLGEDDIIRYEDVYARK

SEQ ID NO: 5298 - protein, 179 aa, Pyrus communis
FTQQYQPAVCRSNPTPCKDPTDKLFTVHGLWPSNLNGPHPENCTNATVNSHRIKNIQAQLKIIWPNVLDRTNHLGFWNKQWIKHGSCGNPPIMNDTHYFQTVINMYITQKQNVSEILSKAKIEPLGIQRPLVDIEKAIRNSINKKKPKFKCQNNGGVTELVEISLCSDRSLTQFIDCPH

SEQ ID NO: 5299 - protein, 317 aa, Arabidopsis thaliana
MQLQTQSFALNLLPSPNFAKPIERRELISLKRDPSRPISLRCSVSTTLDTPATASTHKPFPAEVSRSIMELSSVGTLSTLTHDGWPLGVGVRFAVDKDGTPILCLNRSVSPDKRSALHVQLEQCGLRTPQCTIQGSIGRPGDDTVLKRLSATWKEKFGEEVEEDSLYVVAVDRVLQMEDFMEDGIWVASSDYKNASPDPLRDIAEDIVNQINANNMEDIFRFCNVYVDLDFVVSETKMIWMDRLGFDLRVWSPRGVYDVRIPFPMEVTDEKGAKSSFNGMSQLAWEVEKSYCPADFNKVKLLKQVVGSSHSHKGGGQ

SEQ ID NO: 5300 - protein, 288 aa, Lactobacillus plantarum WCFS1
MTKTPTITLNDGRAIPAIGFGTFQIPDDGSTYQAVKEALVIGYRHIDTAVAYFNEDEVGQAIKDSGIPRDQIWVTSKLWLQDYGFDAASRAIDRSLTKLRLDYIDLYLIHQPYGDVPGAWQAMEAAQKAGKLKSIGVSNMTPTLWQKFVPQFETIPAVNQVEFNPYFQQQPLRQLLAAQDVKLEAWAPLGQGNQALFKEPIIQQLAIKYHKDAGQIILRFEHQEGVIVFPKSVHSARIKSNRDIFDFELTSTEMAQLRALDTGKGHHDPDAPGVSEQLLHAFDVHADD

SEQ ID NO: 5301 - protein, 668 aa, Burkholderia vietnamiensis G4
MISPLEMTLLLLLASVVGVVVFRSLNLPPMLGYLTVGILVGPHAFGVAADLERAEHLAEFGVVFLMFSIGLEFSLAKLRAMQRLVFGLGLLQVVATLVLAVVLGALFERWVHIAWQGSVALGGALAMSSTAIVSKMLAERLEIETAHGRNIFGVLLFQDLAVVPLLIVIAAFGAESSKDLAITLGFAAVKIVIALALLLIVGQRFMTRWLNVVARRRSQELFVLNLLLVTLGAAFITDRFGLSLALGAFIAGMLIAETPFRHQVEEDIKPFRDVLLGLFFVTTGMLLDPRVIWEHPLLVLGFFVGQILFKATTIAGLARLFGATPGVAMRTGIGLAQAGEFGFVLLNLILDRHLVDATLLQAILASMLLSMLAAPFLIQNADRIVMRLSSTEWMQQSLQMTRIATQSLKQRGHVIICGYGRAGQNLARMLEQEGIPYVALDLDPDRVSAAATAGESVVFGDAARRESLLAAGIHRAAAVAITYANTPSALRVLHHVHELAPTLPAIVRTVDDADLEKLLAAGATEVIPEIVEGSLMLASHTLVLVGVPMRKVVRRVEEMRDERYSLLRGYFHGADDADDDDHEQVRLQSVPVDARADAVGRSLEELGLYVLGIEVTAIRRHGIRGVEPDPQTKLRASDIVVLRGLPEALAIAEERLSRLRREPPAAVA

SEQ ID NO: 5302 - protein, 475 aa, Arabidopsis thaliana
  misc_feature (88)..(88): Xaa can be any naturally occurring amino acid
  misc_feature (136)..(136): Xaa can be any naturally occurring amino acid
  unsure (1)..(475): unsure at all Xaa locations
MSATLTGSGTALGFSCSSKISKRVSSSPASNRCCIKMSVSVDEKKKSFSLQKSEEAFNAAKNLMPGGVNSPVRAFKSVGGQPVLIDSXVKGSKMWDIDGNEYIDYVGSWGPAIIGHADDEVLAALAEAMKKGTSFXAPCLFENVLAEMVISAVPSIEMGRFVNSGTEACMGVLRLARAFTKKESLTWNAVSLYKQAVALLALGANVTPPGGPPSSSFIYYKATIHTLTAPYNDLEAVEKLFAAHKGEISAVILEPVVGNSGFIPPTPEFINGLRQLTKDNGVLLIFDEVMTGFRLAYGGAQEYFGITPDLTTLGKIMGGGLPVGAYGGRRDIMEMVAPAGPMYQAGTLSGNPLAMTAGIHTLKRLKQAGTYEYLDKITKELTNGILEAGKKTGHPMCGGYISGMFGFFFAEGPVYNFADSKKSDTEKFGRFFRGMLEEGVYFAPSQFEAGFTSLAHTPEDIQLTIAAAERVLSRI

SEQ ID NO: 5303 - protein, 126 aa, Glycine max
MEAVAEGLWGLAEYHEKRGEIGKAVKCLEAICQSDASFCPIVEVKTRLRIATLLLHHSHNVNHAKSHLERSQLLLKSIPSCFELKCRAYSLLSQCYHLVGAIPPQKQVLHKGLELAASVGYEISMK

SEQ ID NO: 5304 - protein, 427 aa, Bordetella pertussis Tohama I
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLTLEFNNLAVVDAAFSQHGAEIACVIVEPVAGNMNLIKPAEGFLAGLRELCTRHGAVLIFDEVMTGFRIGPQGVQGLTGVRPDLTTLAKVIGGGMPVGAFGGRADLMTHIAPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 5305 - protein, 278 aa, Zea mays
SVLMKGSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNITK

SEQ ID NO: 5306 - protein, 404 aa, Neisseria gonorrhoeae FA 1090
MDKFPKSAKLDHVCYDIRGPVHKKALQLEEEGNKILKLNIGNPAPFGFEAPDEILVDVIRNLPTSQGYCDSKGLYSARKAIVHYYQNKGLRDITVNDVYIGNGVSELIAMSMQALLNDGDEILIPAPDYPLWTAAATLAGGTVRHYLCDEENGWFPNLADMEAKITSKTKAIVVINPNNPTGAVYSKEILLEIAELARKHGLIIFADEIYDKILYDGAVHYHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYHQ

SEQ ID NO: 5307 - protein, 325 aa, Bacillus subtilis subsp. subtilis str. 168
MLKPFVFITKPIPEEIEAFIGEHCRYEVWQEDTLPSDVLFEKLKEAEGLLTSGTSGPSINRELLEHAPKLKVVSNQSVGYDNFDIEAMKERGVVGTHTPYTLDDTVADLAFSLILSSARRVAELDRFVRAGKWGTVEEEALFGIDVHHQTLGIIGMGRIGEQAARRAKFGFDMEVLYHNRHRKQETEDSIGVKYAELDTLLEQSDFILLITPLTDETYHMIGEREFKLMKNSAIFVNISRGKTVDEKALIRALQEGWIRGAGLDVYEKEPVTQDNPLLQLDNVTLLPHIGSATAKVRFNMCKQAAENMLAAIQGQTPKNLTREFQ

SEQ ID NO: 5308 - protein, 448 aa, Pyrococcus furiosus DSM 3638
MGKHYIPNSAHKEEMLKEIGFSSIEELFADVPEGFIREFNVPEGKSEYEVFMEMNEILSKNKTVLEMPTFLGAGTYFHYVPAHVKYLIERSEFLTSYTPYQAEISQGMLQALFEYQSLIAELVGLPVVNSSMYDWGSALGEAALMTVRLHRGKRLKFVVPKHTHPERMQVLKTYTRGANLEIVEVKWNDRGQVDLEDLKEKVNDAAGVYVEIPNFFGLLEENIQEIGEIAHEAGAYFVVGVDPTILGVVEAPGELGADIVVGEASYFGSPMNFGGPRAGIFATRNDPKFIRQMPGRIIGMTKDAEGKRAFVMTLQTREQHIRRAKATSNICSNEALVAVAAAIHIASLGPKGMQELGEVILKNTAYLKKRLSEVAEIPFDGVNFKDVLVKFEKPYQEIHEHLLQKNIHGGYYVKPHFPELGESALFAATETTRKEWIDALIDALREVL

SEQ ID NO: 5309 - protein, 429 aa, Bacillus megaterium
MRSYEKSKAAFLEAQQLMPGGVNSPVRAFKSVDMDPIFMERGKGATIYDIDGNKYIDYVLSWGPLIHGHSNDQVVEAVKKVTESGTSFGAPTLIENELAKVVIERVPSIEIVRMVSSGTEATMSALRLARGYTGRNKILKFEGCYHGHGDSLLIKAGSGVATLGLPDSPGVPEGIAKNTITVPYNDLESVQYAFKEFGDDIAGVIVEPVAGNMGVVPPQPGFLQGLRDITSEYGSLLIFDEVMTGFRVAYNCAQGYYNITPDLTCLGKVIGGGLPVGAYGGKAEIMERVAPSGPIYQAGTLSGNPLAMTAGYETLTQLTPQSYDEFIRKADRLEEGLMAAAEKYDVPFTVNRAGSMIGFFFTNEQVINYETAKTSNLDYFAAYYREMANEGVFLPPSQFEGMFLSTSHTDADIEHTIAAAEKAFSKLRG

SEQ ID NO: 5310 - protein, 502 aa, Pyrococcus furiosus DSM 3638
MFRQAKWDEPLIFELSRPGRVGYTLPKPIEDIKVDIPEKLRRKSKLELPELSEPEIVKHYTRLSEMNYGVDSGIYPLGSCTMKYNPKINEEIATHPKVAYIHPYQDERTVQGALAIMWELEQWLKEITGMDRFTLQPAAGANGEFTGVMIIRAYHLDNGEPQRNEMLVPDSAHGTNPASAAMAGFKVIEIPSNENGTIDLEALENAVSERTAGLMLTNPNTLGIFEDEIVEIAKIIHKAGGLLYYDGANLNGILGKIRPGDMGFDIVHLNLHKTFSTPHGGGGPGAGPVGVKEFLKDYLPVPLVSYDEKSGRYYLDYNVPKSIGKVKELYGNFAVLVRALTYLKIMGRDGLREVSEIAVLNANYLTQKLKGTRGYSLPGKELRKHEVVFSAEPMKKETGVKALDVAKRLLDFGMHAPTIYFPLIVHEALMIEPTETVSKEELDAYVEALKRISEEAYTNPEIVKSAPHNTAVKRVDDVLAAKKPIVTWRMYKELKEKGEVDY

SEQ ID NO: 5311 - protein, 493 aa, Candida glabrata CBS 138
MSNSALQVYGGDEITAVIIDPGSYTTNIGYAGTDCPQSILPSSFGEIHEAEESTSEDNTEKTRKTRKVFSEQSIPIPRPDYEVKRVVENGQVCDWDSAVEQWSWALRNELHIESNRGIPAMLTEPLWNSKENRSKSLEILLEGMEFEACYLTATSTAVSFATGRPNSLIVDIGHDIASVTPVIDGMSLSKSTRCNHFAGRFLNKLLTDYLKPREIIPLFEVEQRKPEFKRRSFSYSVADSLYDYANSRGFFQECKETIFQVATTPIAQEKNNQATSTGRTIESPWNEVIEFESNDRYQFAEQLINPLKESVPDDWPVNVAGVVETWRNDYVPMKRNKVGSGNNKEKEGTKESTPLDSNTATPLPESSSTTNENGKRTAEDIKREELPGIVDLISSSISSCDVDIRASLAHNLVITGGSSTIPGLSDRILNELNMKFPALKFRVLATGQSIERQYQSWLGGSILSSLGTFHQLWIGKKEYEEVGSERLLHDRLR

SEQ ID NO: 5312 - protein, 340 aa, Legionella pneumophila subsp. pneumophila str. Philadelphia 1
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 5313 - protein, 171 aa, Oryza sativa (japonica cultivar-group)
MLHSIQGQLTEFRSYEGEEMQIREKIVPLKIDLRINNTVIRDQFLWDIGNLDSDPEEFARTLCDDLNITDPEVGPAIAVSIREQLYEIASQSVSAMREAARVSKKGRRAPEFASNSKAMNNSLDLFKYFGSKGSVVRKRKEWYLYEPVVDVITNEEVGVTDATEEINSRNA

SEQ ID NO: 5314 - protein, 334 aa, Bacillus thuringiensis serovar konkukian str. 97-27
MTKIGINGFGRIGRNVFRAALNNSEVEVVAINDLTDAKTLAHLLKYDTVHGTLNAEVSANENSIVVNGKEIKVIAERDPAQLPWSDYGVEVVVESTGRFTKKSDAEKHLGGSVKKVIISAPASDEDITVVMGVNHEQYDAANHNVVSNASCTTNCLAPFAKVLNEKFGVKRGMMTTIHSYTNDQQILDLPHKDLRRARAAAENMIPTSTGAAKAVALVLPELKGKLNGGAVRVPTANVSLVDLVVELDKEVTVEEVNAAFKAAAEGELKGILGYSEEPLVSIDYNGCTASSTIDALSTMVMEGNMVKVLSWYDNETGYSNRVVDLAAYMTSKGL

SEQ ID NO: 5315 - protein, 349 aa, Oryza sativa
MSRSGAMDLASGLGGKITKDEVKSAVDEYEKYHGYYGGKEEARKSNYTDMVNKYYDLATSFYEYGWGESFHFAHRWNGESLRESIKRHEHFLALQLGVKPGMKVLDVGCGIGGPLREIAKFSLASVTGLNNNEYQITRGKELNRVAGVSGTCDFVKADFMKMPFSDNTFDAVYAIEATCHAPDPVGCYKEIYRVLKPGQCFAVYEWCITDHYEPNNATHKRIKDEIELGNGLPDIRSTQQCLQAAKDAGFEVIWDKDLAEDSPVPWYLPLDPSRFSLSSFRLTTVGRASSRPSVTRTMVKALEYVALAPQGSERVSNFLEKAAEGLVEGGKKEIFTPMYFFLVRKPISE

SEQ ID NO: 5316 - protein, 400 aa, Geobacter sulfurreducens PCA
MPVARIEEAIEDIRQGKMVILVDDEDRENEGDLTMAAEMVTPEAINFMARFGRGLICLTMTTERCDHLQLPLMVSANTSSFGTAFTVSIEAKRGVTTGISAADRAHTILTAVADDAKADDLARPGHVFPLRAKPGGVLVRAGQTEGSVDLARLAGLKPAGVICEIMNDDGTMARMPQLKVFAKEHGIRICTIADLVAYRLKHESLVRRAADVLLPTDFGEFRAIAFENDVDRLEHLALVKGEIRGDEPVLVRVHSECMTGDVFGSLRCDCGSQLHRAMEMIEAEGRGVILYMRQEGRGIGLFNKLKAYALQDEGKDTVEANLALGFKPDLRDYGIGAQILVNLGVRNIRLLTNNPRKLIGLQGYGINIVERVPIEIPPTTTNLDYLKAKREKLGHLLENI

SEQ ID NO: 5317 - protein, 289 aa, Novosphingobium aromaticivorans DSM 12444
MSTTFQLDTSTSRANPTPAPMKRLTIPAIRQRKKDGVTAQPVVMLTAYTARQAQLLDAHCDLLLVGDSLGQVIYGLPSSVPVTLDMMAAHGAAVVRGSYHAAVVVDMPFGSYEASPQQAFESASRLLKETGCAAVKLEGGEAMAETVAFLTNRGIPVMGHVGLTPQAVNVLGGYNARGRSEAEAAKIVGDARSLADAGAFAIVIEGVVEPIAIAITQAVACPTIGIGASAQCDGQVLVTEDMLGMFERVPRFVKIYEDLAGTISGAAARYADEVRARTFPGIEQTYQPK

SEQ ID NO: 5318 - protein, 290 aa, Triticum aestivum
  misc_feature (206)..(206): Xaa can be any naturally occurring amino acid
  unsure (1)..(290): unsure at all Xaa locations
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNVLGFTFGVXQMVLYVFYMNKTPVASEVKEGKEAWKVPAEDHVVVINVGKADKSSCAEVRPVTEMAGAVDVPRRCAAEAAAAPGMDFARSVDVV

SEQ ID NO: 5319 - protein, 577 aa, Photobacterium sp. SKA34
MFELNDNNQKKGANYVAGVRHFFPSAIIDEEWQTDNQVTITVKMTSLIEVMKWLYYDQGGWLTVTFGNDERSLNGHFAVYHALSMEGEVKSWVTVKVLVDANSQEFISITPTIPAAVWGEREIRDMYGLRPVGLPDERRLVLPDDWPEDLHPLRKDAMDYRQRPQPTTETETYQFDNQLGDDSNRIVPVGPLHITSDEPGHFRLFVDGEDIVDADYRMFYVHRGMEKLAETRMGYHEVAQLTDRVCGICGFTHSVGYSNTIENALSVDVPFRAKMIRTVLLEVERLHSHLLNIGLSSHFVGFDSGFMQFFRVREKTMELAEILTGARKTYGMNLIGGVRRDFLKEQRLKGIALVKEVRKTFTELVEVLLATPNIESRIAGVGILSKQVARDYSPVGPLIRASGFNRDVRTVHGQSLESYGDVPMELQTMDGGDVQSRVMVRIREVFDSLNIVEYGLDHLPPGAILTESFDYVPNKFALGFTEAPRGENVHWSMTGDNQKLFRWRCRAATYANWPTLRYMLRGNTVADAPLIIGSLDPCYSCTDRVTIVDTKKKRSKTIPYKAIEQYSIDRKNSPFKL

SEQ ID NO: 5320 - protein, 411 aa, Rhodospirillum rubrum ATCC 11170
MSNLSLPKDKIRVVLFENIHDSAVEYFHSRGYHNIERLTGALDGEALKDKIRDAHMVGIRSRTRLTRDVLESAEKLMAVGCFCIGTNQVDLDAAELLGIPVFNAPYSNTRSVAELVVAEAVMMMRDIPRRNWDTHEGGWNKAATGCHEVRGKTLGIVGYGHIGTQVSVLAESMGMSVRYFDIVEKLAIGNAQPCATLNELMAVADVVTLHVPDTADTRDMIRAPQIAAMKDGAYLINASRGKVVDIDALAEALTAGKLRGAAVDVFPKEPASLGDPFESPLRGMRNVLLTPHIGGSTEEAQMGIGREVAEKLVKYSDDGSTLGAVNFPEVALPQQASVTRFLHIHRNVPGVMSALNEVFSSHHINIRGQYLMTNPRVGYVVVDVEKDLKAGEGFRQALAAINGTLRFRFLN

SEQ ID NO: 5321 - protein, 412 aa, Paracoccus denitrificans
MDGDIRKNSLDDGSMDALTGEQSIRNFNINFGPQHPAAHGLLRMVLELDGEIVERADPHIGLLHRGTEKLMESRTYLQNLPYLDRLDYVAPMNQEHAWCLAIERLTGTVIPRRASLIRVLYSEIGRILNHLMGVTTGAMDVGALTPPLWGFEAREELMIFYERACGARLHAAYFRPGGVHQDLPPDLLDDIEEWCERFPKLVDDLDTLLTENRIFKQRLVDIGIVTEADALDWGYTGVMVRGSGLAWDLRRSQPYECYDEFDFQIPVGRNGDCYDRYLCRMAEMRESCKIMQQAVQKLRAEPAGDVLARGKLTPPRRAEMKRDMESLIHHFKLYTEGFKVPAGEVYAAVEGPKGEFGVYLVADGTNKPWRAKLRAPGFAHLQSIDWMSRGHMLADVPAIIATLDIVFGEVDR

SEQ ID NO: 5322 - protein, 124 aa, Zea mays
  misc_feature (11)..(11): Xaa can be any naturally occurring amino acid
  misc_feature (18)..(18): Xaa can be any naturally occurring amino acid
  misc_feature (40)..(41): Xaa can be any naturally occurring amino acid
  unsure (1)..(124): unsure at all Xaa locations
MAYSMLSSAAXCYLPGSXHMVAPFTGLKSSSAFPVTGRAXXDLTLLVSNGEKVNWMEGGPQLGKKNFETLFLTFRDLYPKFKLGGGEGEKLFSPKKGGVPLGGEEIPRGGEHPFFFFGPRGETQ

SEQ ID NO: 5323 - protein, 469 aa, Zea mays
RDSRVAKTKANRGAPSLSAASSSRATTTTTTIPNPGHPPPPAAEDATTNTRRTPPQDPTPIPVPPRPPAAPRAVRPPTPPTPSNGHRATGINVLCGVGILSTPYAIKQGGWLGLVILCLFAILAWYTGVLLRRCLDSKEGLETPPVRGHAAFGATGRIAISIILYVELYACCIEYLILEGDNLSKLFPNAHLSVGSLTMNSHVLFTILTTIIVMPTTWLRDLSCLSYLSAGGVFASILGVICLFWVGVVDNVGFENKGTALNLPGIPIAIGLYGYCYSGHGVFPNIYSSLKKRNQFPSILFTCIGLSTILFAGAAVMGYKMFGEATQSQFTLNLPENLVVSKIAVWTTVANPITKYALTITPLTMSLEELLPPNQQKYSNIVMLRSALVVSTLLIALSVPFFGLVMALVGSLLTMLVTYILPCACFLAILRRKVSWHQVAVCSFIIVVGVCCACVGTYSSLSKIIQNYT

SEQ ID NO: 5324 - protein, 121 aa, Synechococcus sp. WH 5701
MAESGGEVERRSERPWGWFEILISAKGYLIKRLWLHPSSRISLQRHHHRSEHWVVVEGDGVLECEGGQLSASPGVTLTIPKRAVHRASAGEQGLMIVEVQRGDDLNDDDIERFADDYGRLG

SEQ ID NO: 5325 - protein, 273 aa, Pseudomonas aeruginosa UCBPP-PA14
MSTPRIAFIGAGNMAASLIGGLRAQGVPAAQIRASDPGAEQRAKIAGEFAIDVVESNAEAVADADVVVLSVKPQAMKAVCQALAPALKPEQLIVSIAAGIPCASLEAWLGQPRPVVRCMPNTPALLRQGASGLYANAQVSAAQREQAGQLLSAVGIALWLDDEAQIDAVTAVSGSGPAYFFLLMQAMTDAGEKLGLSRETASRLTLQTALGAAQMALSSEVEPAELRRRVTSPNGTTEAAIKSFQANGFEALVEQALNAASQRSAELAEQLGQ

SEQ ID NO: 5326 - protein, 501 aa, Ashbya gossypii ATCC 10895
MESRLGWLTRLNYDTGSALRRTSIIGTIGPKTNNPETLVELRKAGLNIVRMNFSHGSYEYHQSVIDNARKSEELYPGRPLAIALDTKGPEIRTGTTVDNVDYPIPPNHEMIFTTDDQYAKSCDDKVMFVDYKNITKVIEKGRVIYVDDGVLSFEVLEVVDDKTLKVKSLNAGKICSHKGVNLPGTDVDLPALSEKDKSDLRFGVKNGVHMVFASFIRTAGDILTIREILGEDGKDIKIIAKIENQQGVNNFDEILKVTDGVMVARGDLGIEIPAPQVFAVQKMLIAKCNLAGKPVICATQMLESMTYNPRPTRAEVSDVGNAVLDGADCVMLSGETAKGIYPINAVKTMAETALIAEQAIPYVPTYDDLRNLTPKPTPTSETIAAAAVAATFEQKAKAIVVLSTSGDTTRLVSKYKPNVPIVMVTRNPRAARYCHLHRGVFPFVYEQEAADEWTDDVEARLNFGVEKSKELGILSEGDTIVTIQGFASGVGHSNTLRVLTV

SEQ ID NO: 5327 - protein, 104 aa, Triticum aestivum
  misc_feature (6)..(6): Xaa can be any naturally occurring amino acid
  misc_feature (18)..(18): Xaa can be any naturally occurring amino acid
  misc_feature (63)..(63): Xaa can be any naturally occurring amino acid
  misc_feature (73)..(73): Xaa can be any naturally occurring amino acid
  unsure (1)..(104): unsure at all Xaa locations
WTQIRXTPGMACAAFQGXFFIVGQKFSETRTHNEDMNYSRAGNMLNQLGLQNYEKNFKKGLLXTDETLPLLQXKAHFRDVNIPPGPRLVILEHIRREPGLTKSN

SEQ ID NO: 5328 - protein, 246 aa, Triticum aestivum
  misc_feature (199)..(199): Xaa can be any naturally occurring amino acid
  misc_feature (227)..(227): Xaa can be any naturally occurring amino acid
  unsure (1)..(246): unsure at all Xaa locations
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLSTLTEKEXEDILGWGVPKGLDMNGLELVRKGIKLVXTVRHFFGQHAKGLKLMSKG

SEQ ID NO: 5329 - protein, 390 aa, Geobacillus kaustophilus HTA426
MKPQTRKTYVSKTVAGLKPSGIRRFFDLASSMDGVISLGVGEPDFVTSWSIREASILSLEQGYTSYTANAGLLELRQEIAAYLRRKFHVDYCPETEILVTVGASQAIDLALRAIINPGDEVIIVEPSFVAYEPLVVLAGGKPVAVHTSGEDKFQLNPVHLERAITERTKAVIICSPNNPTGTVQSRTELEAIARLAEAHDLLVIADEIYAELTYEGEYTSMAAVSGMRERTILISGFSKGFAMTGWRLGFAAAPDEILQAMLKIHQYAMMCAPTMAQYGALEALRSGERDVAEMRNSYRRRRNYFVASLNEIGLPCHLPGGAFYAFPSIKPTGLTSEQFAERLLIEEKVAVVPGNVFGQSGEGYIRCSYASSLEQLQEAIKRMKRFLARL

SEQ ID NO: 5330 - protein, 59 aa, Zea mays
DAWAAKETCYLLQGKVKVYPEGHGEEFVEIAAGDLVVFPKGMSCTWDVAEAVDKHYNFE

SEQ ID NO: 5331 - protein, 468 aa, Escherichia coli CFT073
MEGIMPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 5332 - protein, 634 aa, Prochlorococcus marinus str. MIT 9313
MEVGMVLKQSDGLKTAVARSADNRYSAASNLRNVRGWRARGTFHCLHRTPADRTGVDNEPSTFIPKALRTSPIPAESVEIRFDEISDALAAIRNGECVVVVDDERRENEGDLICAAQFATPEQINFMATEARGLICLAMQGSRLDQLDLPLMVDRNTDANQTAFTVSIDAGPEKGVSTGISAEDRARTIQVALHPETRPRDLRRPGHIFPLRASQGGVLKRAGHTESAVDLSQLAGLAPAGVICEIQNSDGSMARLPQLQNYARRWGLKLINIADLIRYRLENERFVYRQATADLPSLFGSFQAIGYLNGLDGSEHIALVKGDPRKLKEPVLVRMHSECLTGDAFGSLRCDCRPQLEAALARIEQEGEGVVVYLRQEGRGIGLINKLKAYSLQDGGLDTVEANESLGFPADLRNYGVGAQILTDLGIHRLRLLTNNPRKIAGLGGYGLQVESRVPLVICPGDHNAAYLAVKREKLGHLIDAGKSENKAPEVGPFVVVAWDGEVNGETLAKLRTRAHDWAKSNELELIAESSPRLLALWDRPLFVWRVCPRVKTSSEVSSDPLKKASLELLLQELIQWSGSRRIGLLRTDRAEQAMHPPQDLKREERSLATLFKDDFSPLKDWDATSFPNLILWS

SEQ ID NO: 5333 - protein, 477 aa, Neisseria gonorrhoeae FA 1090
MNEYSQLIKHPDISLSPISDGIGVGNPATGEILAYVRNTGSDKLKNLIQKAAAAQKLWAAKTALERADILWRWYFLVKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALAVLAYEAGVPQDLLPVVSGRASEISHEFATNPTVRKISFTGSTEVGAKIFAGSAADIKKLSLELGGNAPFIVFDDADLDKAVEGALASKFRNSGQTCVCTNRVYVQSGIYDVFCRKLSEKAAALKLGDGLDEGVNQGPLIEEKAVEKVEQHIADALSKGAVCLTGGKRSALGGTFFEPTVLSGVTAQMAVAREETFGPLCPVFRFETEAEVIEAANNTEYGLAAYLFTSDTARQWRVGEVLEYGMVGINTGLISNEAAPFGGVKRSGLGREGSKYGADEYLELKYLCIDAG

SEQ ID NO: 5334 - protein, 468 aa, Oceanicola granulosus HTCC2516
MSNADVLKLIEDEDVQYVDVRFTDPRGKLQHVTIDVSQIDEDFLEEGFMFDGSSIAGWKSIDQSDMKLMPDTDSAYIDPFYAEKTLCLHCTVVEPDTGEPYNRDPRGTALLAEAYLKSSGIGDAAFFGPEAEFFLFDDVRFAVTTNKVSYQVDAIDASWNTDTEYEMGNTGHRPGVKGGYFPVNPIDDAQDIRSEMLSTMKKLGMKVDKHHHEVASCQHELGLVFDSLTKQADEIQKYKYVIHNVAQAYGKTATFMPKPIAGDNGTGMHVNMSIWKDGKPLFAGDKYADLSEEALWFIGGILKHAKALNAFTNPSTNSYKRLIPGFEAPVLRAYSANNRSGCVRIPWAESPKAKRVEARFPDPSANPYLCFAALLMAGLDGIKNKIDPGPASDKDLYDLPPEELAGIPTVCASLREALEELEADHDFLLVGDVFTRDQIEGYMGLKWEEVYAYEHTPHPIEFKLYYSC

SEQ ID NO: 5335 - protein, 221 aa, Triticum aestivum
  misc_feature (33)..(33): Xaa can be any naturally occurring amino acid
  unsure (1)..(221): unsure at all Xaa locations
KWLAVQGTLHCCRFLHAEDKHAAYAYQLLFVAXVGFNAVDDLKAMLCLIYPSLCNFIVFNQADDVAGVISSKAGLKYVGPDVDAMKAVADAYSKRSLKYFETALGDYKAQLEEDPIVHRHLSSLYDTLLEQNLCRLIEAYSRVEIAHVAEMIELPIEHVEKKLSQMILDKKFAGTLDQGAGCLIIFEDAKTEAIFPATLETISNVGKVVESLYMRSAKIMA

SEQ ID NO: 5336 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCTFVRQTIADLSSKEVSEATRIQYGGSVKPNNIKEYMAQTDIDGALVGGA

SEQ ID NO: 5337 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCAFVRQTIAGLSSKEVSEATRIQYGGSVKPNNIKEYMAQTDIDGALVGGA

SEQ ID NO: 5338 - protein, 650 aa, Neisseria gonorrhoeae FA 1090
MNEFSLAPIVVVLLVSVITVILCRKFNIPSMLGYLLVGFLAGPGMLSLIPKSHATDYLGEIGIVFLMFSIGLEFSLPKLRAMRRLVFGLGGLQVGVTMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPELEQAATAAVLLSMIIAPFLLGGSDALVGRLVKSSWDMKSLDLHSMLVEAMSKSDHVLIVGFGRGGQTVGRVLAQEDIPYFALDLDIARVQVARSAGEPVSFGDAKRREVLEAAGLGRAKMVVVTLNNMHETQHVLDNVLSMHPNMPVYARATNDDYVKTFTDMGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKKRNYLF

SEQ ID NO: 5339 - protein, 134 aa, Staphylococcus aureus
HETDEEINKKAHAIFKHGMTPIICVGETDEERESDKANDVVGEQVKKAVAGLSEEQLKSVVIAYEPIWAIGTGKSSTSEDANEMCTFVRQTIADLSSKEVSEATRIQYGGSVKPNNIKEYMAQTDIDGALVGGA

SEQ ID NO: 5340 - protein, 524 aa, Colwellia psychrerythraea 34H
MDFIWILFAFICGLAAKTISLPPSIGFLAAGFILNIAGYQADESLSVLSDLGITIMLFTIGLKLNVKNLFKTEVWLGCSLHTLLWIVVTITFVKLLALMSVNYFSDLDLMTAALIAFALSFSSTVCVIKLLEENGEMRTRHGKLAISILVIQDIIAVAFLVFATGKIPSVWAFSLLGLFLIKPLINRVINHVGHGELITLMGFFLALGSYELFELVNIKGDLGALLVGMFLASHIKATEINKALMNFKDIFLIGFFLSIGFTAIPTLEMLGLATLLILLVPIKFLMFYGIFTLLKIRCRTAFLSALSLSNFSEFGLIVGALSVSSGWLSNDWLVILALSMAISFILTNIIYRFAHTIFTEHRGFLSRFERQTKLEEDNFSQPCQRPIVIIGMGRVGMGAYQAINSHGTSPAWGLDADKEKITWLNSKGMQAYYGDAEDIYFWESIDLSQLELVLLALPSVQDIINITKQLTAANYKGKIAAVARYDDERKQLEAFGIDKVFNFYTEAGVGFAEESLALLPKNMR

SEQ ID NO: 5341 - protein, 249 aa, Xanthomonas campestris pv. campestris str. ATCC 33913
MTRKLVLLRHGQSQWNLDNRFTGWVDVDLTEQGRQEAAAAGKLMKDEGLQFDVAYTSVLKRAIHTLQGALKELDQDWLPVHKSWRLNERHYGGLQGLDKAETAAKHGEEQVKIWRRSYDIPPPAMDVTDPGHPGHDRRYATLDRNALPGTESLATTLVRVLPYWHDAIAPQLKAGQTVLVTAHGNSLRALYKYLNDISNAQILELNIPTGIPLLFELDDNLQVQSYRYLGDPEAAKRAAEAVANQGKAK

SEQ ID NO: 5342 - protein, 549 aa, Mycoplasma mobile 163K
MKLLKWQDKIIYQIFPRSFFDTSNDGNGDIKGIIKKLNYLSWLGVDALWLCPVYETEFADAGYDVLDYYKVWEKFGTLKDFKTLIKKAKELNIEIIMDIVLNHTSTSHEWFKKAIEDPTSKEFNYYIWQDKATDEKSIFGSSAWEYVPSIKKYYFHLFSISQADLNWENPATIDAMADVINYWYTLGVKGFRLDAIQHIHKDFSEKDTSFFSFGKKMTSLLQDLKSKIDKEDIFLIGESSGIQPELIPNWTEGKNKIVDNFFNFSWWWIGWNQISGRNGYNPDWSFKDFYSKQFIEYQESNKILDNAFTVFWSNHDTSRALSRWGNENIFWEESAKTLALFQFTLKGLMCIYYGEEIGMLNTFFDSKEELRDVDAINSFSFWVDEKKYYTENEMLRAHNINSRDNTRTPMLWDEKQVNFGFSKAKNTWIKLNQNSKNTSVEKQIKNPNSILNFYRKLIQLRKDSKFKNILLFGTSKVQTFNNFEVSSITREFNGEKIISYINLSSHSHSIVFPKNAEIILSSYSEQPFKIDYLRAYESIMFYTNEKKND

SEQ ID NO: 5343 - protein, 548 aa, Pseudomonas fluorescens
MQDWQHSVIYQIYPKSFHSHAGNATGDLLGIVDKLDYLQWLGVDCLWITPFLRSPQRDNGYDISDYYAIDPSYGTMADCDLLIGEAAKRGIKLMLDIVVNHTSIEHEWFQQARSSLDNPYRDFYIWRDQPNNWESKFGGSAWEYEAQTGQYFLHLFDHTQADLNWDNPKVRAEVYKLMCFWRDKGVGGFRLDVINLISKPADFPEDNSDGRRFYTDGPHVHEYLQEMHREVFEGHDLINVGEMSSTSLEHCIRYSRPESKELSMTFNFHHLKVDYPNLQKWVRADFDFLQLKQILSDWQLGMQAGGGWNALFWCNHDQPRVVSRFGDDGEYRVVSAKMLATALHFLQGTPFVYQGEELGMTNPGFDQIGQYRDVETLNIYRLKRDAGESQASSMAAIMQKSRDNGRTPMQWNGQANAGFSSGEPWIGIPANAAQINVQSQLDDPDSVLHHYRALIALRRLEPLIQQGVYRQLLCDHAKVWAYLREGHGERLLVLNNFYGQPCEIQLPGQVISAASAQRLLISNYPDCPVRTDSITLRPYESFVLHLTD

SEQ ID NO: 5344 - protein, 484 aa, Alkalilimnicola ehrlichei MLHE-1
MPLPRRTKIIATLGPASDGPQMATRLVKAGIDLVRINFSHGTVDDHRRRVEAVRQAAREAGREVGVLADLQGPKIRIEGFRNGAVDLEEDAPFTLDTALDKDAGDTERVGVAYPQLVRDVEPGDVLLLDDGRVLLKVESVSDTAIHCRVATGGRLSNRKGLNRLGGGLSAEALTDKDEADIRTAVELGADYLAVSFVREAADVERARELLQAAGGNAGIIAKIERAEALDCQTEIIQAADAIMVARGDLGVEIGDAALPQVQKQLIHQARDLNRVVITATQMMESMIESPLPTRAEVFDVANAVLDGTDAVMLSAETAAGEYPDAAVAAMDRVCREAEKSRAATESGHRLECRFGSSEEAVAMAAMYTANHLPVKAIIALTESGTTALWMSRIRSGIPIYALTRHPETQGRVTLYRGVYPIAFDPTQGDADSVRQRLVQTLREKRLVTEEDHLVLTFGSRMGVAGGTNTMKVVKVGDLLNGTGH

SEQ ID NO: 5345 - protein, 686 aa, Desulfurococcus mucosus [sequence omitted]

SEQ ID NO: 5346 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTIVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 5347 - protein, 267 aa, Geobacter sulfurreducens PCA
MNRAKTILDIQKMKATGEKITVLTSYDYPFTRIMDECGIDMILVGDSVGVVFAGHDNTLPVTVDDMLYHTRAVTRARPKALVVTDMPFLSYQTDLRDARINAGRLVKEGGAEAVKLEGGAHVTDTIRAIVDMDIPVMAHIGLTPQSIHRMGGYKVQGKKDEQAQRLLEDALAVQEAGAFAVVLEGIPLKLAGRITAELSIPTIGIGAGPHCDGQVLVIHDILGLCEKYSPKFVKRYGDARTLISDAVASYISEVKKGEFPTEGHSFS

SEQ ID NO: 5348 - protein, 90 aa, Nostoc punctiforme PCC 73102
MEIQIEHQPRQERLNELGVYKWDIWRKEVSKFPWTYDSQETCYFLEGDVVVTPDGRQPVQMGKGDLVIFPAGMSCIWEITSDVKKHYYFD

SEQ ID NO: 5349 - protein, 256 aa, Streptococcus pyogenes MGAS8232
MKIGIIGVGKMASAIIKGLKQTPHELIISGSSLERSKEIAEQLTLPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGMPKAKALEIVTQTVLASASNLKTSSQSPHDFIDAICSPGGTTIAGLMELERLGLTTTVSSAIDKTIDKAKSL

SEQ ID NO: 5350 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLRHPNVVLFMGAVTRPPNLSIISEFLPRGSLYRILHRPNCQIDEKQRIKMALDVARGMNCLHASTPTIVHRDLKSPNLLVDNNWNVKECDFGLSRLKHNTFLSSKSTAGTPEWMAPEVLRNEPSNEKCDVYSFGVILWELATLRLPWSGMNPMQVVGAVGFQNRRLEIPKELDPLVARIIWECWQQDPNLRPSFAQLTVAFKPLQGLVIPSHQDQVASPLPQEISVNSTP

SEQ ID NO: 5351 - protein, 168 aa, Zea mays
MGKSGKKTKESHRQGRGRRGSQLGDDDLPSSAYDAPPRRQEDSDGDDSDEATAEGEHDGGAEEGDLQGQWQVGSMPSKFHLYQLSVQSPKGDISYLQKFFLMYVGGRVPLHLQEDFCGTALLSTEWLRTDTRRTAVGLDFDRESLEWCLENNLSKIGADGYSRLLLFN

SEQ ID NO: 5352 - protein, 543 aa, Synechococcus sp. WH 7805
MNAVDRLAGHHKQRLSVAPVVLAILDGWGDCDGSDFNAIRSAETPVMDALKHAYPNTLIQASGSHVGLPDGQMGNSEVGHLTIGAGRIIRQELVRIGDTVRTNQLPAVPALRSLAERLRESGRTLHLFGLCSDGGVHSHVDHLCGLLRWAAAEGIQTVAIHAITDGRDTPRQSAPRYIHAIEEAMQASGIGEIVSLCGRYWAMDRDQRWERTSRAHSLLTDPEFPVSTESPTAVLEASYAAGTTDEFLEPTRLSACHVQEGDSLLMFNFRPDRARQIIQSLTLEDFEGFSRPHHPKLDVVTFTQYESGLPVKVAFPPESLDDLLGQVVAADGLKQYRTAETEKYPHVTYFMNGGIEQPLEGEDRHLVPSPRVATYDQAPAMAAETLTDSCIAAIEKGVYSLVVINYANPDMVGHTGVMEAATKAIETVDHCIGRLLDAVGRAGGTLMITADHGNAECMRGDDGQAWTAHTTNPVPVILVEGEKRKMVGMGNSLRLRNEGGLADIAPTLLQLLGLEKPDAMTGHSLIEAIDAAAPSTARLPQPV

SEQ ID NO: 5353 - protein, 134 aa, Staphylococcus aureus
HETDEEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 5354 - protein, 394 aa, Zea mays
NFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDD

SEQ ID NO: 5355 - protein, 527 aa, Zea mays
MHSTNLLLEEPIRMASILEPSKPSYFPAMTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRHAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFSMLADPRHPAESTSNTNESVLKVALDHGKACGVIKSHDRVVVCQKVGDSSVVKIIELDD

SEQ ID NO: 5356 - protein, 489 aa, Arabidopsis thaliana
MTETGLILMWFPLIILGLFVLKWVLKRVNVWIYVSKLGEKKHYLPPGDLGWPVIGNMWSFLRAFKTSDPESFIQSYITRYGRTGIYKAHMFGYPCVLVTTPETCRRVLTDDDAFHIGWPKSTMKLIGRKSFVGISFEEHKRLRRLTSAPVNGPEALSVYIQFIEETVNTDLEKWSKMGEIEFLSHLRKLTFKVIMYIFLSSESEHVMDSLEREYTNLNYGVRAMGINLPGFAYHRALKARKKLVAAFQSIVTNRRNQRKQNISSNRKDMLDNLIDVKDENGRVLDDEKIIDLLLMYLNAGHESSGHLTMWATILMQEHPMILQKAKEEQERIVKKRAPGQKLTLKETREMVYLSQVIDETLRVITFSLTAFREAKSDVQMDGYIIPKGWKVLTWFRNVHLDPEIYPDPKKFDPSRWEGYTPKAGTFLPFGLGSHLCPGNDLAKLEISIFLHHFLLKYRVERSNPGCPVMFLPHNRPKDNCLARITRTMP

SEQ ID NO: 5357 - protein, 469 aa, Sinorhizobium meliloti
MTTANEVLKQIKENDVKFVDLRFTDPKGKLQHVTMDVVCVDEDMFADGVMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFPDPTANPYLAFAAMLMAGLDGIKNKLHPGKAMDKDLYDLPPKELKKIPTVCGSLREALESLDKDRKFLTAGGVFDDDQIDSFIELKMQEVMRFEMTPHPVEFDMYYSV

SEQ ID NO: 5358 - protein, 469 aa, Mycoplasma mycoides subsp. mycoides SC
MFGSMTDFNNLVNQAKKRNIYIMMDMIFNHCSTEHEWFLKALTNKKYQKRFIFVDNKNKLPNNWTSKLGGSVWEYNKTLDKYYLHLFDKTQADLNWKNKALRNDIFKIINYWLDKGVKGLRFDVINLISKPKTFKDDLIGDGRKYYTDRPLVHKYIKEMASKTYSLKSDVITVGELSSTSLKQAILYTKKESKELDMAFLFHHLKVDYLNNDKWQLDKYDPKKLVKVLKTQQIAFQKNNAWCANFLNNHDQPRAISRFGDYKNYYYQSATSLASVVLLLKGTPYLYQGEEFGMLNNNYSNINQLKDVESINYYKILKNKGLEKEEILNIISNRSRDNARTVMQWDDSLYAGFSSHKPWIDVNNNYLDINFKKDYSKSQSIFKAYQKLIRLRKKHLAFSYGDIEFINLNPNVLSFYRTYLNEKYLVIINLSDLKISSNKLNQFKNLRIVFNNYKNFKQIQPYQTLVLKCN

SEQ ID NO: 5359 - protein, 330 aa, Escherichia coli
  misc_feature (40)..(40): Xaa can be any naturally occurring amino acid
  misc_feature (43)..(43): Xaa can be any naturally occurring amino acid
  misc_feature (118)..(118): Xaa can be any naturally occurring amino acid
  misc_feature (128)..(128): Xaa can be any naturally occurring amino acid
  misc_feature (172)..(172): Xaa can be any naturally occurring amino acid
  misc_feature (228)..(228): Xaa can be any naturally occurring amino acid
  misc_feature (267)..(267): Xaa can be any naturally occurring amino acid
  unsure (1)..(330): unsure at all Xaa locations
TIKVGINGFGRIGRIVFRAAQKRSDIEIVAINDLLDADYXAYXLKYDSTHGRFDGTVEVKDGHLIVNGKKIRVTAERDPANLKWDEVGVDVVAEATGLFLTDETARKHITAGAKKVVXTGPSKDNTPXFVKGANFDKYAGQDIVSNASCTTNCLAPLAKVINDNFGIIEGLXTTVHATTATQKTVDGPSHKDWRGGRGASQNIIPSSTGAAKAVGKVLPELNGKLTGXAFRVPTPNVSVVDLTVRLEKAATYEQIKAAVKAAAEGEXKGVLGYTEDDVVSTDFNGEVCTSVFDAKAGIALNDNFVKLVSWYDNETGYSNKVLDLIAHISK

SEQ ID NO: 5360 - protein, 512 aa, Aspergillus nidulans FGSC A4
MGQSHSKGNSGAGDSLQSYPSFSKSDTKESLRSFRGSIRSKIRSSDSPRASTSALNQSDDKSDAGSMKSVGSRRSSTNLSRPASADSSAASPTDAPDPPPSPTMSSSLKRGHQDVAAMKQSGEVDHVSDAPPSAAPPPGSQAKVGESILIKREDTSNPILDFIMKTPLHSDASSSSPGMGMGALKSIDLDDMITRLLDAGYSTKVTKTVCLKNAEITAICTAARELFLSQPALLELSAPVKIVGDVHGQYTDLIRLFEMCGFPPVSNYLFLGDYVDRGKQSLETILLLLCYKLKFPENFFLLRGNHECANVTRVYGFYDECKRRCNIKIWKTFVDTFNCLPIAATVAGKIFCVHGGLSPSLSHMDDIRNIARPTDVPDYGLLNDLLWSDPADMDEDWEPNERGVSYCFNKNVIMNFLQRHDFDLVCRAHMVVEDGYEFYQDRILVTVFSAPNYCGEFDNWGAVMSVSGELLCSFELLKPLDSAALKSHIKKGRKERNSLINSPPAVVSAQSF

SEQ ID NO: 5361 - protein, 330 aa, Escherichia coli
TIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 5362 - protein, 224 aa, Pseudomonas putida KT2440
MTQDQLKQAVAQAAVDFILPKLDEKSVVGVGTGSTANFFIDALAQHKTAFDGAVASSEATAQRLKGHGIPVYELNSVSELEFYVDGADESDAHLHLIKGGGAALTREKIVAAVAKTFICIADGSKLVPVLGAFPLPVEVIPMARSHVARQLVKLGGDPVYREGVVTDNGNVILDVYNLQITNPVELEAQINAIVGVVTNGLFAARPADLLLLGTAEGVKSLKAE

SEQ ID NO: 5363 - protein, 334 aa, Arabidopsis thaliana
MSNYAAGLGKPGSGKRRIRDLLNQPDNRVCADCGASDPKWASANIGVFICLKCCGVHRSLGTHISKVLSVTLDEWSDEEVDSMIEIGGNASANSIYEAFLPDTCSKPGPDVNHDQRMRFIRAKYELQEFLKPSLRITSGKGSTKSSAFLTSSLSRKIMDSFRTNSSSQTMEGMVEFIGLLKVTIKKGTNLAIRDMMSSDPYVVLNLGKQKLQTTVMNSNLNPVWNQELMLSVPESYGPVKLQVYDYDTFSADDIMGEADIDIQPLITSAMAFGDPEMFGDMQIGKWLKSHDNPLIDDSIINIVDGKVKQEVQIKLQNVESGELELEMEWLPLDQ

SEQ ID NO: 5364 - protein, 407 aa, Roseovarius nubinhibens ISM
MMDGSKGFQDALTGEQKIRNFNINFGPQHPAAHGVLRLVLELDGEIVERCDPHIGLLHRGTEKLMESRTYLQNLPYFDRLDYVAPMNQEHAWCLAIEKLTGVEVPRRASLIRVLYSEIGRILNHLLNVTTQAMDVGALTPPLWGFEEREKLMVFYERACGARLHAAYFRPGGVHQDLPEDLIDDIETWAKAFPNVLADIDGLLTENRIFKQRNADIGVVTEKDILDWGFSGVMVRGSGLAWDLRRAQPYECYDEFEFQVPVGKNGDCYDRYLCRMEEMRQSLHIIHQAIEKLRAPDGKGDILARGKITPPKRGEMKTSMEALIHHFKLYTEGFHVPEGEVYAAVEAPKGEFGVYLVSDGSNKPYRSKIRAPGFLHLQAMDHVAGGHQLADVAAIIGTMDVVFGEIDR

SEQ ID NO: 5365 - protein, 360 aa, Arabidopsis thaliana
MALSTTPSQVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGQSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSDEIFKLLDNGAHIYFCGLKGMMPGIQDTLKRVAEERGESWEQKLTQLRKNKQWHVEVY

SEQ ID NO: 5366 - protein, 220 aa, Oryza sativa
MSGVFGKVFGKSKAQSQATALASIDKLSETLEMLEKKENLLVKKANLEVEKAKTFTKAKNKRAAIQCLKRKRLYEQQIEQLGNFQLRIHDQMIMLEGAKATTETVDALRTGASAMKAMHKATNIDDVDKTMDEINDNMENMRQIQDLLSAPIGAAADFDEDELEAELADLEGEELEAELLAPTTTAPTAPVRVQQPTRPSAQSSKTEDDELAALQAEMAM

SEQ ID NO: 5367 - protein, 244 aa, Triticum aestivum
VRLQKLKERIPACQERIDRNTVVIDDLKKELTEKEELVRSLGDKTHEVNSMKKSMEDNIAEVVKLKIELEAEHERGTRTLEKMNGRLKQMQAQLRDFQMQHMQFTQAEASQIEEDMQNIQREIDYLDSNVTRLREEEKEFSEELSGIQKSISDIAKEIAESDKRILQLKSHMDGLQQRQSNTVTAFGGQKVLKLLQLIESNHGRFKSPPIGPIGAHLQLASESWSVAVDCACGGLLDAFIVSCH

SEQ ID NO: 5368 - protein, 253 aa, Acinetobacter sp. ADP1
MDLETRLLRQQLSDANQLPEILLLKEITTSTNDDVRELAQKGILTALVCSNVQTQGRGQHQRQWISPKGNIYLSTLINTQTTLDGRMALEVALNILQMPALANLNLQVKWPNDLYSLQGKWGGILVEPLSATQAIVGVGINVVTPEHHDTDQAITSLTDLGCHQRERTHLIAQLYLAIQQAKDWFDHGCYRLAERFNHYAAFMHDHVRFEHHQGNLNGHFEGINHEGAVLIRTPEQLHHFYQGRMRRIENTSG

SEQ ID NO: 5369 - protein, 417 aa, Arabidopsis thaliana
MAASAATTTSSHLLLSSSRHVASSSQPSILSPRSLFSNNGKRAPTGVRNHQYASGVRCMAVAADASETKTAARKKSGYELQTLTGWLLRQEMKGEIDAELTIVMSSISLACKQIASLVQRAGISNLTGVQGAINIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 5370 - protein, 422 aa, Methanococcoides burtonii DSM 6242
MVTLDKSKDLFDKARKILPGGVSSPVRAIKPYPFYTESANGCRIKDVDGNEYIDYCLAYGPNILGHANPVIKQAIIDQLDKGWLYGTPTGLEVTLGEKIASLYPSIDMLRFVSTGTEATMSALRAARGFTCKNKFVKIEGGFHGAHDAVLVKAGSGATTHGKPDSLGIPEDFTKNTLQVAYNDIEAMTEVIESNQDDMAAVIMEPVLGNIGPILPEGDYLKEVRKVTEENDVVLIFDEVITGFRLAMGGAQEYFGVTPDMTTLGKIVGGGLPIGVFGGKREILEMISPSGSVYQAGTFSGSPASVAAGIAAVDVLEKEKVHEKLEATGNMLRAGLNDIIADKRLDFHVGGIASMFKVFFGDKPLNYQDVLKCDKEGYLQFFHDMLDSNVFLPPSQFETNFLSTAHTEADLETTLEAYAVNLK

SEQ ID NO: 5371 - protein, 403 aa, Dehalococcoides ethenogenes 195
MPNARVEDAIADIKAGRFVIVVDDYDRENEGDLVMASEMVTPDAINFMAKNARGLICVSLTAERLEQLKIPMMVTENTSPYSTGFTVSVEARKKVTTGISAADRAATVQVLIDPAATREDIAMPGHMFPLRAREGGVLVRAGHTEASMDLTRMAGLYPSGVLCEIMNDDGTMARLPQLEAKAAEWAIKIISVKDIISYRRRTEKMVKKITEAELPTSHGQFKAVAYKSQFDADEHIALVMGDISGPEPVLVRVHSECITGDVFGSKRCDCGEQLDMALNQIAKAGRGVLLYMRQEGRGIGLHNKLCAYALQDKGLDTVEANIELGFAPDLREYGIGAQILVDLGLSKIRMMTNNPKKVVGLEGYGIQVVETVPIIVEPNSFNRHYLETKQKKMGHLLNVDKTN

SEQ ID NO: 5372 - protein, 483 aa, Brassica napus
  misc_feature (381)..(381): Xaa can be any naturally occurring amino acid
  misc_feature (405)..(405): Xaa can be any naturally occurring amino acid
  misc_feature (423)..(423): Xaa can be any naturally occurring amino acid
  unsure (1)..(483): unsure at all Xaa locations
KHNKQISLKPVVFVCYTFSSPTHFLALPNFCNCEAVLSEKEQNKVSKLPGQNFNVNFAHYSGFVTTNEKLGRALFYWLIEAAEDPASKPLVLGVHWRPGFFTSWFSSNTITHHLMTLYMKIYSWNQTRYHLFCYALRDAGFTYYYKLTNFHKKKKKRTAQDSLKFLLKWVERYPEYKGREFYSRPTRPAGHYIPQLSQAIVRHNKASGDNTINLKGYMVGNGLMDDFHDRLGLFQYIWSLGFISDQTYSLLKLQCGFESFIHSSKACDKIQEIADKEIGNIDQYSVFTPACIANASQTKMLLKKRPRTSRVSEQYDPCTEKHSKVYFNLPEVQEALHVPPGLAPSKWDTCSDVVNEHWKDCSSSVLNIYHELIAAGLRIWXVFSGDADAVVPVTATRYSIDALNXLRPLSPYGPWYIDGQVGXGWTQQYAGLNFVTVRGAGHEVPLHRPKEALALFKAFISGTPLSTPESNISKDMSDLVSDS

SEQ ID NO: 5373 - protein, 528 aa, Synechococcus sp. WH 7805
MTKVLVSDPIDQAGIDILGQVAQVDQRTGLSAEELKAVIGEYDALMIRSGTQVTADVIAAADRLRIIGRAGVGVDNVDVPAATQRGVLVVNSPEGNTIAAAEHALALLLSLSRHVPQAHGSMRSGAWDRKKYVGNELYKKVLGVVGLGKIGSHVARVAKAMGMEVIAFDPFISADRAQQMQVRLTTLEDLFRQADYITLHIPRTPDTENLVNAELLRSMKSTSRIVNCARGGIVDEAALAEAIENGVIAGAGLDVYASEPLAEDSPLRTVERGLVLTPHLGASTEEAQENVATDVAEQIRDVLLGLPARSAVNIPGLSAEIMERLKPHLQLAETLGLLVSQLSGGQVQELEVRLQGEFALHPSQPLVVAALKGLLTSALGDRINYVNASLEAKGRGIHVLEVKDDASRDFAGGSLQLSTRGGQGGHSVTGAVFADGELRVTNIDEFPVNVPPSRHMLFTRHRDMPGIIGHLGSLLGEHNVNIASMQVGRRIVRGDAVMVLSIDDPIPPALLATIHGINGIQEAHPVTL

SEQ ID NO: 5374 - protein, 388 aa, Deinococcus radiodurans R1
MTSPFRLSARAQSLKPSATVAVTSRALELQRQGLDVISMSVGEPDFDTPPHVKAAGIAAIEEGKTKYTPVSGIPELREAISAKFRRENGLDYAPNAVTVTSGGKQALFNAFFALLNPGDEVLIPAPHWVSYPEMVALTGAVPVTVPTTPQQGFQLDPDALAAAITPRTRMVILNSPGNPTGAVFPPETLRAVADLATQHGLMIVTDEIYEHLVYDAEQVSIGTYAPEHTLTINGASKAYAMTGWRIGYAGGPREVIAAMNALQSQSTSNASSVSQYAALAALEQHEETMRFIDRARTAYRERRDRIVAGLNALGLPTPTPQGAFYVMADTRAIHTDELEAARIILDEAQVAVVPGTDFAAPGQVRLSYATSMDNIEEVLRRLEGVVRR

SEQ ID NO: 5375 - protein, 175 aa, Triticum aestivum
MGPTVMASSATSVAPFQGLKSTAGLPVSRRSNGASLGSVSNGGRIRCMQVWPIDVIKKWETLSYLPPLSTEALLKQVDYLIRSKWVPCLEFSKVGFIFREHNASPGYYDGRYWTMWKLPMFGCTDATQVINEVEEVKKEYPDAYVRIIGYDNMRQVQCVSFIAFKPPGCDESGKA

SEQ ID NO: 5376 - protein, 236 aa, Anabaena variabilis ATCC 29413
MTVTADPVTLMKQEVGKAAAALVKSGSIVGLGTGSTTAYTIQYLGDRLKSGELTDIVGIPTSFQSEVLSKQYGVPLTTLDAVDHIDIAIDGADEVDPQKNLIKGGGAAHTREKVVDYLANQFIVVVDSGKLVDRLGSVFAVPVEVIPMAITPVTNAIKQLGGKPELRMGVKKAGPVITDQGNFVLDVRFDSIDDPVNLEKILNNIPGVLENGIFVNCADIVLVGEVKDGQPLVRQL

SEQ ID NO: 5377 - protein, 409 aa, Pseudomonas putida KT2440
MSKTSLDKSKIRFLLLEGVHQNAVDTLKAAGYTNIEYLTGSLPEAELKEKIADAHFIGIRSRTQLTEEIFDCAKKLVAVGCFCIGTNQVDLEAARARGIAVFNAPYSNTRSVAELVLAEAILLLRGIPEKNASCHRGGWIKSAANSFEIRGKKLGIVGYGSIGTQLSVLAENMGMQVYFFDPLTKLPLGNAVQVTSLNELLGLADIVSLHVPELPSTQWMIGEKEIRSMKKGAILINAARGTVVELDHLAAAIKDKHLIGAAIDVFPVEPRSNDEEFESPLRGLDNVILTPHIGGSTAEAQANIGLEVAEKLVKYSDNGTSVSSVNFPEVALPAHPGKHRLLHIHENIPGVLSEINKVFAENGINISGQFLQTNEKVGYVVIDVDAEYSDLAQEKLQQVKGTIRSRVLF

SEQ ID NO: 5378 - protein, 171 aa, Arabidopsis thaliana
MILAILALVIATFLYGGATTVQAGCRDTLTSLSPCLYYLNGGSSSPSWSCCRQFSTVVQSSPECLCSVVNSNESSFYGFKFNRTLALNLPTACNVQTPSPSLCNTGGNVPTTLPANTPVGSPRSAPSPSGTTSPANTPSGSKKFPLSNESSSKSNVIILSFVSIALVLAII

SEQ ID NO: 5379 - protein, 478 aa, Mesoplasma florum L1
MNKKELQARVKRTKIITTTGPSTNEPEQIRELFENGMTTIRLNFSHGDYEEQGYRIAGAKKVREELGKPVSILLDTKGPEIRVGKFVDGKQEVTANQSITIYTDAESFKNKECLSGEMTVAYDMSVDLKIGDTILIDDGKLEMTVEEVKPGVVKAIAFNNHLVKTNKRVNLPGVDFSMPFLAQKDINDIKYGVEQGVDYIAASFVNSAENVKEIRDILAEANGSDIQIISKIESQVGIDNIDAIIEASDGIMIARGDLGLEIPYYDVPYWEKIMIRKCREAGKVVIVATQMLETMTENPAPTRAEVTDVYFATELGADATMLSGESAAGDYPFITVNTMATINKRAEIEFYKKAYYQTQLENAKNSTSGPRADIAMDLAERTRDGQYEFAVVLSRTGALLKTISKFRPNVTILGVSESERLWTAFGVWHSIFMNKTANLLELEENVAQISEIAKLWGAKSGSKILVVRNKDIREITVA

SEQ ID NO: 5380 - protein, 242 aa, Mycoplasma mobile 163K
MRKKIIIGNWKMNKTKTEAENFVKEFNKITSELNLKLDKNLVAGLALPFTSLGIKKEGNFANLVIAAQNFHQNNSGAFTGEISAEMLLDLGVKMVVLGHSERREFFHETDEIVNMKMHQAIKNNLVPIVCVGETELQYNSNKSKEVIKNQIEKSLKNLSDFSKIIIAYEPIWAIGTGKTATVEYAQEMCKYIRSLTNEKTIIQYGGSVKPNNIKELLSQKDIDGALVGGASLNVKDFIDLIK

SEQ ID NO: 5381 - protein, 309 aa, Nodularia spumigena
MENVGKIPFKYEWRNRWIIIKEFIQNPVQEISFLRDTFQVSELYTGIAKRDKDLNNPNIPQWLNFGYWQEETTYNGACAALARKLGEVAELSPGEQVLDVGFGFAEQDILWMRENNLGAITGINTTELQVKIAQERVARAGLEERINLQVGSATKIPFAENSFDKVTALECAFHFNTREDFFAEAFRVLRPGGKLALADCLPRVGRDINFWLRVNSKKMCIPFVNQYDRNTYVEKLKKQGFVNIQAIPIGEYVWPAVVHYFAQVGQGISKHDLVINLQKDNPGLEAWSRDRGWFMAFDDYILFSGEKPD

SEQ ID NO: 5382 - protein, 3475 aa, Nodularia spumigena
MAQNIDNKKLIAATLSKMEAMQARITELETRQSAPIAVIGMGCRFPGGISSPEIYWNYCQAGGDAIVEVPANRWDISKYYAPEPTPGKMNSRYGGFLQEDITEFDARFFSISAREATSMDPQQRLLLEVTWEALENANIPPTNLAGDRVGVFVGITSVDHAMTVYKSNYEQIDSFFGTGNSLSAAAGRLSYFLNLRGPAMSIDAACASSLVAIHQAIRSLRNHECELALVAGVNLILNPAITINLSQSGMMSPDGRCKTFDAAANGYVRGEGCGVLVLQRLSAAQKKGDRILAVLRGSAVNHNGAAAGLTVPSGPAQQDLLRQALTDARVSPQQVGYIEAHGTGTSLGDPIEMNAIAAVYGKRSQPLYVGSVKTNIGHLEAAAGIAGMIKTILSLQHGEIPPHLHFQKPNPLINWQGYPIKIPSQIIPWSNHGEIRIAGVSSFGFSGTNAHVIVEQAPAAKTTEIKLQRPSHLLTISAHNETALKELAQRFHTRLESDPEIGDICHSAAIGRSPLPERLAIVADTLPELQQKLSAFANEKTIDHLTFSQRFSGEKQPKIAFLFTGQGACYAGMGEQLYQTQPTFRKYIDQCADILANHLEYSLQNILFGNQTDLLNQTAYAQPAIFALEYSLTMLWKSWGIEPNLLIGHSVGEYVAACVAGVFSLEAGLQLVVKRGQLMQTAPTGKMAVVFADQATVLSLLENYTDTVSIAAINHPQQIVISGESHSIDQIIANCKTQNIPVQFLSLSGAYHSPLMEAILDEFETAAQSIDYDEPKTLLLSGIDGQPLETAPNASYWRKQCRQTVQFLQSIITALNKGYNLFLEIGYRPILAEQGRRYHDEAIWLSSLNRGLDSWQTMLATLAQLYIHGVSFNAEKFNQDYGYRNVQLPTYPFQRKRFQFQPPSQINEEHIEREQTKMTVAKVSHTQKHQQEIGKQLKSILAVLLKEDENEIRDDETLLNLGADSIILTDFTRKIEEKFSVKVRIDQLFTDLQRIVDIANYLSNYIAQEALETSEPISVGNIILSQNSELNNYLWVISQLQPIVVAYILKALGALGQSLNQAETWTTENLLQTLPIAPKYYLLITRYLKTLEQAGIIQNQGNVWTVKNLPTPFSLPETIENLQTHCPAAKPELEMLQRCGENLAEVIKGNIDPLELIFPAGSLIHAESIYGNSPVSRLMNQRVAQEINRILENFSSGDRPYQIIEVGGGTGATSEAILNNLNLTNVTYSFTELSPVLLNKARQKFQHRDHLNFHQLNIEKSPISQGIPAHSYHIVVAANVLHSTRNITETLNHIRELLLPGGFLVLLETVENNSWLDLTFGLTPGWWRFQDKELRLDTPLLSGETWCSVLKRCGFTTTDIFSQQNNVSIYNGQELIIASAPAESAIVSQPKTVAVSIPTSGKEALMMAQLQSLKDLKDIHEKTIIKQLEILQSASVAPSPTSEVLIRQTEPAPPQKATIEIAPLPQKIKTDSPKKPSSPSLNPLALKLAENKSLTEKQQAFISNLQIIYNQKTAKSKAYSQNSRKTMVDVKPTIDFRMALKEFQYPIVSESAQGAYFRDIDGNDYIDLAMGFGVNFFGHSPDFVIAAVQQQMQHGIGLGMQSNIAAETAALVSEITGVERVAFSNTGTEAIMAAVRIARSRTKRLKIVLFSGSYHGTFDGILARVGEEPGTAQPLSLGTPSGMVEDVIVLTYGAEESLEIIAAQADNLAAVLVEPVQSRKPDLQPQEFLQKLRKLTHEKEIALIFDEIITGFRMALGGAQEWFDVEADIVVYGKAIGGGLPISMICGKADFLDTIDGGFWSYGDNSHPHTELTGYGGTFCRHPLALAACRAVLLHLRAQGGTLQKRVNQLTNRLATEVNEFFQETGIPIRIVNFGSLFRFEPFGAYSLFLQPIELPLFYYLLNLKGIYTWEKRVCFLSTDHTNQDIDKVVIAVKEAIRELRQAGFFENAKPPQAKKREESDRSDDEDGRSSINQRFPTSEAQRQLWLLAELDTTASASYNVTTSLELRGNIEILYLQQAINEVVNRHEALRTQILEQGELQEVFNTVKIDLPLINLIDAENPEAAALTLRTQLSQKPFDLGSAPLFAAVLMRLAPEHYLLSLKTHHIVADGWSLGLILNEIGKLYSAKIGVSTDNLAPPMQFRQYLALRQQEAQSSQMQEHRDFWLKTYEGEIPVFELPTDFPRPAVKTYTGGRESKIIAPQLWRNLQTVGRQNQATLFMTMFAAYTAFLRRISGDDDLVIGIPISGRQFEGSEGLVGFCSQFLPVRIQTNITASFVDHLRHTKETLIAAFKHQSHALEELLAALQLQRDFSRSPLISVSFNMDPSLTLPEFEGLEVLLPPEPIGYTPFDLGFNFIEINDALIIYCNYNTELFKPETIKQFLESFEFLMEGVINNGNRLLSQLPLLTQSQEAKLLAELQGQTIDFPQTATIIDDFIAKVNSTPNAPALIVGDNTLSYGELNQKVNQLTNYLHQKYQLSSGKAIALIIGRNQNLIIAILATFKTGATYVPIDPEYPQSRIDFILKDSGCDVCLTESNFVSQLPQDIEAICLDKIDHTLAKFDTSEPHIKRDSSQIAYILYTSGSTGTPKGVMGCHISILNVIRSLRLTFDLDQHPDWHYIFTAPITHDPSLRNIFLPLTIGAALYMYEVKHIGHLVSFLQENQINALHTTPSIYREILAVLDTGETIPSLKYISAGGEKLDRETAIALRKRFPADIVSNVYGSTETCVGVAQYRIDENLNTDVPLGEVFHNNRLFVLDEFNNTVPLHVVGEICVEGVALASGYHNLPQITAEKFQPSFMTEGKTIFRTGDLGKQIAPGVIEFLGRKDNQVKVNGYRIDPGEIEYQLSRHSQIERAIVLPTNVDNQTQLSAYCKTESDIEISEIREFLSNFLPVYMIPTFFIFLKQFPLTRHGKIDLRSLAEFKGIGNLTQLAYTAPRNNLESKLVHIWEKILTKQPIGIFDNFFEIGGHSLLLSRVVTHVHKELNVLVKLAEFFKVPTIAGLAALVSKTQYDYQEPIPAITQQTSYPMSHGQRRLWALEFLDRNHTAYGMPSAYLFKGNLNIAAFENAFQHLLQRHEILRTTFTLIDNEPRQVVHESMNFQVKQIDLTEDEEQAEIIAEAIHNNAKNTFNLETGSLLKVNLLKVTQQSYIVLFNMHHIISDGWSAGVLIKDFLVLYHAYGQQNLELPPPLRIHYKDYSSWQEKRLNTSELQAQRDYWLNKLTPAPTRLNLPLDYARPGVQSFQGSAVIWQPDPELIKGFRVLLQNQESSLFMGLLTLVKSFLFCYTEQNEITVGSPIAGRNHPDLEEQIGFYVNMLVLRDQIAVDDSFATLLAKVKTTTLEAYDNQEYPFDKLVSDLNFPRDPSRNPLFDTAIVLQNNQNVELLLDGITVHPLDQEIVSAKFDLEFTFVEESQLYLKLIYNTDIFVHERISLMLKLLEGLLEEIVKLPEIPFLKLSFNTENSDEGDSKLFATNFNF

SEQ ID NO: 5383 - protein, 179 aa, Pyrus communis
FTQQYQPAVCNSNPTPCKDPPDKLFTVHGLWPSDSNGNDPKYCKAPPYQTMKILEPHLVIIWPNVLNRNDHEVFWRKQWDKHGSCASSPIQNQTHYFDTVIKMYTTQKQNVSEILSKANIKPGRKSRRLVDIENAIRKVINNMTPKFKCQKNTRTSLTELVEVGLCSDSNLTQFIDCPH

SEQ ID NO: 5384 - protein, 341 aa, Nodularia spumigena
MTAIFPQFSTVNLKNQKVLLIGRMYDETGEKLLEEYTNIQILKDPTKNEINQAIQEASGVFVRYPTKLDAQAIGLAKKLKVISTSGFGTDAIDISVATKHGVVVVNNPGLSTTAVAEHTICMILALAKKLTFLNQCVKTGNYLIRNQVQPMQLEGKTLGIVGLGRIGSAVASKCSAAFQMRVLAYDPYVLPSQAEAVGGTLVENLDYLLAESDFVSLHPELTDETYEMFALEAFKKMKPTAFLINTSRGKIVCEQDLVVAIGEKWISGAAIDVFEPEPPCQDNPLYDFDNVILSPHLAGVTPEAAIAATLSAANQILQVLQGQKPPYIVNPEVLDNFPHLQ

SEQ ID NO: 5385 - protein, 570 aa, Pseudomonas fluorescens PfO-1
MFANLLIILASSLVMIALFRRLRLPPVLGYLCVGLMVGPKAFDWINESEHLPDLAELGVVFLLFSLGLEFSLSKMIALRQVVFRLGSQQVMITTLLLGGVLMLLGMPATPALLLGAGLSLSSTAIVTKELGSLGEIFSSHGQNAVGVLLFQDVVAVLLLTLVPVFAGSSDQAWYWALPLTLLKTVLLFFGLLLASRWLLPRLFQEVAASRSAELFVLLALVIVLLTAWLTHLLGLSPALGAFLAGMLLGESHYRHQIEADIRPFRDILLGLFFVSIGMLIDLQLFASHSLLIIGMTLGLLVIKGLVVALLVKWRGSDSETAWRSGLALAQGGEFCFALMAQMQQTRLLPAELGALLLAATFCSMLLTPLLLRAAPRIAAALHRKPNQEAQIEEISALNAGFDGHVVICGYGRVGQSIGRFMRNAGQSYVALDNDPVRIQEAATAERDVHYGDSTRGDLLTAVGLLRARLLVIAVDQADVALRVLKEARRLNPTVPILVRTRDDSQSAELKAAGASEVVPELLESSLMLGSHALILLGFPAHRVQEKVDQVRIDRYRLLHGFYPGADDEET

SEQ ID NO: 5386 - protein, 395 aa, Yersinia pestis biovar Medievalis str. 91001
MNAMSLLSVEVSNFTFVGLFKNDNVNIVSIHRVLLLLEELMSQLPEKMSAVVCHGPQDYRLEHVPTPVPKAKELVIKVKGCGICAGDCKCKNGAKMFWGETPWVKPPVVPGHEFYGHIVALGEGTESKYKLGERVIAEQIVPCWDCRYCNSGSYWMCETHNIYGFQKDVAEGGMAEYMRFSENAIVHKIPESLSHEDAVLIEPMACAIHTVARGDIQLDDVVVLAGAGPLGLCMVQVARLKTPKKLIVIDTIEERLALAKAFGADVVINPLKEDADKIVKSLTGGYGCDVYIEATGAPIGVTQGLQMIRKLGRFVEFSVFGQETTVDWSIIGDRKELDIRGAHLAPYSYEIATDLFERGLVTSKGIVTHSYSLDDWEKAFELADSTNSIKVILVP

SEQ ID NO: 5387 - protein, 117 aa, Prochlorococcus marinus subsp. marinus str. CCMP1375
MNHKLPQTISPKELNQWLNEDSLKPILIDVRELEELSIAAFSEEVLHLPLSEFVSWSQSFTKTLSLDKPIVAICHSGVRSLNFGIWLLEQDGRYQVWNLQGGIDSWSLEVDNSVPRY

SEQ ID NO: 5388 - protein, 273 aa, Candida glabrata CBS 138
MVSRHEKELMKTFQSLTSCTDEGKAKRYLSANNWNINYALNEYYDKEVGGFTEDHMIRHQFKYPDELVSLFGHYAALIEEDGTQSITPDGLIDYIQDLGYNLEDLVTISLAHFLQCKNLENPITEKQFLYFWYNEGCYTLEQMRHYLEDCERKLCNDWKYFTTIYNYSFDLNASKQGVVETDIAIEYWKLFFEENRTKLSGIIKVDQAHLDLWCKFLQDEHKKLIHKDTWQMLLLFFKKFPSLDAIKTEYNEADAWPYTIDEFYEYLEERNVL

SEQ ID NO: 5389 - protein, 438 aa, Bacillus sphaericus
MRKTKIVCTIGPASESSETLEKLIEAGMNVARLNFSHGSHEEHAGRIHLIREVAQKLNKPVGILLDTKGPEIRTHNMKNGELHLTAGQVIDISMTEVEGTETSFSVTYEQLVEDVEQNSIILLDDGLIQLRVLATDVEKGLIHTIVENAGVLKNKKGVNVPGVSVQLPGITEKDAQDILFGIEQGVDFIAASFVRRAKDVLEIRELLEQNGGGHIQIIPKIENQEGVDNIDEIILVSDGLMVARGDLGVEIPAEEVPLVQKKLILKCNQVGKPVITATQMLDSMQRNPRPTRAEASDVANAIIDGTDAIMLSGETGAGLYPVESVQTMNKIAQRTENSLDYKSIVSTRSREKEANMTEAISQAVAYTSINLGVKAVLAPTESGNTARMIAKYRPGVPIVAVTGSTNTAQTLTLVWGVHPIVCQRVTTTDEILELAVDE

SEQ ID NO: 5390 - protein, 399 aa, Bacillus thuringiensis serovar konkukian str. 97-27
MDTLIFEVGTALVLVAIAAVIAGKFKFSVIPFLIVLGMLVGPHAPTIGVIDFKFIESANVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRMEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 5391 - protein, 212 aa, Glycine max
MTPDPHTTFLPFFIKTTDNSSSSENSSCRIRHEEFSEDELLSVVLMKNGRKVVCGSQTGVILLYSWGCFKDCSDRFTDLSSNSIDAMLKLDEDRIITGSENGIINLVGILPNRVIQPIAEHSEYPVECLAFSHDKKFLGSIAHDQMLKLWDLDNILQGSGNTQRNEAGGAVDSDDDEMDLDDDPSKINKGNKRKNANNGNALGGSNNFFADL

SEQ ID NO: 5392 - protein, 404 aa, Zea mays
MASAATTLLKSSFLPKKAEWGSKHQLVAAHPRPATVVVSMVARASAYADELVQTAFAILLIIFLQKTIASPGRGILAMDESNATCGKRLDSIGLENTEANRQAYRTLLVSAPGLGQYISGAILFEETLYQSTVDGKKIVDVLSEQGIVPGIKVDKGLVPLAGSNNESWCQGLDGLASREAAYYQAGARFAKWRTVVSIPNGPSQLAVKEAAWGLARYAAISQENGLVPIVEPEILLDGEHGIERTFEVAQKVWAETFFYMAENSVMFEGILLKPSMVTPGAECEEKATPEQVAEYTLRLLRTRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 5393 - protein, 141 aa, Bacillus cereus
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFD

SEQ ID NO: 5394 - protein, 346 aa, Lactobacillus plantarum WCFS1
MKAATFIEPGKVEVKEYDKPTIQKPTDAIIRVLRACVCGSDLWWFRGISQRQAGSTVGHEAIGIVESVGSAVKDVQAGDFVIAPFTHGCGHCAACLAGFDGDCLNQEAGGNGGYQGEYLRFTNANWALVKIPGQPEDYSDDMLNNFLALADVMATGFHAATSAEVKKDDTVVVMGDGAVGLSGVLSAKLLGAKRIIAMSRHEDRQKLAKAFGATDIIAERGDEAVAKVMALTETGADAVLECVGTEQSVDTAVKVGRPGAVVGRVGVPQKAEMNTNNLFWKNIGLRGGIAAVTTDDKQVLLDAVLTGKIQPGQVFTKRFMLDDIQAAYEAMDQRNAIKSLVIVSDK

SEQ ID NO: 5395 - protein, 73 aa, Glycine max
AFSMIFSPAVITVNLAGADMVAPFTVLMSMAGFPTRKTNNDITSIASNGGRVQCMQVRPPICKNKSETLSYLA

SEQ ID NO: 5396 - protein, 280 aa, Desulfovibrio desulfuricans G20
MIDKEYQRIMTERTASAPRAKKSLGQNFLQDKNISAKIVAALQIGPADCVIEIGPGPGALTDFIQKAAPASLWLLEKDTYWAGEHRRSDSRTPVEKQVVLTDALTFPWERLSDDRSWKLIGNLPYNVASPLMWDCLSLAAFSRAVFMIQKEVGDRIVAAPRSRQYGALSVWLQSHTVPRKELIVPPTVFKPRPKVDSAVLSFAPLPLSARNFSPGALSVLLKICFQQRRKQLQKILKRYWSDAVCGWFEQQGLPPAARPEELSPNQFQQLANLLESQLVS

SEQ ID NO: 5397 - protein, 195 aa, Pyrobaculum aerophilum str. IM2
MHAINIAFFALIMPVEKTLLILKPDAVARGLVGEIISRFEKAGLKIVALKMVKASPEEIERFYPSSEEWLRSAGQKLLKAYQELGIDPRAKIGTDDPVEVGRIIKRSLVKYMTSGPIVVMVLKGNRAVEIVRKLVGPTSPHSAPPGTIRGDYSIDSPDLAAEEGRVVFNLVHASDSPSEAEREIRFWFREEEVLE

SEQ ID NO: 5398 - protein, 391 aa, Streptomyces avermitilis MA-4680
MKAAVYEGPRTVAVKDVPDAKIEHPCDIIVKITTTNICGSDLHMYEGRTSFESGRTLGHENMGQVVEVGSAVRKVQVGEYVVLPFNIACGFCKQCERGLTNYCLTMQPEPALAGAAYGFADMGPYQGGQAELLRVPYGDFNALRLGEDAAEWQTDYVMLADIFPTGYHATEMAHVKPGDQTIVFGAGPVGLMAAYSALLKGAGRVWVADHQPDRLRKAEEIGAIPINTAEQKPGEVVKEATLGLGADNGCECVGYQAHDPEGHEDASLTLNGLIDSVRFTGDIGVVGVFLPQDPGGAEAQGELEAQGKVPLDFGLMWFKGQHMGTGQAPVKRYNRALRDLIAGGKAKPSFVVSHELSLDEAPTAYEHFDARDEGWTKVVLHPNGHGNGHKR

SEQ ID NO: 5399 - protein, 389 aa, Anabaena variabilis ATCC 29413
MKAVCWYGANEVRVENVPDPKILNPRDAIIKITSTAICGSDLHIYGGYIPTVQQGDIIGHEFMGEVVEVGSGVDNLKIGDRVVVPSTIGCGRCHYCEHDMWSLCDNSNTKGWLEEKLYGNITSAIYGYSHLLGGYAGAQAEYIRVPFADVGVVKVPPDLPDEMLLFISDAIPTGYMGAEMCDIQPGDTVAVWGCGAVGQFAMISAYMMGAEKVIAIDRFPERLEMARKYAKAEVINYEEVNAGEALKEMTGGRGPDACIDAVGLEAHGVGLEDFYDQTKQKLKLESDRPHVLREMMVACRKGGTLSIMGVYGGFVDKIPFGAAFNKGLTFRMGQMHGQKYMNLLLQLILDGKLDPSFVVSHQLPLEQAPFGYHIFQQKKDNCTKVVLKP

SEQ ID NO: 5400 - protein, 581 aa, Desulfotalea psychrophila LSv54
MNKTKIIATLGPQSQSVEEIYSLIQAGMNVARINLSHGDAESYKHLISNVKEARKLAEKDTAILLDNRGPEIRVSEMEEDIHLVDGEELVITNRAETVSPSRITTNYPQLAGDVQVGSRILLDDGKLALEVLAIEDEEVITKVIAGGILSSRKRVALPDNEVNLPSLSEKDKEDIAFGVEQDVDFIAASFVRQAGDVWAVRKIIEDNGGDQEIIAKIENRQGVNNLDEILQAANGIMVARGDLGVEVPAEEVPIIQKSIIKAANRLGKPVITATQMLESMITCPTPTRAEANDVTNAIFDGTDAVMLSGETAIGKYPVQAVAFLVRCATIAENALDYDHILANGLQNRRPTITDSISYASCATAADLKATAIITATSSGSTARMVARYRPKAPVIAVSPSPSTIRHLQLIRGVTPLLCNFGSSMDEQLDRVIHAATLAELIHNGDLVIITAGMPLGPTGTTNMLKVHTVADICVTGQGIGVKHAQGAVRIIQAEDDWQDLPEHTIAVVSSTNESMLKHLGKVRGIIAEAPGLTSHAAIVGRELGIPVICNVTNALMLFENDQVITIDGTTGHICYGSTQNT

SEQ ID NO: 5401 - protein, 392 aa, Anabaena variabilis ATCC 29413
MKAVCWHGTNDVRVETVPDPKILNPRDAIIKITSTAICGSDLHIYNGYIPTMQSGDILGHEFMGEVVELGSAVKNVKVGDRVVVPFTISCGSCFFCQRDLWSLCDNSNPNAWMVELQMGHSPAGLFGYSHLFGGYAGGQAEYARVPFADVGLLKIPDNLPDEQVLFLTDIFPTGYMAAENCNIKPGDIVAVWGCGPVGQFAIKSAYMLGAERVIAFDRIPERLQMAKEQCNAEVLNYEEVNIGEALKEMTGGRGPDACIDAVGMEAHGTDLMAFYDQVKQAVRLETDRPTALRQVIVSAAKGGHVSLAGVYGGFLDKIPMGSAMNKGLTFKMGQTHVHKYLRPLLERIQNGEIDTSFVITHTLPLEQAPHGYEIFKHKKDNCIKVVLKPSGN

SEQ ID NO: 5402 - protein, 1053 aa, Gibberella zeae PH-1
MSATRIGQRLARQSRRSPITLQPRLTQTIRLNAVSSRAFSVTATTQAPRFVESQSSTKLHEHELFSRRHIGSESSEQTEMLKMLDPPVSSMEEFLEQTIPPQVRRKQKGLNLVEQWYEGGAETAVPVNGRTEHYIQKEMRKLAKNNKVYESFIGAGYYGTLVPAVIQRNVLENPAWYTSYTPYQAEISQGRLQSLLNFQTLITDLTGLDIANASVLDEATAAAEAMTMSMANAPKGKGQKTFVVSENCHPQTISVLQSRAEGFNIKLVIGDVLADNSKLVREVEGDLIGTLIQYPDTHGGVHDYQALADIVHEKKALLSASTDLLALTMLKPPGDFGADIAIGNSQRFGVPLGYGGPHAAFFATSEKYKRKIPGRLVGVSKDRLGKPALRLALQTREQHIRREKATSNICTAQALLANMSAFYAVYHGPKGLKTIAEDIWSKTRLAQSLILEKGEFKLHTEGLREDGSVLFDTVTLKGSPEAIAKVHEKADSQSINLRRVADDKVGFSLHEGVTLESLGNLVKIFGVSESDFNAALESDKAKFLNDEIPASLQRKSAYLEQPVFNQYHTETELLRYIYHLQSKDVSLVHSMIPLGSCTMKLNATTEMLPVSDPGINNIHPFAPVEQASGYQALISSLAKNLSEITGMDATTLQPNSGAQGEFAGLRCIKAYHEARSGEKRKVCLIPVSAHGTNPASAAMAGMKVVTVKCDGKTGNLDIEDLKAKCVKHADELAAIMVTYPSTFGVFEPEIKQVCDLVHEHGGLVYMDGANMNAQIGLCSPGDIGADVCHLNLHKTFCIPHGGGGPGVGPIAVKKHLAPYLPGHPEIDPQRIGAERDSTAVAPISAAPWGSASILPISHTYILMMGGDGLTKQTGTALLNANYIMSRLLPHYKVVYTNAQGRCAHEFILDVRPFKDTAGVEVADIAKRLADYGFHSPTMSFPVSGTLMIEPTESESRAELDRFCDALIQIRKEIADIESGKVPRKNNILTNAPHPQEDLLSSEWDRPYTREEAAYPLPWLREKKMWPSVGRVDDAYGDTNLFCTCPPVEGSEDL

SEQ ID NO: 5403 - protein, 319 aa, Photorhabdus luminescens subsp. laumondii TTO1
MKDITVPLQLIKILSDGEVHSGQQLGQYLGMSRAGINKHIQTIREWGIELETTLGKGYSLMAPMQLLDESTILQYLPQDRITVLPVIDSTNQYLLERLSELKSGDACVAEYQYAGRGRRGRKWVSPFGKNLYLSMYWRLEQGPAAAIGLSLVVGIVIAEVLHRFGAGRIRVKWPNDLYLDDKKLAGILVELIGKTGDAAQVVIGAGINISMDHKDEEPINQQWINLLQAGIQVDRNKLAVEIILDLRKALIQFENKGLSSFVSRWFELDNFMDRPVKLIIGSQEVYGIARGINQQGALLLDQNGVITPYIGGEISLRGC

SEQ ID NO: 5404 - protein, 779 aa, Ustilago maydis 521
MLPASIRTFLSSNFLLLLALAYSVTAFTVTISDKDELRQTCSGMIAGDDSHIQAYFDKGSKGTVATMFYEFIDFDKLGKWSDDKDALGYQLKSYICTPKAVQKTLCMQEQLGNFIVDESGGKASTVQLQRMDFGAAGLSEVKTLLPDAQLTRQRYNVTKTGYYCFGATEVPLVSLEAAPSGSGDLSVHAEFSGRVEFFNKFKGNLPAAEYPKLNFYFAMTIAYIALGIYWISLCIKHRDEMLTVQYFISGTIAFLVVEMAAQWMYYYYLNGHLIDFFRIREVNNHTGVTAMARFLLVLTSILDAGRNSVSFFLLLIVAMGYGVIRPSIGPVMTRVRLLTAAHFIFGVLYSIGIVLIQLEQGGAWIFAFIFPLAMTLTAFLTWIMNSLNRSIEHLTQRKQTFKKSMFVKLHRILLGAVVVIFAFFIISSIAFSQSGGEGFAPNTWQYRWFLLDGWLALLYLAVFSAIAWVWRPTGNNMRLAMSDELATDDDPNAEGYEVDTFAARGPDGPDSDDEDDVEAKRTSQGPNGGRSAGAQPNSDVVFEIGDEDDEADHSKAAAADRREGRRGERQGLMSTSTNVSEETLVPVLLTITCRNHVYPRAFANAVTPLARLCTFALALTRFTMWTAASRSAAAQLQLTITLGRSTVFRVQVPSLFSTPSSLCSTFHPLTPALSTSQSAVSSSTASPSTWASDVGTLLWDGILRAVPKKKVSHSRKSMRAANKGLKDRTDLVHCSSCGKPKLHHHICASCYFELNRARKVALKQQHGGAPTNGGAQQHP

SEQ ID NO: 5405 - protein, 505 aa, Magnetospirillum magnetotacticum MS-1
MGDVTLLEFLSLGQRVEGHRPWPRFVLDLRGWRLLIDRLRVAEWSVMAQWAERDHIHVALRDETSGDIAVASHYCDDRRFPALGNVRPGVIRIERAIHDVWGLTPVGLEDRRPWLDHGRWPSRMPLAAQPMAPPSQPDGYSFLQAVGEGLHQIPVGPVHAGVIEPGHFRFHCQGEAVVRLEERLGYQHKGIEGLLQGAPLDKAQRIAARVSGDSTVAYSLAFARAVEAATGCEVPPRAHWVRGLMAEMERVANHVFDIGAVCNDAAFAVMLSHMGVLREKILRANDALFGHRLNMDRIVPGGVDRDLSEEGAEALKHLLYGFGKMLAKGYKLYENTPSLSDRTVSTGIVQTSLIHRFGAGGFVGRASGRGQDTRETPSYPPYDKLDMTVPVLTEGDVNARVLVRFAEAKESLHLINRILHEMPEGAFRVPVPEVAGEGLGVVESFRGEVVVWLRISAGHVVERCHTHDPSWFQWPLLEAAIEGNIVADFPLCNKSFNCSYSGHDL

SEQ ID NO: 5406 - protein, 388 aa, Vibrio sp. Ex25
KFTLDSDLPKGEGNQESVGLDYKELPQDVSPNDILLLDDGRVQLQVTSVEGNKVHTRVIVGGPLSNNKGINKKGGGLSADALTEKDKADILTAAEIQVDYLAISFPRNGEDMHYARRLARDAGLEAMLVAKVERAETVATNESIDDIILASDVVMVARGDLGVEIGDPELIGVQKKLIRRARSLNRIVITATQMMESMITSPMPTRAEVMDVANAVLDGTDAVMLSGETAAGKYPVETVKSMAEVCVGAEKMSEASLSTYRLDRTFETAEETIAMATMYSANHMEGIKAMISLTESGRTALMMSRLSSGLPIFALSRNESTLNRAALYRGVTPVYFESKSDAGLPTAQAAIASLKEQGFLHKGDLVMITQGDVMDVVGSTNCMRILQA

SEQ ID NO: 5407 - protein, 163 aa, Arabidopsis thaliana
  misc_feature (21)..(21): Xaa can be any naturally occurring amino acid
  misc_feature (50)..(50): Xaa can be any naturally occurring amino acid
  misc_feature (81)..(81): Xaa can be any naturally occurring amino acid
  misc_feature (140)..(140): Xaa can be any naturally occurring amino acid
  unsure (1)..(163): unsure at all Xaa locations
MASSMLSYAAVATSPAQATMXAPFTGWKSSAGFPATRRTNTDITSIASNXGGRVSCMKGWPPIGKKKLETLSYLPDLNDVXLTKEADYLLRNTWIPCAEFKLQHGYAYREHGYTPGCYDGPYWTKWKLPLFGCTDCAQVXNEAEECKREYPGACIRIIGCDNT

SEQ ID NO: 5408 - protein, 394 aa, Prochlorococcus marinus subsp. marinus str. CCMP1375
MSQLETRTEPMVVNFGPHHPSMHGVLRLVVTLDGEDVIDCEPVIGYLHRGMEKIAENRTNVMFVPYVSRMDYAAGMFYEAIVVNAPERLANISIPKRASYIRVLMLELNRIANHLLWLGPFLADVGAQTPFFYIFREREMIYDLWEAATGQRLINNNFFRIGGVACDLPWGWLEKCKDFCDWFGPKIDEYEKLITNNPIFRRRIEGLGSISKEKAINWSLSGPMLRASGVPWDLRKVDHYECYDDFDWNIAIAEEGDCYARYRVRIEEMRQSLRILRQACEMIPGGPTENLEASRIAEGKNSPFAGFDFQYVAKKVAPTFKIPNGELYTRLESGKGEIGVFIQGNNDVTPWRFKIRAADLNNLQILPHILKGAKVADIMAILGSIDVIMGSVDR

SEQ ID NO: 5409 - protein, 427 aa, Xanthobacter autotrophicus Py2
MNSRAFPAPEDPSATPESSHLPLTPVGAGEDPYLERVRDPIRTLPESGIVEVMNYGRDRPGMIPLWAGEGDVATPPFICEAAATALHAGETFYTWQRGLPELRGAIARYMARTYGIPENPDRYFVTGSGMQAIHIALAMTAGAGDEVIIPSPSWPNAAAAAQKAGARPVYVPFAYGKDGFSLDHERLAQAITPRTRAIFLNTPANPTGFVATHDDLRAVLALARRHGLWIIADEIYGRFYYGDEPRAPSFHDVMDEGDHILFVQTFSKNWAMTGWRVGWIEADPRLGQVIENLIQYSTSGVAAFMQRGAVAALDQGEDFVAQQIARARKGRDRVADALIATGKVDLVKPPGAFYLFFGIAGRSDVRSLGLTLVDEANVGLAPGTAFGPGGEGFMRLCFARGDAQLAEASRRLVAWLTGDGQTGAGAA

SEQ ID NO: 5410 - protein, 565 aa, Helicobacter hepaticus ATCC 51449
MAVISGIILSRLKIPTIIGYIITGVLSAYIFGFALEDSESLNSIAELGIVFLMFMIGLDFSFKSITAMKQEVLVFGGMQIGISIAFFFVVCFYFLGFNFATSIIIASAVSLSSTAIVLKFLNESNQTKTPYGTASIGILIFQDIAVIPILLMIKLLSDKDSHLWALILTTFLSAIILLIVLVLPGRIVAKVFLRFSANMKTDEIFVGAVFLIVLGAAYISKSFGFSLTLGAFLAGMIISNTPYKYQVSSVLVHFRDILLGIFFITVGMQVDVIFLLEHFVIIVILVALMMGAKTLLMYLFLLFFKGQRIGMRIALSLAQIGEFSFAIFLLASQHKILNLTLDGGILKAIFGEAIFANITPEEIYQFLTLMVIFSMIATPFILDRLDKVTDFFLRYMHPLHIFQTTKNNDEEETLQESHHKEAGLEGHIIVCGYGELGRKILEYFKGCDVRYIAVDKDYNKVERGIKNDDNVIYGNITRRRILEQLGIEQCAAVIIAIDSIEVVQHVYQEILSIAPLCKIILKTKNSAFESQMKTQGIYGIVHERRELAKILSDLALQATNEYLRD

SEQ ID NO: 5411 - protein, 275 aa, Medicago truncatula
TLLSGLVKEVRRLDDKLLLVDIDLLESKLHFSLRNLPKAKAALTAARTAANAIYVPPAQQGAIDLQSGILHAEEKDYKTAYSYFFEAFESFNALEDPKAIFSLKYMLLCKIMVNQADDVGGIISSKAGLQYVGPDLDAMKAVADAYSKRSLKFFETALQDYKAQLGEDPIVHRHISSLYDTLLEQNLCRLIEPFSRVEIAHIAELIELPIDHVERKMSQMILDKKFAGTLDQGAGCLVIFDDPKTDAIYPATLETISNVGKVVDSLYVRSAKIMA

SEQ ID NO: 5412 - protein, 332 aa, Triticum aestivum
  misc_feature (227)..(227): Xaa can be any naturally occurring amino acid
  misc_feature (232)..(233): Xaa can be any naturally occurring amino acid
  misc_feature (237)..(237): Xaa can be any naturally occurring amino acid
  misc_feature (264)..(265): Xaa can be any naturally occurring amino acid
  unsure (1)..(332): unsure at all Xaa locations
MMGGKHPQTILTDQCRAMELAIEKVMPNTTHRWCKWHILKKAKESIGAHYTKRSKFRMDFHKIIHHMLTVDEFETAWNQLTETHGLQRHPYLTQIYETREKWAKPYFNGKLCAKMSSTQRSESANHMLKTYVPASCPMHIFVRQYMRLLFDREAAENYEERRTMINAPVMRVNTPLEQHASNVYTRAMFEKFGEVLYESGQYKIEEVSRWKTYIARRHHPEKHEKWXRVFYXXLKLXDDGALIVCECGNFEYTGLLCCHALKVXXMSLVVDHIPANHILKRWTKDARDLLPDHLAHLQKDKINVNSITFRHLNLYTHALGKLSVFGDANTSI

SEQ ID NO: 5413 - protein, 440 aa, Oryza sativa
MGDFNVALAIVAAVVSVLVLLVSVYLLINYQHPDDANQAYFPKLVVVLGITVALLSILMLPADVANRQACRRAIYSGACSLTLPMKTLWLAVYIADAVLVFLVIPFAMFYYEGDQDKSVGKRLTSALLWVAVSAVVCGLILGILYGLVGKVDFTVRHLSSAVETFPNSFTSFSTGQPCISTSPKQEATELGKKARELKKAAEALHQEEKSGKKGRKWRKNVKALGKELVLLEDDMKALEEMCPQGEQAEATWALTVLGYIGKLLFGAVGLIISIAWVAHIVIYLLIDPPLSSFLNEIFVKLDGVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYAIFGWRKRKPTGRFQLSN

SEQ ID NO: 5414 - protein, 557 aa, Arabidopsis thaliana
MSGSVSRDAEALKSADSSTRRSGGRITFPFMIVTLFGLTLATLGWLQNLIVYLIEEYNMKSIAAAKILNIFSGFTFMFPAIGAIAADSFFGTIPVILVSSFISLVGVVLLALTTLFDSLRPQACETASKLCQAPTNIQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 5415 - protein, 188 aa, Oryza sativa (japonica cultivar-group)
MAVARGVALAVVLAAAAAILAASPVAAQGGGGGGGSGSCMTEIISLASCLGYMSGNSSAPKPSCCTALSSVVTSKPACLCAVLGGGASSLGVTINNTRALELPAACNVKTPPASQCSTVGVPMPSPATPATPAAPAVPSETPAGTGGSKATPTTATTTTGQSASGGSVGKAASMATVVVSVAFALIHV

SEQ ID NO: 5416 - protein, 443 aa, Dehalococcoides ethenogenes 195
MTRAESVEYVLKTAKDHNVRFIRLWFTDILGTLKSYSIAYNELERALEDGMGLDGSSIEGYARIDESDMLALPDPDTFRIMPWSNGEYQVGRMFCDIKHPSGEQFEGDPRYVLKRNLKKAADMGFTFYVGPELEYFYFKNDRSTEFLDEGGYFDLTPRDLATDLRRETIVALQDMGIIVEYAHHEVAPSQHEIDIRYTDALTMADNVMTYRLLVKEVALRHGLHASFMPKPVGSVNGSGMHTHQSLFKGDKNAFFDAKDSYYLSTMAKQYIAGILKYAPEFTAVTNQWINSYKRLVPGFEAPVYLSWARRNRADLVRVPEYKPGHEKSTRIELRSADPGCNPYLAFSVMLASGLKGIEEKLTPPAPIEENVYEMNEAERAKRGIGTLPGSLLEALKLTEGSDLMREALGDHVHKAFISNKKIEWTEYSAAVTDWELKRYLPLL

SEQ ID NO: 5417 - protein, 493 aa, Rickettsiella grylli
MLIPVILSGGNGSRLWPVSRETYPKPFIRINDEPHSLIQKTYQRTLNIPHIEKIITVTNFEYYYHTKKELTDLGYDPASNTFNFILEPFSRNTAAAIIFSAFFTNEVIHPDATLLVLPADHIILNQDKFNACVEKAKKLAEKELLTLFGIIPYKPETAYGYIQYSKTDEILSAYKVIQFYEKPTYKNAQSFIEEGNYLWNSGILCFRVKTFLETVKKYIPAFYLKSLACWNHSVKKNVTRHNKLSLDEPSFTVLENISIDYALLEKADNITVIPSDFGWSDVGSWDVLNTFVKLEENNNRILGDVFLKETYNTNIYSQHSNRVIGLLGIKNLTIVDTPDALLICQQSHIQNVKQLVEELKRNDHPAYRYHQTVYRPWGHYTVLDEGPHYKLKRLLVYPGASLSVQMHRYRSEYWVVVSGVATIKNDQKQLILYPNESTFIPLGCKHCLSNLEKHDLIVIEVQTGSYLGEDDIIRFKDNYERKTVTDDEANIDS

SEQ ID NO: 5418 - protein, 338 aa, Desulfovibrio desulfuricans G20
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 5419 - protein, 483 aa, Oryza sativa
  misc_feature (234)..(234): Xaa can be any naturally occurring amino acid
  misc_feature (416)..(416): Xaa can be any naturally occurring amino acid
  misc_feature (446)..(446): Xaa can be any naturally occurring amino acid
  unsure (1)..(483): unsure at all Xaa locations
MATAPPRVSCGSLLQELQVLWGQIGQNEAERDRMILQLEEDCLNVYRKKVEQTRKQKEDLIEELSFGELDIEKILSALGERESFSRVEKLGGTLLEQLAKVEPVLEDLRRRRDERVEEFMVVQAQIVRLHAEISGTIENGDPVPPLVDETNLSLRRLEEFKSQLKELQTEKSLRLQKIDGQINCIHEICNMMSFDLKRELYDVHPSFVELGRTTSMSISDSTLERLAGKVHSLXQEKKQRLRKLQDLGSTLIELWNLMDTPTAEQKCFDHVTSLISVSPSTKMPQGCLARELIEKVEVEVKRLNCLKASKMKELVLKKMIELEEIYKSVHMDIDSDYERRILNDLIDSGKADLSDLLTGMDGRITKAREHALSRKEILEKVEKWTLASEEESWLDEYEKSNFICHISGLILSFHFXDQNRYNAGRGAHKNLKHAEKARMLVSKIPXRLLDSLEEYTSRRQQKDEEKRRSRADLPLTLTVGGDP

SEQ ID NO: 5420 - protein, 199 aa, Karlodinium micrum
MSTFWLSLACLLWSAQVRGVHQGPSNAFSKMLLALNPANARSSSSNARAARAAPAKAFVTEKSDAIFAEAKTLMPGGVSSPVRAFKSVGGNPIVVEKVKGAYMWDVDGNKYIDYVGTWGPAIIGHADDVVLDALKKQLDSGTSFGAPCALENELAKMVIEAVPSVEMVRFTNSGTEACMGMLRLVRTFTKREKVVKFEG

SEQ ID NO: 5421 - protein, 89 aa, Brassica napus
  misc_feature (4)..(4): Xaa can be any naturally occurring amino acid
  unsure (1)..(89): unsure at all Xaa locations
MAGXAKASWMVAMSVGAVEALKDQAGLCRWNYALRSIIHRAAKARANVRGGVSQGAKQLPASAAAAAERRRAEKAEEGVRTVMYLSCWG

SEQ ID NO: 5422 - protein, 200 aa, Pavlova lutheri
TLMPGGVSSPVRAFKSVGGDPVVFDRVKGAYAWDVDNNKYIDYVGSWGPAIIGHADDEVLAALKKVIDKGTSFGAPSALENVLAKMVIDAVPSVEMVRFTNSGTEACMGVLRLMRAYTKREKLIKFEGCYHGHADSFLVQAGSGVATLGLPDSPGVPQGATKSTLCAKYNDLKSVEAIFDANPGEIAGVILEPVVGNSGF

SEQ ID NO: 5423 - protein, 140 aa, Gluconobacter oxydans 621H
MALERTLSIIKPDATKRNLTGKINAVFEGAGLRIVAQKRIQLTEKQAGAFYAVHKERPFYGSLVSSMIAEPVVVQVLQGENAVAKNREVMGATNPADAAEGTVRKLFAESIEANSVHGSDSLENAKNEISFFFAETEILP

SEQ ID NO: 5424 - protein, 515 aa, Candida albicans SC5314
MLEEISFESWYLYLIICGVLYFCTNYLYIQYLNKKLGAKSPGSCKSDGCFGFRSGFEMLKAKKIGRQVDLLHERFNDLSNPEVNDTFTSYNFGFPMIITKDPENIKALLATQFNDFSLGRRYDFFKPLLGKGIFTLDGEGWKHSRSMLRPQFAREQIAHVKALEPHFQLLKKHITKNKGQFFDIQELFFRFTVDSATEFLFGESVSSLKDESIGYNQDEFDFAGRKDFPEAFNKSQIYLSTRSLLQNLYWLVNPKDFQNCNAIVHKFSDYYVNKALNATPEELEKNSGYVFLYELVKQTRDPQVLRDQALNILLAGRDTTAGLLSFAVFELARNPQVWKKLREEIIERYADGATEISFETLKQCEYLKAVINETLRLYPSVPRNGRFANKNTTLPRGGGPDGMSPILIKQGQAVMYSIYSTQRDPKYYGKDADVFRPERWFEPETRKLGWAFLPFNGGPRICLGQQFALTEASYVLVRLAQCCENLQLTEGIEYPPAKLTHLTMCMFDGVPIKVD

SEQ ID NO: 5425 - protein, 452 aa, Pseudomonas putida KT2440
MSNNLDQLTDWLKEHKITEVECMISDLTGITRGKISPTNKFIAEKGMRLPESVLLQTVTGDYVDDDIYYELLDPADIDMICRPDENAVFLVPWAIEPTAQVIHDTYDKKGNPVELSPRNVLKKVLKLYADKGWQPIVAPEMEFYLTKRSEDPDFPLQPPVGRSGRPETGRQSFSIEAANEFDPLFEDVYDWCELQQLDLDTLIHEDGTAQMEINFRHGDALHLADQILVFKRTMREAALKHNVAATFMAKPMTGEPGSAMHLHQSVVDVATGKNIFSNEDGSMSALFLNHIGGLQKFIPEALPLFAPNVNSFRRFLPDTSAPVNVEWGEENRTVGLRVPDAGPQSRRVENRLPGADANPYLAIAASLLCGYIGMVEGIEASAPVQGRGYERRNLRLPLTIEDALERMENSRALVQYLGKKFITGYVATKRAEHENFKRVISSWEREFLLFAV

SEQ ID NO: 5426 - protein, 469 aa, Hordeum vulgare
MAGAAAAVASGISIRPVAAPKISRAPRSRSVVRAAVSIDEKAYTVQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDADAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVRGILDVGAKTGHEMCGGHIRGMFGFFFAGGPVHNFDDAKKSDTAKFGRFHRGMLGEGVYLAPSQFEAGFTSLAHTTQDIEKTVEAAEKVLRWI

SEQ ID NO: 5427 - protein, 85 aa, Kluyveromyces lactis NRRL Y-1140
MLTQDDLKAKLEKEIPNFYHALITDTSNGCGQSFDVVVVSDVFVGKNKLSRCRIVNKALAEEVAQIHAFGCKCYTTNEWNEILGN

SEQ ID NO: 5428 - protein, 444 aa, Chromobacterium violaceum ATCC 12472
MNHQINEWLREHRITEVECIVPDMTGIARGKIVPKDKFVSDPEMRLPEAVLIQTVTGDYPDDSLLDLTDPDMVLEPDPNTLRYVPWAVDPTAQLIYDCCRADGSPVDVAPRNVLKRVLGLFDEMGLEPVLAPEMEFYLLSPNPDPDIPLAAPIGRTGRAEFGRRSYSIDAVNEFDPLFEDIYDYCHAQNLEVDTLIHEIGTAQMEINFLHGNPLELADQVFLFKRTVREAAFRHNMYATFMAKPMENEPGSAMHIHQSLVDKNTGRNVFTNEDGSPSDIFFHFIAGLQKYVPQTMPLFAPYVNSFRRLSRYTAAPTNVEWGYDNRTVGLRIPHSSPAARRIENRVPGVDVNPYIAIAATLACGYLGMVNKLRPTEPRQTDAYELPYQFPNSSEESLLQLAGCSEIAEVLGPRFVKMYVAMKEKEFSEYFRVISPWERKFLLLHV

SEQ ID NO: 5429 - protein, 447 aa, Mycoplasma gallisepticum R
MPSKTNRAYFLKDPIHSEVVFKDKTAWMQQLIHTTEFKRLKRIQQLGLSSNLFPGASHNRFSHCLGVYELLRKMMFKSTFKRISDYDKQTLICAGLLHDLGHGPHSHAFEFYLNNCTDDHKQRFHHEVMTAKLILNKRGEIYPILKENNINPEDVAALIDKNNPLLKKKPLWMQQLISSELDADRIDYLKRDSYFTGATYGTIDSKLLDRWIVFDHKSKQVGYEKKAITTIESLLIGRYHMYKSVYYNHKSVVLEQIIMLVFKRIVDLFKQNQFDFYGFEIIQQLFEALFIDNDISKVDLNLFKYLTDDYFNTFLYQQWIKTNDPILKTLLNNHFVENKFLIWTFDDQLRREEIYNQLKNIIDDSQYFLVKDSYKDKTLYAKKSNSLGINIYEHNSKKFYPITNYSKILDISHPEAFNHLIIFDSEKAAKKQKLFNQIKNKYLKLSS

SEQ ID NO: 5430 - protein, 172 aa, Capsicum annuum
MASKGIALICMTLVTIMSTMISVEVMAQSDCTSTLITMASCLSFVTGSAKTPPASCCSSLSGVLQSNPRCLCVIVNGGGSSLGVQINQTQALALPSACNLQTPPVSRCYAGNAPVMSPEGAPTEGTPDSSTGVAVTGSKASGSSTSDGSSLKVPVRAAVAIVIFMASYISMI

SEQ ID NO: 5431 - protein, 92 aa, Zea mays
MSSSAAKKGVSMVVATSMAAVEALKDQAGLCRWDYALRSLYHRAVVTGRRAVPASLSSSSSSQAAVGRAARPRRSEEEKLHKAYHIVCWGPN

SEQ ID NO: 5432 - protein, 491 aa, Helicobacter pylori 26695
MAQKTLLIITDGIGYRKDSDHNAFFHAKKPTYDLMFKTLPYSLIDTHGLSVGLPKGQMGNSEVGHMCIGAGRVLYQDLVKISLSLQNDELKNNPAFLNTIQKSPVVHLMGLMSDGGVHSHIEHFIALALECEKSHKKVCLHLITDGRDVAPKSALTYLKQMQNICNESIQIATISGRFYAMDRDKRFERIELAYHSLMGLNHTPLSPSEYIQSQYDKNITDEFIMPACFKNYCGMQDDESFIFINFRNDRAREIVSALGQKQFSGFKRQVFKKLHIATMTPYDNTFPYPVLFPKESVQNTLAEVVSQHNLTQSHIAETEKYAHVTFFINGGVETPFKNENRVLIQSPKVTTYDLKPEMSAKEVTLAVLEQMKLGTDLIIVNFANGDMVGHTGNFEASVKAVEAVDACLGEILSLAKKLDYAMLLTSDHGNCERMKDENQNPLTNHTAGSVYCFVLGDGVKSIKNGALNNIASSVLKLMGLKAPATMDEPLF

SEQ ID NO: 5433 - protein, 328 aa, Triticum aestivum
  misc_feature (98)..(98): Xaa can be any naturally occurring amino acid
  unsure (1)..(328): unsure at all Xaa locations
AEFRVAPRPASSPSSSWSPPSPPPCWPPRSSTFSPAAAAAGPSLNPKRPAPTVIRASAGAVHPEESPQSEEKDVDSGAAALPKLKPLHWDKFRASSGXPTVWDQLKASSFRVNEEMIETLFVSNSTRRMPKNGFKEANGAPCNQENKVLDAKKSQNIAIMLRALDATKEEVCKALLDGQADSLGTELLEMLLKMAPTREEELKLREYREDAQSKLGPAESFLKAVLGIPFAFKRAEAMLYIANFDSEVDYLKTAFRTLEAACEELRGSRLFHKILDAVLKTGNRMNTGTNRGNAHAFKLDSLLKLVDIKGTDGKTTLLHFVIEEITKS

SEQ ID NO: 5434 - protein, 1613 aa, Oryza sativa
MAMLTAKLTSPPAATTWLPGGGRRSAPPRRATVIRAAAVSYADELVSTAKSVASPGRGILAIDESNATCGKRLASIGLDNTEVNRQAYRQLLLTTAGLGEYISGAILFEETLYQSTTDGKKFVDCLKDQNIMPGIKVDKGLVPLPGSNNESWCQGLDGLASRRTVVSIPCGPSALAVKEAAWGLARYAAIAQDNGLVPIVEPEILLDGDHAIERTLEVAEKVWSEVFFYLAQNNVLFEGILLKPSMVTPGAEHKQKATPEAIAKHTLTMLRRRVPPAVPGIMFLSGGQSEVEATLNLNAMNQEPNPWHVSFSYARALQNSVLKTWQGRPENVEAAQKALLVRAKANSLAQLGRYTGEGESDEAKKGIRHALRPDPPTPRRRLSPESELSALNPPQTPAVQIPPEPSSRPPAAAAAAPEAEGAEALHEISGPAAAAARLVMLLASCLRGRLRLHRRPRPLIMPSPLFLSRNPNPSPPRSATATGTTILSPPSTSASASMSTSGVYVPPMRRLRSVIASTNGSLAPPPSAAAQAQPGGSTLDNIDEWKWKLHMLLRNEDEQEVISRERKDRRDFEQLSQLAERMGLYSRQYSRIVVFSKVPLPNYRSDLDDKRPQREVSIPSGLQREVDALLSDYLARKRTSSGSFPNAAFSRSSSTDSFATDESFLEQQDNQTSTSAVIERIQRRKSLQLRNQQESWQESHDGQSMMEFRRSLPAYKERQTLLEAIAQNQVVVVSGETGCGKTTQLPQYILESEIDAARGATCSIICTQPRRISAIAVSERVAAERGEKIGESVGYKVRLEGMKGRDTRLLFCTTGVLLRRLLVDRNLKGVTHVIVDEIHERGMNEDFLLIVLKDLLPRRPELRLVLMSATLNAELFSSYFGGAPMIHIPGFTYPVRSRFLEDILEITGHRLTPYNQIDDYGQEKSWKMQKQALRKRKSQIASVVEDTVQAADLRDYSARTRDSLSCWNPDSIGFNLIENVLCHICQKERAGAVLVFMTGWDDINALKEQLQANPLLGDPSKVLLLACHGSMASSEQKLIFDRPEPGVRKIVLATNLAETSITINDVVFVVDCGKAKETSYDALNNTPCLLPTWISKASARQRRGRAGRVQPGECYHLYPQCVYEAFADYQLPELLRTPLQSLCLQIKSLRLGSISEFLSRALQSPESLSVENAIEYLKVIGAFDRNEELTILGKHLSMLPVEPKLGKMLIFGAIFNCLDPILTIVSGLSVRDPFLTPFDKKDLAESAKLQFSCRDYSDHLALVRAYEGWREAERDRNGYDYCWKNFLSVQTLKAIDSLRRQFLFLLRDTGLVDENMTACNKWSRDENLVRAVICAGLYPGVSSVVNKEKSISLKTMEDGQVMLYSSSVNGKETKIPFPWLVFNEKVKVNSVFLRDSTAISDSILLLFGGNIKQGGLDGHLKMLGGYLEFFMSRDLASTYLSLKSELDNLIHCKLQNPRMDIQTSEELLSAIRLLVTEDPCNGRFVYGRQEQRSKKAKTMFSAAPMSHGGGGNGGDNAKNQLQTLLTRAGHDNPSYKTKQIKNSLFRSTVEFNGMQFVGQPCANKKLAEKDAAGEALNWLTGGAPSDSRDPQDMDHMSMLQKPPRRKRHHHRRG

SEQ ID NO: 5435 - protein, 1211 aa, Ashbya gossypii ATCC 10895
MAPFKFGKKNGKDKSVVGRATTGPEPVGAAGGPTGGSSRAAGRDARRPETPWDRVKLVQTPFPRYRHVASAYASDTNEVIVIGGLHDQSVYGDTWILRAQDNGKQFSARTIEITETTPPPRVGHAATLCGNAFVIFGGDTHKTNNEGLMDDDVYLLNVNSHKWTIPHPVGPRPLGRYGHKISIIATSQMKTKLYVFGGQFDDTYFNDLAVYDLSSFRRPDSHWVFVKPASFVPPPLTNHTMVSYDYKLWVFGGDTPQGLINELFVYDPVVNDWSVVETTGAKPPPLQEHAAVLYRDLMCVVGGKDDQDNYSQDVYFMNMKTFRWFKLPHFQDMVPSPRSGHSVTLLANRKLLIMGGDKFDYARPGDADLMAADHDMRAGTILYTLDLTDLEEHCPGVFDMAGVSPPRRTPSQSTSASSKNTAMTTPMMPRSSFTPATSPAKAKPNGVVNILSPHQESKKRQPTDSHMYGDQQYKATPQQKTPPLKQSAKPPQQQHRSPHQTATQDLQKSTDSQGRKLPQKKYAAQQNPKDYEEAADTTHSTEPLSTAESSQLPSDVTNASTEPADISTPQAHNRPGLKPKSPVPHIIDNERSPRVASMQYTNPLEQGKNKRHSQIIEEYDGELGVAVVGNSPGKDEVRRQSVDGSKPDGWAQPRTFGELAELPGSFTPQQLSDVERSPVLERSIPEAAVTSGRSKEKSDNDDNSLAKEVSTGPVKKQNDQTDFGIPASAEVPVRAATRSPKELGRSATYEGVQRPQQNEGNSPDQVVRSSSVKDTPRSVEDDNLPHAKMKSDGRANNPFLQDTRFASPSKGSSASEDDELEKPAGVTSRDLNDRSGSLRKNTESILSKRGTPDGHVSNEFVQQLFEELRELKLQTERSAAEASNRIRLLEDENLKLRQPGHGPSHRGISGASEDVSYSKLQTEVDILKADKAVYADRVAELEEFLDSNILDAERLNRIIESQSKIIESFSDQESYKEKFEQIQKKLDALKKENEELRCKNISQMNKLQQDISNHSQAMRDMLKHWRAQGLSDSSEGGAEGVRNLQHHQSIINKLSAQLDAAEKEKSDLNHLHHELLRNYESLQQDYKALNDELVSKQNEVSYLEQNYKSSLSSVNNASKALELSQRELGKLKNENTKLKEQLEDLTLSPSIDGRSKFANTLTDDPLGSLNDAHYNLRIKDLKAELFIVRQERDSLKDELLQLKKRLFTMDD

SEQ ID NO: 5436 - protein, 119 aa, Brassica napus
  misc_feature (24)..(24): Xaa can be any naturally occurring amino acid
  misc_feature (67)..(67): Xaa can be any naturally occurring amino acid
  unsure (1)..(119): unsure at all Xaa locations
RSTLRVEHASDETSRLFTMPYQKXSDGHEHLAGLSDDVGAGFITGHGNETASSSSELTVDQATDLPXQDETGLTGVSKLITADQKRFIIDRGNSIRSHFLKISEVDGSDRSSIILPLSG

SEQ ID NO: 5437 - protein, 483 aa, Sorghum bicolor
MSSSGQYSSPRRAATATLLLALAAGSFLLLPALARGSSSSSSFEEDRISALPGQPNDGVAFDMYGGYVTVDEHAGRAFYYWLQEADRGEVEDPDTAPLLLWLNGRPGCSSVGYGAMEELGAFRVHTDGHRLLLNEYAWNKVANVLFLDAPAGAGFSYSNTSSDLLVAGDISTAHDSYTFLVKWFERFPQYKYRDFYIAGESYGGHYVPQLSQLVYRNNIGVEKPVINLKGFMVGNGLTDDRADMVGMFEFWWHHGLIADETLDTGLKVCPGSSFIHVTPECRKIWDKALEEQGHIDGYSIYTPPCDKGSPYAHRLQSRPHPLMMLPAYDPCTAFYSTKYLNLPEVQTAMHANVSGSMEYPWVVCSNLLFDNWTDAATSMLPIYRELIEGGLKVWVFSGDTDTVVPLSATRRSLAALSLPVKTSWYPWMIVGCYEHELASDMAKSRALGKDILCRGPPAETLGKEKPSAKTPSAILFLNRRSMS

SEQ ID NO: 5438 - protein, 195 aa, Pyrobaculum aerophilum
  misc_feature (1)..(1): Xaa can be any naturally occurring amino acid
  misc_feature (13)..(13): Xaa can be any naturally occurring amino acid
  misc_feature (51)..(51): Xaa can be any naturally occurring amino acid
  misc_feature (112)..(112): Xaa can be any naturally occurring amino acid
  misc_feature (120)..(120): Xaa can be any naturally occurring amino acid
  unsure (1)..(195): unsure at all Xaa locations
XHAINIAFFDLIXPVEKTLLILKPDAVARGLVDEIISRFKKAGLKIVALKXVKASPEEIERFYPSSEEWLQSAGQKLLKAYQELGIDPRAKIGTDDPVEVGRIIKRNLVKYXTSGPNVVXVLKGNRAVEIVRKLVGPTSPHSAPPGTIRGDYSIDSPDLAAEEGRVVFNLVHASDSPSEAEREIRFWFREEEVLE

SEQ ID NO: 5439 - protein, 657 aa, Sorghum bicolor
MHEGLAVVELAVGTHRPVRARTHEFVSPAHKFATRPGEEAVVDEGLKGMGIFEALGGICSGATAEEQELAADSMAGHDEGRGNTDSEGGYRGRGGKQMATLEEYEEARNLRMGDRPRSTFRVHMGEDKVCRKDWCWSVRADYILEKLPDVSGPSFVQFHGRVCRSCAGIVHMSGVDLKWSYNMALDTRTWPREDVPGLGLTDEDVSLLWRTSRRQPPPGTGVGARVLEEQDHQQREDDLIRGLPGLPPNDDVPFDMYGGYITVDEQAGRALYYWFQEADRTEVEDPDAAPLLLWLNGGPGCSSIGGGALEELGAFRVHTDGERLLRNEFAWNRAHDAYKFLVKWFERFPKYKYRDFYIAGESYGGHYVPQLSQLVYRNNIGVENPSINFKGFMVGNGLTNDRTDMIGMFEFWWHHGLISDETLESGLKICPGSSFIHIEPECQKIWDKAVEEQGNIDGYSIYTPPCDKGTPYARRRLRRSRRPLMLPAYDPCTAFYSTKYLNLPEVQTAMHANVSGIIDYPWVLCSDPLYYNWTDTPASMLPIYKELIGAGLKVWVFSGDTDTAVPLSGTRRSLAALGLPVKTSWYPWYIVSTETRVLLSSPIRSSCPPMVMTAESYAEPVVMIMVFTTGSDGHYFHLPSNQRWNFFLPPVWFYNSN

SEQ ID NO: 5440 - protein, 147 aa, Arabidopsis thaliana
  misc_feature (72)..(72): Xaa can be any naturally occurring amino acid
  misc_feature (84)..(84): Xaa can be any naturally occurring amino acid
  unsure (1)..(147): unsure at all Xaa locations
MASSMLSSATMVASPAQATMVAPFNGLKSSAAFPATRKANNDITSITSNGGRVNCMQVWPPIGKKKFETLSXLPDLTDSELAKXEVDYLYPEQSGIPLWLNSSLEQRDLCTREQRVNLTRVLLMDRYWTNVGGFPFVRVATGFRSKC

SEQ ID NO: 5441 - protein, 458 aa, Pseudomonas putida KT2440
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGEPFFADPREVLRQVVTKFDELGLTICAAFELEFYLIDQENVNGRPQPPRSPISGKRPQSTQVYLIDDLDEYADCLQDILEGAKEQGIPADAIVKESAPAQFEVNLHHVADPLKACDYAVLLKRLIKNIAYDHEMDTTFMAKPYPGQAGNGLHVHISVLDKDGNNIFTSEDPEQNAALRHAVGGVLETLPASMAFLCPNVNSYRRFGAQFYVPNAPSWGLDNRTVALRVPTGSADAVRIEHRVAGADANPYLMMAAVLAGVHHGLTNKIEPGAPIEGNSYEQLEQSLPNNLRDALRELDDSEILNKYIDPKYIDIFVACKESELEEFEHSISDLEYNWYLHTV

SEQ ID NO: 5442 - protein, 299 aa, Geobacillus kaustophilus HTA426
MQDGKPFSFGWIHQGKEEWNDEQRTNDRAHRRGSMAEALIAGMTKAFCHPAHIVVANRQNRARLEELARQYGVCTAGCAQEAVKQADIVILAMKPKDVVEAMNAIAPTLRAHQLILSLLAGITTETIERLAGRNIPVVRAMPNTSAAVGLSATAIAGGRFAAKEHLEVAKQLFETVGIVAVVPEKDLHAVTGLSGSGPAYVYYLVEAMEKAAADIGLERDVAKRLILQTIIGAAEMLKASDKHPSVLRREVTSPGGTTEAGIGVLEQYRFQEAVIACIRRATARSEELGSALLAAIAEA

SEQ ID NO: 5443 - protein, 437 aa, Trifolium pratense
MNIKLATALTICYVIYISNINAIDPCASQPDDSDLNVIPMYGKCSPFNPPKADSWDNRVINMASKDPARMSYLSTLVAQKTATSAPIASGQTFNIGNYVVRVKIGTPGQLLFMVLDTSTDEAFVPSSGCIGCSATTFYPNVSTSFVPLDCSVPQCGQVRGLSCPATGSGACSFNQSYAGSTFSATLVQDSLRLATDVIPSYSFGSINAISGSSVPAQGLLGLGRGPLSLLSQSGAIYSGVFSYCLPSFKSYYFSGSLKLGPVGQPKSIRTTPLLHNPHRPSLYYVNLTAISVGRVYVPLPSELLAFNPSTGAGTIIDSGTVITRFVEPIYNAVRDEFRKQVTGPFSSLGAFDTCFVKNYETLAPAITLHFTDLDLKLPLENSLIHSSSGSLACLAMAAAPSNVNSVLNVIANFQQQNLRVLFDTVNNKVGIARELCN

SEQ ID NO: 5444 - protein, 432 aa, Brassica napus
  misc_feature (402)..(402): Xaa can be any naturally occurring amino acid
  unsure (1)..(432): unsure at all Xaa locations
STHASASLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGNMDVYNILKARGAKVPKTKKTPMVVANPRHVPDYELNPQELQVRKADGISKGIYQVAKWNGTKVSVKILDKDLYKDHDTINAFKHELTLFEKVRHPNVVQFVGAVTQNVPMMIVSEYHPKGDLGSYLQKRGRLSPSKVLRFALDIARGMNYLHECKPEPVIHCDLKPKNIMLDNGKHLKVAGFGSISFSKLSSDKSRLLNHGAHIDLSNYCVAPEIYKDEIFDRSVDSYSFGVVLYEMIEGQPFHPKPPEEAVKLMCLEGRRPSFKSKSKNCPQEMRELIEECWDVKAVVRPTXFSEIIVRLDRIFGQCSKQGWWKDTFKFPWK

SEQ ID NO: 5445 - protein, 957 aa, Pseudomonas putida KT2440
MSQSPSLHQLQELNPFLRRHLGPDATEQQAMLNALGIASRNELIEQTVPPDIRLNRPLDLPAALDEQAALAKLAGYAEQNQVWTSLIGMGYHGTITPTVILRNVLENPGWYTAYTPYQPEIAQGRLEALLNFQQMVIDLTGLPLANASLLDEATAAAEAMALAKRVARNKSNAFFADEHCHPQTLSVLKTRAEGFGFELIVDSVDNLAKHSVFGALLQYPDTHGEVRDLRPLIDQLHSQQALACVAADLLSLVVLAPPGELGADVVLGSTQRFGVPMGYGGPHAAYFACRDDYKRAMPGRIIGVSRDARGNTALRMALQTREQHIRREKANSNICTAQVLLANIAGFYAVYHGPEGLQRIAQRVHRLTFILAAGLEAKGIKRLNQHFFDTLTLNVGGAQAAIIESAEAAHINLRILGRGHLGVSLDETCTEQTVLRLLDIFLGVDHGLEITALDQLALPEGIPASLVRRTPFLAHPVFNLHHSETEMLRYLKQLENKDLALNQSMIPLGSCTMKLNATSEMIPITWPGFAQLHPFAPAAQAAGYKAMIDELESWLCAITGFDAICMQPNSGAQGEYAGLMAITRYHCSRHQPMRTLCLIPSSAHGTNPASAQMAGMEVVIVDCDNDGNVDLADLKAKAHAAGERLSCLMITYPSTHGVYEEGIREICDVVHQYGGQVYMDGANLNAQVGLARPADIGADVSHMNLHKTFCIPHGGGGPGMGPIGIRAHLKPFVASHPVVPVPGLDPNNSAVSAAPWGSASILPISWMYIAMMGPQLADASEVAILSANYLASQLGAAFPVLYRGRNQRVAHECILDLRPLKALTGISEEDVAKRLMDYGFHAPTMSFPVPGTLMVEPTESESKAELDRFVEAMLAIRAEIDEVQQGNWPAENNPLKHAPHTLADVLGVWDRPYSLEQAVAPSAHVRQHKYWPAVNRVDNVYGDRNLFCACVPVEAYR

SEQ ID NO: 5446 - protein, 134 aa, Triticum aestivum
  misc_feature (82)..(82): Xaa can be any naturally occurring amino acid
  unsure (1)..(134): unsure at all Xaa locations
MSWAGPDEILLSTSLAGFLDKKLIVLLRDGRKLLGTLCSFDQFANVVLQGACERVIVGELYCDVPLGLYVIRGENVVLIGRXWVREKDELPSHMTCVSEAEIRTAEKAEKEARDLKGTMRKRMESKLDVINIIS

SEQ ID NO: 5447 - protein, 489 aa, Bordetella pertussis Tohama I
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVPEAAGEIAYAASFLEWFAEEAKRIDGDILQSPKGGQRLMVLKQPIGVTAAITPWNFPAAMITRKVGPALAAGCTMVVKPAQQTPLTALALAVLAVLAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGEPHALGGSFFQPTVVRDVTQSMRFAVEETFGPVAPLFKFDSEDEVIGMANNTIFGLAAYFYTRDYARIWRVSEALEYGIVGINTGIISNEVGPFGGVKQSGLGREGSKYGIEDYLELKYLCVDLGA

SEQ ID NO: 5448 - protein, 162 aa, Brassica napus
  misc_feature (55)..(55): Xaa can be any naturally occurring amino acid
  misc_feature (159)..(159): Xaa can be any naturally occurring amino acid
  unsure (1)..(162): unsure at all Xaa locations
MGKIGKRNGRHRSSRFNTCSVSDPMKDADTLPLSPSSPAANAKKENGYSALFRSXAKGRYKFWALAAILLLAFWSMLTGTVNLRWSAGNISHFTDDLVFPIHEDLDVLEMEEREKVVKHMWDVYNNGRRIRLPRFWLEAFEAAYEELTSDVADVVEAAXSEI

SEQ ID NO: 5449 - protein, 378 aa, Arabidopsis thaliana
MALSTTPSQMSVALPTRIDGSSRSMIKVQSISFTDKSWGPPLLRLDSKSRSLGVKKRSTICMSLQQSSKSKVLVTPLELEDPKETPLNLFRPKEPYTATIVSVERIVGPQAPGETCHIVIDHDGNVPYWEGKSYGVIPPGENPKKPGAPHNVRLYSIASTRYGDSFDGKTASLCVRRAIYYDPETGKEDPSKAGVCSNFLCNAKPGDKVKITGPSGKVMLLPEDDPKATHIMIATGTGVAPYRGYLRRMFMENVPNFKFDGLAWLFLGVANSDSLLYDEEFAGYRKDYPENFRYDKALSREEKNKKGGKMYVQDKIEEYSDEIFKLLDNGAHIYFCGLKGMMPGIQDTLKRVAEERGESWEQKLTQLRKNKQWHVEVY

SEQ ID NO: 5450 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 5451 - protein, 430 aa, Helicobacter pylori 26695
MELLHSINDFNEAKQVIAGGVNSPVRAFKSVKGTPPFILKGKGAYLYDVDNNHYIDFVQSWGPLIFGHADEEIEENIINALKKGTSFGAPTELETTLAKEIISCYEGLDKVRLVSSGTEATMSAIRLARAYSQKDDLIKFEGCYHGHSDSLLVKAGSGCATFGSPSSLGVPNDFSKHTLVARYNDLNSTEECFKKGNVGCVIIEPIAGNMGLVPAQKEFLLGLKALCEKYQAVLILDEVMSGFRASLSGSQEFYGVVPDLVTFGKVIGAGLPLACFGGRAEIMDLLSPIGSVYQAGTLSGNPLAVCAGLSALYKIKRDKTLYTRLDALAIRLTQGLQKSAQNYNIALETLNMGSMFGFFFNENAVHDFDDALKSDTEMFAKFHQKMLFKGVYLACSSFETGFICEPMTEEMIDLTIAKADESFDEIIKGV

SEQ ID NO: 5452 - protein, 82 aa, Oryza sativa
MAGGGQQPSTERKETSSAFGGGCCGGGFQMPLHYPRYKKADYEAMPEWRVDCLLREYGLPVDGGVEEKRRFAMGAFLWPDQY

SEQ ID NO: 5453 - protein, 172 aa, Capsicum annuum
MASKGIALICMTLVTIMSTMISVEVMAQSDCTSTLITMASCLSFVTGSAKTPPASCCSSLSGVLQSNPRCLCVIVNGGGSSLGVQINQTQALALPSACNLQTPPVSRCYAGNAPVISPEGAPTEGTPDSSTGVAVTGSKASGSSTSDGSSLKVPVRAAVAIVIFMASYISMI

SEQ ID NO: 5454 - protein, 304 aa, Desulfovibrio desulfuricans G20
MNEVVMSFPVYILSKLQGCSMRPLAPEALGGAHALWQRDVRLLPAFEPCRNEVYEGYATSGGPGCGAVFICDGVGSSLDAAHALHAAGELPVWTSVLAVSQQSGRGQMRRQWVSPAGNIYAALRFPAASNYPDSLSSLVAGYVFARAFEMCGIDVRMKWPNDLLLDDCKMAGILLEDRNGALLVGIGINVAHFPRADCLREGAAVPACGLAARGFDFAPFELWRQLVDRAFFCYRNEVLRFSEDGLISRLEAYLAWVGRVVMIHGSDLGSCPGRLMGLSHDGALRVLLSGREQVLHSCSLSPIS

SEQ ID NO: 5455 - protein, 810 aa, Oceanobacillus iheyensis HTE831
MKLRKKKLVNRISQELAHQKGLTIEGASSRDIYEVLASIINESMEDNWKATQEGYAYGKYKQVYYLSMEFLIGRLMESNLLNLGLLDEAKEAIRELGFNEEEVFSQEHDAGLGNGGLGRLAACFLDSLASLQYPGHGYGIRYRYGLFEQRIIHGNQVELPDYWLTYPYPWEYRKEEDAVVIHFEGNVHIHEDQDGNLIFSYDQTNKVKAIPYDIPISGYQNGTVNTLRLWSAEAIDNIGGSLEENTTYYKELAHQHTIEQISGFLYPDDSSEEGKSLRLKQQYFLVSASIQSIVQQYKQTHKISIDRLHEKVSIQINDTHPSLGIPELMRILLDEEGLSWDNAWKVTTNTFAYTNHTTLSEALEKWPVATIKQLMPRIYMIIEEINERFCQELWLDYKHLRNQIADMAIIAHDTVHMAHLAIVGSYRVNGVARIHTEILKTQEMKYFYQRFPDKFTNKTNGITHRRWLLQVNPELSTLVTDVIGSQWIKRPKKLISLLKYAEDSSVLEKLKEVKLTNKQKLASVIQQRTGIMVDPHSIFDVHIKRLHEYKRQLLNVFHIIYLYNELKDNPQQDVIPRTFIFAAKAAPSYYMAKEVIKLIHTVASIVNHDPDIKGKLKVIFLENYQVSLAEQIIPAADISQQISTASKEASGTGNMKLMMNGAITLGTLDGANIEIRDVVGNDNMFIFGLTAEEVIEYYRNGSYSARALYDQDERIRRILDQLNDGDFGIHQMEFKDIYYHILSHNDPYFVLQDFEPYLEAHELVERAYRNKNKWLSMSLTNIAHSGKFSSDQTIQSYATDIWKLKQVPIK

SEQ ID NO: 5456 - protein, 506 aa, Saccharomyces bayanus
MPESRLQRLANLKIGTPQELRRTSIIGTIGPKTNSCEAITALRKAGLNIIRMNFSHGSYEFHQSVIDNALKSEQQFPGRPLAIALDTKGPEIRTGRTPNDQDFHILVDHQMIFTTDAKFEHSSNDKIMYIDYANLTKVIVPGKLIYVDDGILSFKVLQIMDDANIRVQALNSGYISSRKGVNLPNTDVDLPPLSAKDIQDLQFGMRNGIHMVFASFIRAPEDVLTIRKVLGTEGEDIKIISKIENQQGLDNFDEILQVTDGVMIARGDLGIEILAPEVLAIQKKLIAKCNVAGKPVICATQMLESMTYNPRPTRAEVSDVGNAVLDGADCVMLSGETAKGDYPVNAVKIMAATALIAESTIAHLALYDDLRDATSKPTSTTETVAAAATAAILEQNGKAIVVLSTTGNTARLLSKYRPSCPIILVTRHARTARIAHLYRGVFPFVFEPKRLYDWGEDVHRRLKFGVEMARSFGMVESGDTVVSIQGFRGGIGHSNTLRVSTVGEEF

SEQ ID NO: 5457 - protein, 252 aa, Geobacillus stearothermophilus
RKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 5458 - protein, 271 aa, delta proteobacterium MLMS-1
MDNIRQLQEKKARGEKLTMLTAHDAALGALVDQAGVDLVLVGDSLGMVALGYDSTVPVTMDEMIHHARAVRRGVSGALLVGDMPFLSYQADKRGAIINAGRFLKEAGCAAVKMEGGAALAPTVEAVVAAGIPVLGHIGLTPQTAGQLGGFKVQGRDAASAARLRHDAEALAAAGVSAVVLECVPALLAREISAALAVPTIGIGAGPYCDGQVLVSHDLLGLFAGFTPKFAKRYVDLGQQAATALATFKKEVEAGEFPSASHSFGPLTEGNE

SEQ ID NO: 5459 - protein, 298 aa, Saccharomyces bayanus
  misc_feature (281)..(281): Xaa can be any naturally occurring amino acid
  unsure (1)..(298): unsure at all Xaa locations
MSRLERLTSLNVVAGSDLRRTAIIGTIGPKTNNPETLVALRKAGLNIVRMNFSHGSYEYHKSVVDNARKSEELYPGRPLAIALDTKGPEIRTGTTTNDVDYPIPPNHEMIFSTDDKYAKACDDKVMFVDYKNITKVISAGKIIYVDDGVLSFEVLEVVDDKTLKVKAMNAGKICSHKGVNLPGTDVDLPALSEKDKEDLRFGVRNGVHMVFASFIRTANDVLTIREVLGEQGKDVKIIVKIENQQGVNNFDEILKVTDGVMVARGDLGIEIPAPEVLAVQXKLIAKSNLAGKPVICAT

SEQ ID NO: 5460 - protein, 601 aa, Escherichia coli CFT073
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTHFSWQAAVVGGIGLAMSSTAMALQLMREKGMNRSESGQLGFSVLLFQDLAVIPALALVPLLAGSADEHFDWMKIGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 5461 - protein, 826 aa, Candida albicans SC5314
MTGEEDKKQHFDASGASAVDDKTATAILRRKKKDNALVVDDATNDDNSVITMSSNTMELLQLFRGDTVLVKGKKRKDTVLIVLADDDMPDGVARVNRCVRNNLRVRLGDIVTVHPCPDIKYANRISVLPIADTVEGINGSLFDLYLKPYFVEAYRPVRKGDLFTVRGGMRQVEFKVVEVDPEEIAIVAQDTIIHCEGEPINREDEENSLNEVGYDDIGGCKKQMAQIRELVELPLRHPQLFKSIGIKPPKGILMYGPPGTGKTIMARAVANETGAFFFLINGPEIMSKMAGESESNLRKAFEEAEKNSPSIIFIDEIDSIAPKRDKTNGEVERRVVSQLLTLMDGMKARSNVVVIAATNRPNSIDPALRRFGRFDREVDIGVPDAEGRLEILRIHTKNMKLADDVDLEAIASETHGFVGADIASLCSEAAMQQIREKMDLIDLEEETIDTEVLNSLGVTQDNFRFALGNSNPSALRETVVENVNVTWDDIGGLDNIKNELKETVEYPVLHPDQYQKFGLAPTKGVLFFGPPGTGKTLLAKAVATEVSANFISVKGPELLSMWYGESESNIRDIFDKARAAAPTVVFLDELDSIAKARGGSHGDAGGASDRVVNQLLTEMDGMNAKKNVFVIGATNRPDQIDPALLRPGRLDQLIYVPLPDEPARLSILQAQLRNTPLEPGLDLNEIAKITHGFSGADLSYIVQRSAKFAIKDSIEAQVKINKIKEEKEKVKTEDVDMKVDEVEEEDPVPYITRAHFEEAMKTAKRSVSDAELRRYESYAQQLQASRGQFSSFRFNENAGATDNGSAAGANSGAAFGNVEEEDDLYS

SEQ ID NO: 5462 - protein, 566 aa, Streptomyces coelicolor A3(2)
MIVNEPVPDTFEDTPAKDRDPDWFKRAVFYEVLVRSFQDSNGDGIGDLKGLTAKLDYLQWLGVDCLWLPPFFKSPLRDGGYDVSDYTAVLPEFGDLADFVEFVDAAHQRGMRVIIDFVMNHTSDQHPWFQESRRNPDGPYGDYYVWADDDKQFQDARIIFVDTEASNWTYDPVRKQYYWHRFFSHQPDLNYENPVVQEEMISALKFWLDLGIDGFRLDAVPYLYQEEGTNCENLPRTHDFLKRVRKEIDAQYPDTVVLAEANQWPEDVVDYFGDYAAGGDECHMAFHFPVMPRIFMAVRRESRYPVSEILAKTPAIPSGCQWGIFLRNHDELTLEMVTDEERDYMYAEYAKDPRMRANIGIRRRLAPLLDNDRNQIELFTALLLSLPGSPILYYGDEIGMGDNIWLGDRDAVRTPMQWTPDRNAGFSSSDPGRLFLPTIMDPVHGYQVTNVEASMASPSSLLHWTRRMIEIRKQNVAFGLGTYTELPSSNPAVLAFLREHEDDLVLCVHNFSRFAQPTELDLSAFDGRHPVELFGGVRFPAVGDLPYLVTLGGHGFYWFRLRKDAA

SEQ ID NO: 5463 - protein, 398 aa, Pyrococcus furiosus DSM 3638
MIRASKRALSVEYAIRDVVLPARELEKKGIKVIRLNIGDPVKFDFQPPEHMKEAYCKAIKEGHNYYGDSEGLPELRKAIVEREKRKNGVDITPDDVRVTAAVTEALQLIFGALLDPGDEILVPGPSYPPYTGLVKFYGGKPVEYRTIEEEDWQPDIDDIRKKITDRTKAIAVINPNNPTGALYDKKTLEEILNIAGEYEIPVISDEIYDLMTYEGEHISPGSLTKDVPVIVMNGLSKVYFATGWRLGYMYFVDPENKLSEVREAIDRLARIRLCPNTPAQFAAIAGLTGPMDYLKEYMKKLKERRDYIYKRLNEIPGISTTKPQGAFYIFPKIEVGPWKNDKEFVLDVLHNAHVLFVHGSGFGEYGAGHFRAVFLPPIEILEEAMDRFEKFMKERLKE

SEQ ID NO: 5464 - protein, 458 aa, Pseudomonas fluorescens Pf-5
MSVPPRAIQLNEANAFLKKHPEVLYVDLLIADMNGVVRGKRIERTALHKVYEKGINLPASLFALDINGSTVESTGLGLDIGDADRICYPIPGTLSVEPWQKRPTAQLLMTMHEIEGQPFFADPREVLRQVVSKFDEMGLTICAAFELEFYLIDQDNVNGRPQSPRSPISGKRPHSTQVYLIDDLDEYVDCLQDILEGAKEQGIPADAIVKESAPAQFEVNLHHVSDPIKACDYAVLLKRLVKNIAYDHEMDTTFMAKPYPGQAGNGLHVHISILDKQGNNIFASEDPETNEALRHAIGGVLDTLPQQMAFLCPNVNSYRRFGAQFYVPNSPTWGIDNRTVAVRVPTGSADAVRIEHRVAGADANPYLLMASVLAGIHHGLTNKIDPGAPVEGNSYEQNEQSLPTNLRDALRVLDDSEVMAKYIDPMYIDVFVACKESELAEFENSISDLEYNWYLHTV

SEQ ID NO: 5465 - protein, 817 aa, Synechococcus sp. WH 5701
MAASTVPPTDLGASPSLDGHALAEAMRRHLFFTQAKSPSLATSHDYYRALAMAVRDQLLQSWVDTAEAYTQSGVRTVSYLSAEYLLGPHLENNLVNLGLREAAQEACDELGLDLMHLIAQEPEPGLGNGGLGRLAACFQESMASLELPAIGYGIRYEFGIFRQQIKAGSQVESTDPWLAQGNPWEVIRAEWTYPVTIGGHTVMGVAYDTPILGYGVHTANTLRLWSAQAPESFDFASFNAGDYTRAVLQKINSETLSKVLYPNDETDQGKQLRLSQQIFFVSCSLQDMFRILKGQGLPVTEFHTKFAVQLNDTHPAIAVAELMRLLIDEHGVDWDTAWSITTSCVSYTNHTLLPEALETWGVDLFEQLLPRQLEIIYEINTRFLRMVRIRHPGQPALLERMSLIQEGPHRKVRMANLAVVGSHRVNGVAELHSKLVRKDLFAPFVELWPDKFTNVTNGVTPRRWIAVANPSLSDLLDDTIGSNWRRDLGELSRLESYADDGGFLERWRGVRDHNKQRLANLIHQQLGVLVDPASLFDVQVKRIHEYKRQHLAALQIVERYLRIRNGEDLPPRTFIFGGKAAPGYAMAKLIIRLIGGIAEIVNMDPAMDGRLRVVFLPNFSVSLGQKVYPAVDLSEQISTAGLEASGTGNMKMALNGAVTIGTLDGANIEIRDLVGHENFFLFGHTAEQLEVINRSGYHPMPWLENDPIAREAIDLIGSGHFSEGDRDLFHPLLANLCGSDPFRVMADIGDYRKAHNAVDAAWVDSVGWSRMSLLNSARCGFFSSDRSIRDYAERIWNVESMPINACTVLPSAQPGSR

SEQ ID NO: 5466 - protein, 523 aa, Methanosarcina barkeri str. fusaro
MKVLVSDSLSNEGLEILKEHFKVDVSTGLSEDELVKKIKDYDALVIRSGTHVTQKIIEAADNLKIIGRAGVGIDNVDVDAATKKGIIVANSPEGNMISAAEHTIAMMMAMSRNIPQANASLKGKEWKRSKFTGVEVKGKTLGIIGLGRIGSEVAKRASGLEMNLMGYDPFVSEKRAIELGVKLATVNEIAKEADYITVHTPLIKETRNILDEEQFALMKPTTRILNCARGGIINEEALAKALESGKIAGAAIDVFIEEPPFNSPLLSFDNVVVTPHLGASTKEAQVNVAVDIAKEVASVLTGGPAKNAINIPSVKPEAMAVLAPYIRLSEIMGKIAGQLVDGNYEKVEIGYNGEISGKDTRPLTVSALKGLLEMALGSGVNYVNAPTLAKSRMIAVVESKSESSEEYSSTISIKLSSNGKEKLVAGTVVGDDPKIVAVDDDRVDIFPAGRMIFAKHINRPNVIGPCCMVLGKNNINISGMQVGRSEIGGVTMMVLNIDSEVSDPILEEVRKVDGILDAKLVTL

SEQ ID NO: 5467 - protein, 303 aa, Rubrobacter xylanophilus DSM 9941
MSAPRVIVVGDVLYDMVARVEGGLPVGADSFVRIQDSPGGSGANVAAWLASLGVEAHLVGRVGEDPLGDHLEAGLREAGVRTHLPRDPSLPTGRVFVLVDGSGERTMITDRGAGEALGPRDIPARLFAPGAHLHLTGYLFSGGGRREAALEALRLARSAAMSFSVDPSSVTLLRAVGVERFAGWTSGADLLFPNLSEAALLSGRAEPEEAARRLLERYRAVVLKLGPEGALYADREGRRARLPAPRVRRADATGAGDALCAAFLASWVRGEPPARALREGVRLAARVVGRTGARGFRRTRGPC

SEQ ID NO: 5468 - protein, 510 aa, Oryza sativa
MAVMEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 5469 - protein, 357 aa, Pseudomonas fluorescens PfO-1
MATMKAAIFVEKNRIVLDDKPIPEVGPLDALIRITTTTICGTDVHILRGEYPVAKGLTVGHEPVGIIERLGSQVRGFVEGQRVIAGAITPSGQSYACLCGCGSQDGPDTRHGFRAIGGWKFGNTIDGCQAEYVLVPDALANLCPIPDGLSDEQVLMCPDIMSTGFSGAERGEVSIGDSVAVFALGPIGLCAVAGARLKGASTIIGVDAVAERMTVARRLGATHVVNFREGDVVEQIMALTDGRGVDVAIEALGTQGTFESALRVLRPGGRLSSLGVYSSDLRIPLDAFAAGLGDYSIVTTLCPGGKERMRRLMAVVQSGMVDLSPLVTHRFKLDDIEAAYDLFAHQRDGVMKVAITP

SEQ ID NO: 5470 - protein, 126 aa, Brassica napus
  misc_feature (31)..(31): Xaa can be any naturally occurring amino acid
  unsure (1)..(126): unsure at all Xaa locations
IRLSSLRYAPPSPAPRGRFVAARVKAEAEAXATEKLGVRVERNPAESRLSELGVRQWPKWGCEKSKFPWTYSAKETCYLLQGKVKVYPDGEEGFVEIAAGDLVVFPKGMSCTWDVAEAVDKHYKFE

SEQ ID NO: 5471 - protein, 287 aa, Prochlorococcus marinus subsp. marinus str. CCMP1375
MSTQIIQWYPGHIAKAEQQLSKSLEKVDLVVEVRDARIPLATGHPCLHKWIRNKKHLLVINRRDMISQKAFNSWDNWFKENGQEAWWCNAKDGNGTNKIKEAAIKLGNDLNNRRESRGMRKRAVRALILGFPNVGKSALINRLVNKKVVKSARRAGVTKSLQWVRVGQQLDLLDAPGVLPPQLEDQEAAVKLALCDDIGQASYDVESVAIKFLNILNQVKNESDFETSNQILEKRYGISWEESNNNVHLWLENAANYHTSGNTNRMSQRLLDDFRKRLIGTISLELP

SEQ ID NO: 5472 - protein, 393 aa, Rhodopirellula baltica SH 1
MPEVSSASNHRFQPSSNRQRVNMHPWIADRTASFDSSGIRKVFDLAAKLKDPINLSIGQPDFDVPEEIQDATVDAIRSGKNAYSPTQGIAPLREKLLAEINAKYPGQNRDVFVSSGTSGGLVLSLLSMINPGDEVIFLDPYFVMYPALVSLCGGIPVTVDSYPDFRLDPAKIEAAITPKTKMILVNSPANPTGVTASEQDLRDVGDLAAKHNIALLSDEIYSRFFYDGDFASPAATNPDTIVIDGFSKSHAMTGWRVGYVHGPPEIIATMLKIQQYSFVCSPQPAQWGALRAMEISLDGHIDDYRRKRDFMVEQLSPHFELTSPGGAFYLFPKAPGTEGGTAFVERAIADGLLIIPGKIFSSRDSHFRVSFAASDDTLRRGAERLIKLAGDNR

SEQ ID NO: 5473 - protein, 818 aa, Magnetospirillum magnetotacticum MS-1
MKKAKPPVVRLLSDDVASIKEAIGSHLLYTVGKEPINATARDWFMAAAHTVRDRVTEHWMPTLNRYYREDSKRVYYLSMEFLIGRTLVNSLINLGLYDTVRQAISELGQDFDEVAAWEVEAALGNGGLGRLAACLLDSMATIGVPGFGYGIRYDYGMFTQHVDNGWQVESPENWLRYGNPWEFPRPGVIFPVRFGGRVIHFRDVLGHTRSQWVDAEEVMAMAFDVPVPGYGGKVVNNLRLWSAKSTREFDLKYFNAGNYIEAVRDKNESETLSKVLYPSDMTDRGKELRFKQEYFFVAASIQDILARFRKSHSDWNRLPDKVAIQLNDTHPALVVAELMRVLVDEHQIEWSQAWDLVRGCCAYTNHTLLPEALETWSIDLFERVLPRHLEIVFALNHEFLQGVRYRHPGDSELLRRVSLIAEGDERRVRMGHLAVIGSHKVNGVAAIHTGLMKSTIFSDFEHLSPGKITNKTNGVTPRRWLLAANPALAALITSQIGDGWITDLDKLHRLEPLADDPAFRKQFAAVKRGNKERLAVMLSQRLGVEVDVDSLFDVQVKRIHEYKRQLLNVLHVITRYGRIRSNPLIHPVPRTVIIGGKAAPGYHIAKLIIKLVNDVAEVINNDPLVGGKLKLIFIPNYNVSTAELVMPAADLSEQISTAGTEASGTGNMKMSMNGALTIGTWDGANVEICEEVGEENMFLFGLSAQDVARRRVDGYDARAAVKADPDLSWALEMIGTGFFSSDQPDRYQQLVDILTTGGDHYLLSADFPLYMAAQERVDQTYRDPEDWTRKAILNVARMGKFSSDRTVAEYAREIWGAL

SEQ ID NO: 5474 - protein, 466 aa, Lactobacillus johnsonii NCC 533
MNENETSKLGFWSIVLLAINSIIGSGIFLTPGSVVQQAGSKALIVYFIAAIFASILAISFAAAAKYVTKSGAAYAYSKAAFGNNVGFYMGILRYFSASVAWGIMAVGVIKSTISIFGGNPNETMSVTIGFLILMAVITVINLFGQKVVKYVMNLATIGKLAALVLIIVAGVVLLIVSGASSNLSQVDQITQNGQKIVPTLTTTGFVMAIVSAFYAFTGFESVASGSDDMKNPAKNLPRAIPLAIIVIAVIYIGVVAVAMMLDPKALMTTKQVVAIAAIFKNEILRDVILVGALVSMFGINVASSFNAPRILEAMARENQFSKALTKRTKNNFPIRTFFISVLFAILIPMAFEYNMVNLITLSAMVRFLGFIVVPLAVIQFYRGKTAEPVLDAQRNVWTDIVVPILSIVLVIFLLVEYNWKAQFGVVNAQGQVTGINWYAIAMMIFGFILLPLIMFIISRKDRKASK

SEQ ID NO: 5475 - protein, 530 aa, Vibrio vulnificus CMCP6
MEIILITTAFVAGFLALKCNLPPLVGFLLAGFALHAFGFESNLTITTLADLGVTLLLFTIGLKLEIKTLLSKEIWAGATAHNLLSTLLFTAAFIGLKFLGISSLAEMETGHLVLLAFALSFSSTVFAVKSLQEKGEMNATYGTLAIGILIMQDIFAVVFLTASTGKLPHWYAIALFALPLLRPLFYKILDWVGHGEMLVLFGIFFALVAGAGLFELVGMKPDLGALVLGMLLAGHRKSSELAKSLFNMKELFLVCFFLNIGLSASLSLTGVSLALLILLLLPLKGLLYFLTINHFKFRVRTSLLASLTLFNYSEFGLIVGGLAYKMGWMPSDILVALAVAVSLSFILAAPLSKMGHQIYQHSGKWLQETAAEKLNQRDQLINPGNAQVLILGMGRIGTGAYDELRARYGKISLGVEVREEAAQHHREEGRNVIAGDATDPDFWERILDTANVKLVLLAMPHHQGNQTALEQLKRRNYQGQIAAIAEYTDQLEMLTNSGVHAAFNIYNEAGSGFARHVCEQLQPQFAPPSN

SEQ ID NO: 5476 - protein, 460 aa, Lactobacillus johnsonii NCC 533
MENKQNHPPKLKRSMTAGQMEMISLGGAIGVGLFMGSTSTIKWTGPSVLLAYMFVGLILYIVMRALGEMLYVSPGTGSFADYATEYISPLAGYLAEWANVFQYIVVGISEVVAATEYLKFWWPEVSVFWSGIIIIAFLLLANLASAKAYGTLEFWFAMIKVVTIVIMIILGLLVILLGVGNHGKPIGFSNLWSHGGFFTGGVKGFFFSMAIIAGSYEGIELIGISAGEVANPQEAIVKSVKSVLWRILIFYVGAIFVIVTIYPWNQLSNIGSPFVETFTKVGITAAAGIINFVVLTAALSGANSGIYSSSRMLFKLAHEGEAPKAFGKLSKRIVPDRAIVGITSGILIGFILNLIMSTMNKSMGELFVVVYSSSVLPGMVAWFVILIAELKFRKNNSHLMAEHPFKLPLYPYSNYFAFAMLLVIVVFMFINPETRISVGVGAGVLVLASLVYMLKHRNKK

SEQ ID NO: 5477 - protein, 464 aa, Lactobacillus johnsonii NCC 533
MENKKSMPKLKRSMTAGQMEMISLGGAIGVGLFMGSTSTIKWTGPSVLLAYMFVGLILYIVMRALGEMLYVNPGTGSFADYATEYVHPLAGYLAEWANVFEYIVVGMSEVVAATEYLKFWWPKVNVFWSGIIIILFLVLANLASAKAYASLEFWFAMIKVVTIILMIILGFIVIFFGVGNGGKPTGFSNLWSHGGFFTGGVKGFFFSMSIIVGSYEGIELLGISAGEVANPKKAIVKSVKSVLWRILIFYVGAIFVIVTIYPWNELSNIGSPFVTTFAKVGITAAASIINFVVLTAALSGANSGIYSSSRMLFKLAHDGDAPKTFGHISKRIVPNHAILGISGGILIGFIINMIAATINKSTQDLFVVVFSSSVLPGMIPWFVILLAELKFRRNNQDLLVDHPFKLPLYPISNYFAFLMLIVIVIFMLINPETRVSVLVGAAVLLIATIVYLFRHKKDGVNNGE

SEQ ID NO: 5478 - protein, 256 aa, Vibrio parahaemolyticus RIMD 2210633
MRRPVVMGNWKLNGSKAMVTELLTGLNAELEGVEGVDVAVAPPALYIDLAERLIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAAAKA

SEQ ID NO: 5479 - protein, 190 aa, Momordica charantia
FDSFWFVQQWPPAVCSFQKSGSCPGSGLRTFTIHGLWPQQSGTSLTNCPGSPFDITKISHLQSQLNTLWPNVLRANNQQFWSHEWTKHGTCSESTFNQAAYFKLAVDMRNNYDIIGALRPHAAGPNGRTKSRQAIKGFLKAKFGKFPGLRCRTDPQTKVSYLVQVVACFAQDGSTLIDCTRDTCGANFIF

SEQ ID NO: 5480 - protein, 131 aa, Prunus avium
NCNGSQFEDRKVYPELRSDLKRSWPDVKNGNDTNFWAGEWNKHGTCSEDTLNQMQYFERSHDMWISYNITKMLKSSQIVPNARQTWSYSDIVSPIKTATGRTPLLRCKPHPKSQTKSRPKSQAKSQPKARP

SEQ ID NO: 5481 - protein, 120 aa, Prunus avium
EPVLQWVAIKRLPPQLISKLKISWPNVESSNDTKFWEGEWNKHGTCSEQTINQLQYFERCYEMWKSHNITEILKNASIVPHPTQTWTYSDIVAPIKAATKRTPVLRCKPDPAQNKKGRRL

SEQ ID NO: 5482 - protein, 274 aa, Ralstonia solanacearum
MTTQMPIASPRTEFYERAFGGFHDQAVAEVRKETYGEDLGQNDWSTVDEMRQFSQWLELSPQSHLLDVCSGSGGPALFLARNSGCRVTGVDLHPDALQTGRQLAQALELHDRSQFVECDVRQRMPFPDGTFDALWCIDSVIHIPDRLALLREWCRLLKPGGRFLYTDPTLVTGMVSKEEILLRGTPGYFLYTPIGLNERLIEQAGLRLDMQADLTHSITELSERWHAAREKRCAVLTATEGEEAFARMQSFLTATHRVSVEGRLSRWVFVGVRP

SEQ ID NO: 5483 - protein, 118 aa, Prunus avium
ARTCTGARFNFTKVYPQLRKDLKKSWPDVESGNDTKFWEGEWNKHGTCSEQTLNQMQYFERSHAMWTSFNITKILKNASIVPHPTQTWTYSDIVSPIKAATGRTPLLRCKGDPKQPNL

SEQ ID NO: 5484 - protein, 311 aa, Magnetospirillum magnetotacticum MS-1
MTWQVLISAPYMIPVIDRFRPWFAEHDIEITVADVQERLEEADLLPIIAKYHGIVCGDDRITKTVIDAAANLKVISKWGTGIDSIDSAYAATKGIPTGRTLDAFTQPVADTALGYILSFARNLPWMDKMMKAGIWDKIPGRALNESTIGVVGVGCMGSAVLRRAKPFGARLLGNDIRTIDPAFVAEVGVEMMDLDSLLEQSDFVSVCCDLNPTSYLLFNDERFKRMKAGSVLVNTARGPVVQEEALVRALQSGKIVGCALDVFEHEPLPKTSALLGMDNVMLAPHNSNSSPKAWERIHHSTLKNLLDGLRG

SEQ ID NO: 5485 - protein, 362 aa, Sorghum bicolor
MHTVSRGEQEKNAISRSPGEYYSPWRAATTTLLLALAAVVSLLLPALAQGSSEDDRILAMPGQPNDVAFDMYGGYITVDEQAGRALFYWFQEADQTAVKDPDDAAPLVLWLNGGPGCSSIGGGALEELGAFRVHKDGERLLLNEYAWNKAHDAYTFLVKWFERFPKYKYRDFYIAGESYGGHYVPQLSQLVYRRNIGVDKPIINFKGFMVGNGLTDDRTDMIGMFEYWWHHGLISDETLARGLKVCPGTSLIHASPECKEVWDVATKEQGNIDGYSIYTPPCEKGNPYARIFERSRRQVGGWSMEYEGLTFVTVRGAGHEVPLHRPEQALFLFKQFLQGEPMPAEAKNASLIQLPSEKAHSY

SEQ ID NO: 5486 - protein, 122 aa, Arabidopsis thaliana
  misc_feature (68)..(68): Xaa can be any naturally occurring amino acid
  misc_feature (80)..(81): Xaa can be any naturally occurring amino acid
  misc_feature (84)..(84): Xaa can be any naturally occurring amino acid
  misc_feature (87)..(87): Xaa can be any naturally occurring amino acid
  misc_feature (94)..(94): Xaa can be any naturally occurring amino acid
  misc_feature (97)..(97): Xaa can be any naturally occurring amino acid
  misc_feature (102)..(102): Xaa can be any naturally occurring amino acid
  misc_feature (104)..(104): Xaa can be any naturally occurring amino acid
  unsure (1)..(122): unsure at all Xaa locations
MASSMLSSTAVVTSPAQATMVAPFTGLKSSASFPVTRKANNDITSITSNGGRVSCMKVWPPIGKKKFXTLSYLPDLSDVXXAKXVDXLLRNKWXPCXEFEFXHXFFVGRETNSRIMIYAKFW

SEQ ID NO: 5487 - protein, 307 aa, Zea mays
MAAATPSPHSARVAVVTGGNKGIGLEVCRQLFSNGITVVLTARDEKRGAAAVEELADAGLSGVVFHQLEVTDAQSIARLAGFLKARFGKLDILVNNAAIGGVQSLPVENVGEKIKGMDAFQMAELMRKSCRETNDTAKAGVQTNYYGVKNVTEALLPLLLQASSSGGGRVVNVSSDFGLLRYLRNEEVKHELDDIEGLTEERLDELLSTFLRDFEAGALEARGWPTEFAAYKVAKAALNSYSRVLARRHPELRVNCAHPGYVKTDMTRQTGLLKPAQGAANVVKVALLPEGGPTGAFFALGKEAPFV

SEQ ID NO: 5488 - protein, 628 aa, Neisseria polysaccharea
SPNSQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLYLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSQAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQDLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 5489 - protein, 219 aa, Haemophilus influenzae
MNQLEMKKLAAQAALQYVKADRIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 5490 - protein, 494 aa, Synechococcus sp. WH 5701
MSPAASLVPVILCGGTGTRLWPLSRASYPKQYWPLAGSGEETLLQQTQLRLKGLNQLGAPLLICNEDHRFIVAEQMRQIGVEPGAILLEPLGRNTAPAIAVAALHATSRGDDPLLLVLAADHVIQDGARFRATVEAGRAAAEGGLLVTFGIVPTAPETGYGYIEAVEPLPQATPGLGEPPIPTPTPIARFVEKPDAATAEEFLSSGRFTWNSGMFLFRASAILAELERLAPEVVSCCRAAIDHDSADLDFLRLERESFANCPNVAIDVAVMERTGLGAVLPLEAGWSDVGSWSALWDTGARDSDGNVLRGRVISEGSRNCYLRSEHRLVVGLGVEDLVVVETDDAVLVAHRDRAQEVKTIVNRLASSGSPEGKAHRRIYRPWGSYDGIVEGSRWQVKKIVVNPGASLSLQMHHHRAEHWVVVQGTAVVEKDSVEELVGENQSTYIPLGAKHRLSNPGKIPVEMIEVQSGPYLGEDDIVRFDDRYGRSDMSLPVR

SEQ ID NO: 5491 - protein, 393 aa, Pseudomonas aeruginosa UCBPP-PA14
MRYSDFTQRIAGDGAAAWDIHYRALARVEQGEEILLLSVGDPDFDTPAPIVQSAIDSLLAGNTHYADVRGKRALRQRIAERHRQRSGQAVDAEQVVVLAGAQCALYAVVQCLLNPGDEVIVAEPMYVTYEAVFGACGARVVPVPVRSENGFRVQAEEVAALITPRTRAMALNSPHNPSGASLPRATWEALAELCTAHDLWMISDEVYSELLFDGEHVSPASLPGMAERTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 5492 - protein, 428 aa, Oryza sativa
FGSEIDLQGRRSTMRRYDEMPPAMVLVPPPFTFPAAAARTRMAVPAYEVMFGKLQRRSLFDDYFDQVGSITSGMIMLRPLVDSHVDLTAKMTTTGGEALFRWQRYLDDPNTFMDLHLSTPKPMVQLRSCAYYPKYRIGAFGTFPLLKANRDCSEGDYGIMGLRYGSENLSIGASFLPFALSGQVPYGAWLVGRKGNISAGIQYKPLSGESMHPVPLTDLKNWNCAISYGMGSTSPLSPSFNFSLELVRNTQLVASFYQHFVVQRRVMNPREEEHIIGTTNFVDFGLELATSLDKDKAKENASNPSFQVAASWQASKNFLVKGKLGPSKSSMALAMKSWWRPFFTFSFTAMYDHLKGTGSYGFGISIEDLKEPSYQMAYSNYVIVTQNKEDVEPRFLKKLGKKYIFQPDIDSGNYDNLPTGLKPIDKIL

SEQ ID NO: 5493 - protein, 185 aa, Triticum aestivum
  misc_feature (43)..(43): Xaa can be any naturally occurring amino acid
  misc_feature (111)..(111): Xaa can be any naturally occurring amino acid
  misc_feature (130)..(131): Xaa can be any naturally occurring amino acid
  unsure (1)..(185): unsure at all Xaa locations
DIGVIAKIESIDALKNLEEIIRASDGVMVARGDLGAQIPLEQXPSIQQRIVRMCRQLNKPVIVASQLLESMIEYPTPTRAEVADVSEAVRQRADALMLSGESAMGRYPEKXLSVLRSVSLRIERWWREEXXQEDWTSSVSSSFSDKIQRNCIQQLNGNNLDRRVSLHEDHGPVDAARPISLTLQS

SEQ ID NO: 5494 - protein, 320 aa, Triticum aestivum
MPQDDASFLLCAEDAFFFVDAAASTCTTAEQDDGWCSSAEEESAASFVAELIGGEADYSPRSDYSDRLRSRSVDPAARADSVAWIVKVQEYYGFLPLTAYLAVNYMDRFLSLHRLPQEDGWAMQLLAVTCLSLAAKMEETLVPSLLDLQIESTRYIFEPRTILRMELLVLTALNWRLRSVTPFTFIDFFACKVDPRGRHMRYLIARATQMILAAIHDIEFLDHCPSSMAAAAVLCAAGETPSLTSLLNPRLAVNWCIGLAEEGVSSCYQLIQRLVGCKRAATAEAAVNLCSDEVLSCDYSSCTTPPPPKRRKRSPPPVIT

SEQ ID NO: 5495 - protein, 840 aa, Synechococcus sp. WH 5701
MTDAPPRQLRLPTPGCFADPDRSGLTADGVFDGMTEHLFYTLGKLAPTASHHDLYVALSYAVRDRLMTRYLAGIEAISATPARVVAYLSAEFLIGPQLGNNLLMLGIQDEAAEALRRFGIDSLDEILEVEEEPGLGNGGLGRLAACYLESLASLEIPATGYGIRYEFGIFDQLIRDGWQVEITDKWLKSGWPWELPRPDQACFVGFGGRTESYRDTQGEYRVRWLPSEHAIGVPHDVPVLGYRVNTCNRLRLWQAEASESFDFYAFNIGDYYGAVEEKVGSETLSKVLYPNDGTDEGRRLRLKQQHFFVSCSLQDMLRSLELRDLPITDFPEHWSVQLNDTHPAIAVAELMRLLIDHKHLSWDAAWDITTRSLAYTNHTLLPEALEKWGLDLFGSLLPRHLELIFEINRRFLQTVRLKHPGNETMLRRVSIIDENDGKAVRMAHLATVASHHVNGVAALHSDLVRTQLFPEFASLWPEKFTNVTNGVTPRRWIALANPLLRELLDEVIGQDWVHNLDELRKLEAFQNDSGFLERWGQTKLAVKRQLAHYIHRQSGLLVDPSSLFDVQVKRIHEYKRQHLNALQVIAQYLRIKNGLGDNLAPRTVIFGGKAAPGYYMAKLIIRFLNGIAETVNADPDMDGRLRVVFLPNYNVTLGQRVYPASDLSEQISTAGLEASGTGNMKFAMNGALTIGTLDGANVEIREQVGAENFFLFGHTTDGIEALRAGGYRPWELIAGIPELPEALQLVEQGHFSNGDTELFKPLLKNLTGRDPYYVMADFSDYMRAQDTVTQAWGDRTTWNRMSLLNTARSGFFSSDRSILEYAERIWRAEPFPVTISCEID

SEQ ID NO: 5496 - protein, 357 aa, Glycine max
MSAFVGKYADELIKNAKYIATPGKGILAADESTGTIGKRLSSINVENIEANRQALRELLFTAPDALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAAVYKALNEQHVLLEGTLLKPNMVTPGSDSPKVPPEVIAEYTVQALRRTVPAAVPGVVFLSGGQSEEEATLNLNAMNKLEVLKPWTLSFSFGRALQQSTLKTWGGKKENVAKAQEAFLARCKANSDATLGKYVGGSGSGLTSESLYVKNYKY

SEQ ID NO: 5497 - protein, 174 aa, Lactuca sativa
MASISSSAIATVNRTTSTQASLAAPFTGLKSNVAFPVTKKANNDFSSLPSNGGRVQCMKVWPPIGLKKYETLSCLPPLSDEALSKEIDYLIRNKWIPCLEFELEHGFVYREHHHSPGYYDGRYWTMWKLPMFGCTDSAQVMKEVGECKKEYAGTEFAKGSLKVKLLKWPRSPLQ

SEQ ID NO: 5498 - protein, 318 aa, Oryza sativa
MAGMSLQHPWAFAFGLLGNIISFMTYLAPLPTFYRIYKSKSTQGFQSVPYVVALFSAMLWIYYALLKSDECLLITINSAGCVIETIYIAVYLVYAPKKAKMFTAKLLLLVNVGVFGLILLLTLLLSAGDRRIVVLGWVCVGFSVSVFVAPLSIIRLVVRTKSVEFMPFSLSFSLTISAVVWFLYGLLIKDKYVALPNVLGFSFGVIQMGLYAMYRNSTPKAVLTKEVEAATATGDDDHSAAGVKEHVVNIAKLSAAVDVVKTREVHPVDVESPPAEAPPQEDDKAAATAAAVAGAGEKKVAALSACMRTWVAVRRKKA

SEQ ID NO: 5499 - protein, 159 aa, Glycine max
  misc_feature (122)..(122): Xaa can be any naturally occurring amino acid
  misc_feature (138)..(138): Xaa can be any naturally occurring amino acid
  unsure (1)..(159): unsure at all Xaa locations
MVGGDSSPPRALDAETREDLKRVSAHRALHMVESGVTLGFGTGSTAAHAFNRFGAFFRTGALRAVAGVPTSLKTEAHAARVGIPMLALAEGGQDPLLIDGRDEDRPGLHLFKGGGGSLLREXMIEGAGARFVVIVDEXKLVPRLGWTGFVPREDVPFGA

SEQ ID NO: 5500 - protein, 170 aa, Arabidopsis thaliana
MKMEMGLVFLTVFMAVMSSTMVSAQSSCTNALISMSPCLNYITGNSTSPNQQCCNQLSRVVQSSPDCLCQVLNGGGSQLGINVNQTQALGLPRACNVQTPPVSRCNTGGGGGGSTSDSPAESPNSSGPGNGSKTVPVGEGDGPPSSDGSSIKFSFPLIAFFSAVSYMAIF

SEQ ID NO: 5501 - protein, 317 aa, Arabidopsis thaliana
MQLQTQSFALNLLPSPNFAKPIERRELISLKRDPSRPISLRCSVSTTLDTPATASTHKPFPAEVSRSIMELSSVGTLSTLTHDGWPLGVGVRFAVDKDGTPVLCLNRSVSPDKRSALHVQLEQCGLRTPQCTIQGSIGRPGDDTVLKRLSATWKEKFGEEVEEDSLYVVAVDRVLQMEDFMEDGIWVASSDYKNASPDPLRDIAEDIVNQINANNMEDIFRFCNVYVDLDFVVSETKMIWMDRLGFDLRVWSPRGVYDVRIPFPMEVTDEKGAKSSFNGMSQLAWEVEKSYCPADFNKVKLLKQVVGSSHSHKGGGQ

SEQ ID NO: 5502 - protein, 70 aa, Capsicum chinense
MASKGIALICMTLITIMSTMISVEVMAQSDCTSTLITMASCLSFVTGSAKTPPASCCSSLSGVLQSNPRC

SEQ ID NO: 5503 - protein, 398 aa, Chrysodidymus synuroideus
MLLKEKTLIRNLKNFTINFGPQHPAAHGVLRLILELDGEIIVNSDPHIGLLHRGTEKLIEYKTYLQALPYFDRLDYVSMMAQEHTYSLAIEKLMNIKIPRRAQIIRVLFCEITRLLNHLVAVGCHALDVGAMSPFMWGFEEREKLMEFYERVSGARMHAAYFRPGGVASDLPIGLLDDIFIFIKQFKIRLDEMEEMLTSNRIWKERLVDIGIVSAFDAINWGFSGVLLRGSGVPWDLRKSNPYEIYNELNFSYPVGTNGDCYDRYLIRIEEMRQSLSLISQCLNIINDGPIKTTNSKLTSPSLFELKNSMESLIHHFKYYTEGLIPGFGETYTATEAPKGEFGVYLISNNTEKPYRCKIKAPGFGHLQALNFMASGHMIADVVTIIGTQDIVFGEVDR

SEQ ID NO: 5504 - protein, 70 aa, Capsicum chinense
MASKGIALICMTLVTIMSTMISVEVMAQSDCTSTLITMASCLSFVTGSAKTPPASCCSSLSGVLQSNPRC

SEQ ID NO: 5505 - protein, 587 aa, Pseudomonas syringae pv. tomato str. DC3000
MHAINFIQDLAVIMLVAGVVTILFHRLRQPVVLGYIVAGFIIGPHTPPVSLIHDEDTIKILAELGVIFLMFCLGLEFSLRKLFKVGATAFIAAFLEIALMIWIGYEIGQFFGWKTMDSLFLGAILAISSTTIIVKALNDLKMKNQHFAQLIFGVLIVEDILGIGIIALLSGIAVSGSVSSGEVFSTVGKLSLFMIVALVVGILLVPRLLSYVARFDSNEMLLITVLGLCFGFCLLVVKLEYSMVLGAFLIGAIMAESRELLKIERLIEPIRDMFSAIFFVAIGLMIDPKILLEYAWPIAVITVAVVLGKMISCGLGAFIAGNDGRTSLRVGMGLSQIGEFSFIIAALGMTLQVTSDFLYPVAVAVSAITTLLTPYLIRGADPLSLKLAAIMPRRVARVFGMYGEWLRSIQPQGQSAVLAGMIRRILLQVGVNLALVMAIFFSGGYFAERLGGYMDEWVADVSHQKAWICGAALLLSLPFLIAAYRKLKALSMLLAEMGVKPEMAGRHTVRVRKVVAEVIPLLSLVVIFVMLAALSASILPANELLLVVVLVAALVAALLWRWLIRVHTRMQIALLETLGNNQESSGH

SEQ ID NO: 5506 - protein, 536 aa, Haloquadratum walsbyi
MIMHMQVLVTDPIDDAGLERLRAAGHSVETAYDIGDEALLNTITDVNALVVRSGTDVNEAVFEAASDLIIVGRAGIGVDNIDIDAATEHGVIVANAPEGNVRAAAEHTVAMTFAGARSIPQAHARLRTGEWAKSEYLGTEVNGKTLGVVGLGRVGQEVAKRLESLGMDLVAYDPYISEDRAERLGAELVEFDTCLERAEFLTVHTPLTSETAGMISTAELELMDGGYLINCARGGVVDEDALAAAVEDGVLDGAAVDVFADEPVAPDSALLSVDNIVVTPHLGASTEAAQENVATSIADQIDAAFAGAPVMNALNAPSVDESVFPRIRPYIDLAETAGKIAAQLLDGRISSVSVSYEGDIADEDVELATASALKGVFEPLEWQVNAVNAPQIAEERGIDVTESKRLQSDDFQSVVTVEVSNGDDQLAVSGTQFTGGEPRIVKIDGYRVDAVPHGKMLVARNADKPGVIGFIGSVLGEHNINIAGMFNARRDIEGGEALTIYNLDDSVPTDVVERLLADERMIDVRYLTLNGASDTK

SEQ ID NO: 5507 - protein, 190 aa, Zea mays
MRASRPAVHPVEAAPPPPAAAAEGPEAQVEGAAHPRGVRMKDPPGAPGTPAGLGLRLAQAFFAAAALAVMASTNDFPSVSAFSYLVAAAILQCLWSLLLAFVDIYALLVKRSLRNARAVCIFTIGDGITGTITLGAACASAGITVLIGNDLNICAENHCASFETATALAFISWFALAPSCILNFWSMASR

SEQ ID NO: 5508 - protein, 277 aa, Bacillus anthracis str. 'Ames Ancestor'
MSLTSLKDYTTLHNGVKMPWFGLGVFKVEDGSQVIDSVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQDIAKKYNKSTAQIILRWDLQNEVVTIPKSIKEHRIIENANIFDFELSSDDMKAIQALNEDHRVGPDPDNFNF

SEQ ID NO: 5509 - protein, 470 aa, Pseudomonas aeruginosa UCBPP-PA14
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLVESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 5510 - protein, 245 aa, Bacillus anthracis str. 'Ames Ancestor'
MLTKHRILFIGAGRMAEAIFSGLLKTSKEYIEEIIVSNRSNVEKLDQLRARYNVSTTTDWKQHVTSVDTIVLAMPPSAHEELLAELSPLLSNQLVVTVAAGISPSYLEERLPGGTPVAWIMPNTAAEIGKSISLYTMGQFVNETHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALY

SEQ ID NO: 5511 - protein, 481 aa, Rickettsiella grylli
MKLKNPSLFQQQCYINGKWITTPKNITVNNPATLEIIGTVPDLESTHLQHAVTAAEAALPRWMSKTAKERSELLHQWYTLILENSDDLALLLTIEQGKPFSEAQEEIRYGASFIQWFAEEAKRIYGDIIPAGLPQQHLFVNKQAIGVVAAITPWNFPNAMITRKCAPALAAGCTLVLKPSTLTPFSALALGVLAEKAGIPPGVLNIVTGDSELIGNHFTDNPVIRKLSFTGSTAIGRLLMQKAAHSIKKISLELGGNAPFIVFEDADSDQAIQGAVASKFRNSGQTCICTNRFYIHEKMYESFTKKLTHAIQQLNVGNGQEPQVQIGPLINSAAIKKVEKHIADALDKGAELMCGGKKHALGGNFFQPTLLKNCSKDMLIAQEETFGPVAALFRFSKEKEVIEWANDTLYGLAAYFYTKNVDRIIRVTQALDYGIVGVNTGRTSNEVAPFGGFKQSGMGREGSKYGIEDYLEIKYICLNTD

SEQ ID NO: 5512 - protein, 1510 aa, Trichodesmium erythraeum IMS101
MERKYLREALVVGVNRYPMLKNKKVGDSNLKAAAKDAEAIANMLEKYGKFRVQRLPKKYDEEGKETCDHEGIVKVDDLKKAIINLFTPPGKNETPDVALLFFAGHGYVNIEEDIREGFLATSDAKFAKKLSNNEDIFGVPLSWLKDLLQKSQVQKQIVWLDCCFSGELLNFDGVANLNTQEKKVSRCFITASRSFQTATEKIDGEHGLFTDNLLECLNPENYVDGWVDNHVLTESIQEKMSQTSQAPMCDNSGDTIILTTNSLNEPLDERWKNDPPYRGLSYFRQQENDGVFFHGRTSLTDKLIELVKDNNFVAVLGASGSGKSSLLRAGLLYQLKRGQKISGSDRWFYIAPFTPEESPLKSLLKSLGKSLGEIKIKGEKVEGLIQFVDQTEAEQTEGKKVDFLTKELIEEKLIEFIDVVEAERVIMVMDQFEESFTLCKTHEERLDFFDCFLAVLERRGEKFCVVLGIRADFLGRCSEYGGLANKIQGHQLLVTPLDEGEIEEVIKKPAKLVGMDVEPNLVAKMREDFLRNPGSLPLLEYTLDALWSFATQGENKSPYLTLENYTSLGEIEGALTKRADAVFESLNDEEKSVAKRIFLELVQPGEGKISPGKITDTRRRVILEKLPNERHSLELLSAVSDRLADKNNRLMTKDRSEAGILLDIVHEDLIRSWKTLRKWVEEYQEALPVERKIEADAADWEKEGKSENLLLRAGRLTKAEEYLENYGEMALLDGLAYEFIEASRELKIREEEKEKERQRKEKERQRKVEEQAARILGMLSDSMIRQKLSLLDKGVLLSVESMKQYFDIKKRYGKADSGLLVELDQTLRNGVSQLPKHLYTLKHQSDVYAVAFSPDGKTIATASLDKTARLWDTENGNVLATLNHQSSVNAVAFSPDGKTIATASYDKTARLWDTENGKELATLNHQDWVNAVAFSPDGKTIATASYDKTARLWDTENGKELATLNHQSSVIAVAFSPDGKTIATASSDKTARLWDTENGNVLATLNHQDWVIAVAFSPDGKTIATASSDKTARLWDTENGKVLATLNHQSSVNAVAFSPDGKTIATASSDKTARLWDTENGKVLATLNHQSSVRAVAFSPDGKTIATASYDKTARLWDTENGNVLATLLHQDLVIAVAFSPDGKTIATASWDKTARLWDTENGKVLATLNHQSSVRAVAFSPDGKTIATASSDKTARLWDTENGKVLATLNHQSSVNAVAFSPDGKTIATASSDKTARLWDTENGKVLATLNHQSSVRAVAFSPDGKTIATASSDKTARLWDTENGKVLATLNHQSRVFAVAFSPDGKTIATASSDKTARLWDTENGNVLATLNHQFWVNAVAFSPDGKTIATASSDKTARLWDTENGKVLATLNHQSRVFAVAFSPDGKTIATASSDKTARLWDTENGKELATLNHQSLVNAVAFSPDGKTIATANYDNTARLHWATSEGLIQEACSRLSRNLTAKEWQQYINSDLETYQKTCENLPVHPSVTAEAALTSSDQTLWFDL

SEQ ID NO: 5513 - protein, 277 aa, Bacillus cereus ATCC 14579
MILTNLKDYTTLHNGVKMPWFGLGVFKVEDGSEVIDSVKAAIKNGYRSIDTAAIYQNEEGVGQAIRESGVSREELFITSKVWNSDQGYETTLQAFETTLEKLGLEYLDLYLVHWPVKGKYTESWKALETLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 5514 - protein, 267 aa, Bacillus cereus ATCC 14579
MLTKHRILFIGAGRMAEAIFSGLLKTSKEYIEEIIVSNRSNIEKLKQLQHQYNVSTTTDWKQHVTSVDTVVLAMPPSAHEELLAELSPLISNQLVVTVAAGIGPSYLEARLPKGTPVAWIMPNTAAEIGKSISLYTMGQSVNEIHQETLQLLLKGIGTSQLCTEEEVHQLTAVTGSAPAFLYYFAESLIEATKSYGVDEETAKHLVIQMISGSASMLEQTQNPANLREQVTTPGGSTAEGLKTLYEYNFSEAIQKAVEATNKKARGK

SEQ ID NO: 5515 - protein, 489 aa, Gibberella zeae PH-1
MALLSVNLRDGLILTAVITILLYIWEKKTAKITRNGEPLRKPPNTLPLVGNGIIFLQPRQKLFSWFHRCERLYGYETLHITVPSLPPGVIVNDPQNLDFIFRNEGVFEKGEFFKQRSWDLFGHGIINVDGEFWRLQRKAGLRFLSAAALKTLTNEKLPKYLDQAIGVLEAKTNTKEVVDLQAVVHEVTTQLMGRMAYNMEMHADDDFTVAFEHASGGTAERFQNPLWFVTEMFTGARMRRSITTVKAYGKRIVTSAVADRKEAEGKTQSDAPGSLIQSLLDSIGDETLVADAALNYLSAGRDTVAQALTWTLYLLMKNPHVATKLRQSVESLRDEDTSTGDDPELLTPVRLPYVLAVFYESLRLRPPIPFEIKQAQQATTLPDGTFLPAGAIVVWCAWAMGRSHTTWGPNADDFRPERWLTTSLAGDVTVAQRPAAEFPVFNGGPRTLARLVPLFKFEPAFEGERVSKSSLTLPMEGGLPVYVQHQTPS

SEQ ID NO: 5516 - protein, 461 aa, Synechococcus sp. WH 5701
MSSLPSPASADPLTEPQLSWQQRKLDLLSQGVSYALASFVDLHGTSKAKAVPLDHFEAMLAGSELFTGAALDGVPQDVSDDEVAAIPDLATATVLPWRRDVVWLASSLHLHGQPFEACSRNILIRALDEAQRMGFRFNLGIETEFFVLRRGADGALRPASSRDTLEKPCYDLTGLLDNLPWLDELVQAMNDLGWGVYSFDHEDGNGQFETDFAYAEALTMADRLTFFRLMLKEITHRHGLIASFMPKPFSDRTGSGAHFNMSLADPATGRNLFAGDTPGAITPLAEQFIAGILRHAPAICAVIAPTVNSYKRLVAQGSMSGFTWAPVFICYGNNNRTNMLRIPSAGGRVECRAADSACNPYLGAAMILAAGLEGIREELDPGDPNLVNAYRLSAEQRAERGLRVLPRTLGDAIEAFAADPLSRSVFGDAMADAFIDYKRAEWAEYHGCVSDWELTRYLEFL

SEQ ID NO: 5517 - protein, 164 aa, Mesorhizobium loti MAFF303099
MVYPLAIALLGVAGLIEAGEESAPDWIGTVLICLGLWTLIEYVLHRFVLHHVPYIRDLHDRHHVDERSPVGTPTWLSLGVHALIALPVWVLSDFATASAVGCGLMLGYLWYISVHHMIHHWHPAHPSYLYTLKRRHAVHHHIDDSANFGVTSLFWDRVFGTARL

SEQ ID NO: 5518 - protein, 127 aa, Photobacterium profundum SS9
MNKNIKILIVDDFSTMRRIVKNLLRDLGFNNTHEADDGLTALPMLKKGDFDFVVTDWNMPGMQGIDLLKHIRVDEKLKHLPVLMITAEAKREQIIEAAQAGVNGYIVKPFTAATLKTKLDKVFERMQ

SEQ ID NO: 5519 - protein, 332 aa, Thermotoga maritima
ARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 5520 - protein, 365 aa, Emiliania huxleyi
  misc_feature (151)..(151): Xaa can be any naturally occurring amino acid
  unsure (1)..(365): unsure at all Xaa locations
DNGSGMCKAGFAGDDAPRAVFPSIIGRPRQPGVMVGMGQKDSYVGDEAQSKRGILTLKYPIERGIVTNWDDMEKIWHHTFYNELRVAPEEHPVLLTEAPLNPKANREKMTQIMFETFNVPAMYVAIQAVLSLYASGRTTGIVMDSGDGVSXTVPIYEGYAVPHAILRLDLAGRDLTDWMVKLLTERGYSFTTTAEREIVRDIKEKLAYVALDFDQEMQTAASSSSLEKSYELPDGQVITIGNERFRCPEALFQPSFLGMESAGVHETTYNSIMKCDVDIRKDLYANVVLSGGTTMYAGIADRMSKEITALAPASMKVKIIAPPERKYSVWIGGSILSSLSTFQQMWISKQEYDESGPSIVHRKCF

SEQ ID NO: 5521 - protein, 233 aa, Rubrobacter xylanophilus DSM 9941
MSEGEGRVALVSGGNRGIGLEICRQLAAKGIAVVLGSRDERRGREAAEGIAGRVVAHQLDVADQESVDRIAAYVEREFGRLDILVNNAGVAPDGGQRGVEADLEKVREALEINLLGAWRLSRAFIPLMRRNGYGRIVNVSSGLGSISEMGGGSPAYRVSKAALNALTRILASELRGTGVLVNAVCPGWVQTEMGSPGAPRPVQEGADTPVWAATLPKGGPTGGFFRDRRPIPW

SEQ ID NO: 5522 - protein, 1096 aa, Oryza sativa (japonica cultivar-group)
MESSSSVIFLGTGCSGALPDARCLIHPSTPPCPVCSHSLSLPPERNPNYRCNTSLLIDYCQHDGIHKYILIDVGKTFREQVLRWFSHHKIPYVDSIILTHEHADAVLGLDDVWVVQPSGCRNGLGKVPIFLTHFTMNSVAARFPYLLKNKLEEGDEGSQVIQLDWTIIEGDIDKPFVSSGLEFVPLPVMHGEDYVCLGFLFGRRSRIAYLSDVSRILPRTEHAISKSGAGQLDLLILETNELHGEGDAGSCHLTLSQTLNAVKRISPKRALLIGMNHEFEHHKENQTLAEWSSSEIIVEHFRIIPFACFKRKRKFHLLSSSSGVSSAAAAGRAISLPGCPDKCGDVSIPYPFGVGDRCAAVGLNPYFNITCDDAVRPPVPKLGDPGMEAEVLDITLERGEIRLTGFLSYVCYTSSNSSYASLPGGIFVGGTQLRVSPSRNQLTVIGCRALGLLVGGAHAGGSGDGDEYATGCYTYCASLNSTDADGAPCAGTGCCQAPISSDLAYVGGTFPSNWTNSGWRFNPCFYALIAEVGWYSFRRRHLAGVLGFVNETKPSDIPVVLDWAARDGWCPATAEEKARRKYACVSGNSHCVNSSNGMGYSCSCNQGYEGNPYLDNGCQDIDECTLRRQGRQYEDVYPCKHGICINTPGSYRCKCKAGTKPDGTNFGCQQVLPMAAKVIIGLSACSIFVMALSCMLVIQLQRRKHTIEKQEYFRRNGGLRLYDEMVSRQVDTVRVLTVDELKKATDNFSDARVLGRGGHGTVYRGTLDDLREVAIKRSKAAVDGDGDGGGCKEEFVNEIIVLSQINHRHVVRLLGCCLEVHVPMLVYEFVPNGTLFDLLHGGTAARRRPVSLGLRLKIAAQSAEALAYLHSSASRAILHGDVKSLNILLDGALDAKVADFGASALRSAMGEGESFIEYVQGTLGYLDPESFVSRHLTDKSDVYSFGVVLAELITRKKAVYEDDGGGGGGSGEKRSLSSTFLAASSRGELWRVVDRDIMDGDDVDAVVRELARVAEECMGARGEERPAMKEVAERLQVLRRVEMMEAAAGVEVVDGFNGGGLVGRHGHLDTTTTTTTSYYQSMETDKLQLDVDDLVR

SEQ ID NO: 5523 - protein, 252 aa, Rhodococcus sp. RHA1
MYTTETPQDAAKYAVGRAAVERYAHDGAQLGLGSGTTSAWFVRALGEKVADGLDVVGVPTSTATRDLALSVGITLVDLNDLDRPLDVTLDGPDEVDHDGDMIKGGGACLLWERMVAEASSKMVCIADDTKLVEQLGSFPLPIEVIPFGWKATRRSISALLTDLGYTDVKIIQRHRNGQPVVTDSGNFILDAHMVAITDKALLDTNLNWIAGVVENGLFTGIAHEILIASPDGAAKLIELPHRNAARIPEWRK

SEQ ID NO: 5524 - protein, 344 aa, Triticum aestivum
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEFILTHPNIKIPPKGKIYSVNEGNAKNWDTPTAKYVEKCKYPTDGSSPKSLRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKAGSA

SEQ ID NO: 5525 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 5526 - protein, 492 aa, Rhodococcus sp. RHA1
MPAELITPERKAHAMTITTLHNYIDGGWVPSETTFKALNPADEKVIAEVPASTATDVDAAVTAARRAFADWRHVNPTVRARYLHTIGDIVKTRERELAEAITTEMGKTIGEATGEVDKLAKAFHFYAEEATRIHGEVIPNDVDGFASMVVQEPIGVIGAITPWNYPLELVGWKLCAALAAGCTIVIKPSQYASLSPALLFACIDEAGLPAGVANLVLGGGETGPAVAGHPGFDKLAFTGSTATGGKIARGVPAAKPLTMELGGSCPMIVTDRADIDAAVAGAARRGFRNAGQICIAINRIYVHETVYSEFVDRLTAKVSELTVGNGMDPTVDVGPMATRAGLDVVDQHVRDAIARGATVTTGGTRIETLAPGNFYQPTVIAGCNPDMLVMHEETFGPVVGVMPFSDLRNAVDLANGTEAGLAAYVYTGDLAQAHDLGRLLDFGNVAVNNVDAGIMNAPYGGRKGSGFGVEHGKAGLEGYLQYKHLRIQYGTR

SEQ ID NO: 5527 - protein, 305 aa, Arabidopsis thaliana
MSSLTVRRVSREDIQLVQNLIERCLQLYMNQKEVVDTLLEQAKIEPGFTELVWQKLEEENREFFKAYYLRLMVKHQIMEYNELLEQQINHMRQMHPTAGASVRNRNGSHVPPMNQQQLLYERKEPDQSSPNLSSPYLNGGSAINTNIPSYVDFSSHSRRVDPSPNSLSLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQGDHERLRTISSGFSYENFRSN

SEQ ID NO: 5528 - protein, 316 aa, Rhodococcus sp. RHA1
MRMVITDHNFAGEDFERAAAKELDADFATFAATTETEAIEAVRGADVALVNFAPMTAAALAAMNPNGVVVRYGIGFDNVDLDAATRLGVRVCNVPDYGADTVADHAVTLTLMLLRKVAQFDRALAAGGWPSATELAPIRSTSETTVGLLGTGRIALAVAKRLQPFGFDLIAHDPYANPDVAADHGITLVDLDELFRRSHALSLHAPATADTRGIVNADNLAKMPFGSFLVNTSRGALVEQDAVLDALDSGALAGVGLDVFHPEPLAPDHRLRAHPNAVLTPHAAFYSEQSLRDLQRLAAEEASRAIRGEPLRCPLN

SEQ ID NO: 5529 - protein, 298 aa, Zea mays
MARYDELASKSNVEYIAGGATQNSIRVAQWMLQIPGASSYIGCIGKDKFGEEMKKNAQAAGINAHYHEDDNAPTGTCAVCVVGGERSLIANLSAANCYKSEHLKKPENWALVEKAKYIYIAGFFLTVSPDSIQLVAEHAAATNKVFMMNLSAPFICEVFRDAQEKALPYVDYIFGNETEARTFAKVRGWEIENVEEIALKISQLPKASGTHKRITVITQGCDPVVVADDGKVKTFPVILLPKEKLVDTNGAGDAFVGGFLSQLVQEKSIDECVRAACYAANVVIQRSGCTYPEKPDFN

SEQ ID NO: 5530 - protein, 342 aa, Coxiella burnetii RSA 493
MKVLSKLKPAPGLWLHKAPTPKPGRDEVLIKIKKTAICGTDLHIYKWDEWAQKTIPVPMHVGHEFVGEIVEVGEAASALAVGDRVSGEGHITCGDCRNCRAGKRHLCRYTVGVGVNRPGAFAEYLVIPAKNAYKIPAKISDDIAAILDPFGNAAHSALEFDLVGEDVLITGAGPVGLMSAAIARHVGARHVVITDVNDYRLALAEKVGVTAAVNSTKTPLTETMKNLGMTEGFDVGLEMSGNAEAFRSMLTVMNNGGKIAFLGIPPEPFAIDWNQVVFKSLLIKGIYGRRMFETWYKMTNLLLSGLDISPIITHEFPMKDFQQAFDVMLSGKTGKVILNWEQ

SEQ ID NO: 5531 - protein, 262 aa, Triticum aestivum
  misc_feature (252)..(253): Xaa can be any naturally occurring amino acid
  misc_feature (259)..(259): Xaa can be any naturally occurring amino acid
  unsure (1)..(262): unsure at all Xaa locations
HSRTSLYKKAGWYRSGIPGISSTHASEGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCRPTLXXTLGTYXGDA

SEQ ID NO: 5532 - protein, 142 aa, Triticum aestivum
  misc_feature (100)..(100): Xaa can be any naturally occurring amino acid
  misc_feature (107)..(107): Xaa can be any naturally occurring amino acid
  misc_feature (115)..(115): Xaa can be any naturally occurring amino acid
  unsure (1)..(142): unsure at all Xaa locations
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKGWLRLPXEHNSSPXYYDGRYWXTMWKLPMFGCNDATQVLSKWRSQRRIP

SEQ ID NO: 5533 - protein, 565 aa, Xanthomonas campestris pv. campestris str. 8004
MHHDTSLIDIIAVGLAVAFVLGTLAQKVKLSPLVGYLLAGVCVGPFTPGFVADQTMANQLSELGVMLLMFGVGLHFSLDDLMEVKWIAVPGALAQIVVATLLGWALAWSMGWPLMQGLVFGLALSVASTVVLLRALEERRLLETQRGRIAVGWLIVEDLVMVIALVLLPALANVLGGSAGAAEHAGESTSLLAALGWTLLKMVAFVAVMLVVGRRVIPWSLEKVAATGSRELFTLAVLGIALGVAFGSAKLFGVSFALGAFFAGMLLKESELSHKAASDSLPLRDAFAVLFFVSVGMLFDPMILIAHPWQVLATFLTVTVGKSLAAFVIVRAFGHPTGTALTISTSLAQIGEFSFIQAGLGVQLAILPETGRDLILAGALLSIVANPFLFSWLDRWQAKQAQDAPATVEPELPPGPPLQLDGHAIVIGYGRVGSALAQLLRSRGVPVLVIDDNGDHVAKAHAAGIPGIRGSAAADRVLAEARPEQAKIAILAIPQPLEAGEALAKLRALNPSLTLLARAHSDAEVKHLLEHGADGAVLAERELAYSLAEMVMSTPPYRALRVPAS

SEQ ID NO: 5534 - protein, 508 aa, delta proteobacterium MLMS-1
MINLILCGGSGTRLWPLSRTLLPKQFVRLFAGQSLFQQTVRRNQALGSDFFIVSNSEQYFLAVDQFGEVATAAPRFLLEPEGRNTAPAIALACLLLDPEEVVLVTPSDHLIKDEAAYAQAVAQAQTLAIEGALVTFGIKPTCAETGFGYLEVEGNNVLSFREKPDQATANAYLESGNYYWNSGMFCFKAGVLLAELETHAPEIHAACLAAAQTVADPAASKINISPEAMAAIPAESIDYAVMEKSTRVKAVPAAMGWSDLGSFDALYQENHDPAQTNTVVSHGESEHSPAPLCLDAENNLIVGGKRQIALVEVSDLLVVDTADALLISRKGSSQQIKEVVARLKKETPALTEIHQKAHRPWGTYEVLLDSAQYKIKRIVVKPGSKLSLQKHFHRNEHWIVVSGTATVTVGEETFLVRPNESTYIQMGQLHRLENLGQIDLVMIEVQVGEYTGEDDIVRLDDIYERQHSCSARATLSTASNAGPAFSTPTELTNREDLVAAQGELSGGV

SEQ ID NO: 5535 - protein, 507 aa, Salmonella enterica subsp. enterica serovar Paratyphi A str.
MVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 5536 - protein, 343 aa, Desulfovibrio desulfuricans G20
MGLQLAFQEQGKGGAVRGAILEVLRKHDGNWVSGEELSRILGMSRAAVSKHMRLIRDAGYPVEAMTRRGYRLGGDADSLHPAAVCHGLGTRLLGRGTVLHMESVPSTNMEARVLAERGAPEGSVVLADCQTAGRGRQGRTWLSPRGGVYMSVVLRPQCAPQQVPVLTLMTVVAVVGAVRGLTGLPAMPKWPNDVLVHGRKLSGVLIEAGLVVDALDYAVAGIGINVNTVCSELERDGMRAVSLRGALETHHGTEQPQLPRAGVARAVLEGLEEAYELFRSGGGAAVVARWKQLAGITGSSIRLGRGDAVLTGKVRDVDDNGWLLLEDESGTVHRLPAGDILDG

SEQ ID NO: 5537 - protein, 387 aa, Campylobacter coli RM2228
MLEKQMIKFILSKWNYGNFRIVFWDQEEFYVGNQPAKFSLIFKEKIPLLKLFSDTSLVFAKHYMESKLEIEGDYDEIAKVLYYFSNKRFLKNKEDILSKIAQKEESKNIKSHYDIGNDFYRLWLDDTMSYSCAYFKTSSDTLYEAQINKIEHTLKKLDLKPNEKLLDIGCGWGWLSIMAAQKYGVKVVGVTISEEQCKKAQERVRELKLEDRVEIRLQNYQDLEFEDYFDKVVSVGMFEHVGKENLGLYFMKAKQVLKPGGSMLLHSILAMFEGKTNAWIDKYIFPGGYLPSLREVVSAMSEWDFHLLLAESLRIHYAKTLDIWSENFNQVLPQVREKYDEEFVRMWDLYLRSCASAFRVGSVDLFQFLITKEINNNLSLTKEYIYK

SEQ ID NO: 5538 - protein, 852 aa, Aspergillus fumigatus
MEKTCKRAGLLIVWPRGFIDGYCDSLLQKELVRHVETTLARSLYNCDELAAYSGTALAFRDRLIIEWNKTQQRQSFADQKRVYYLSLEFLMGRALDNAMLNVGMKDAAREGLKDLGFRIEDVINQEHDAALGNGGLGRLAACFLDSMATLNYPAWGYGLRYRYGIFKQEIVDGYQVEIPDYWLDFNPWEFPRHDITVDIQFYGWVRTYQDENGKTIHSWQDGEAVQAVAYDVPIPGYGTRTTNNLRLWSSKAASGEFDFQKFNAGDYESAVADQQRAETISAVLYPNDNLERGKELRLKQQYFWCAASLYDIVRRFKKTKRAWSKFPEQVAIQLNDTHPTLAIVELQRILIDQEGLEWDEAWTIVTKTFGYTNHTVLPEALEKWSVPLMQNLLPRHLQIIYDINLFFLQSVEKRFPSDREMLSRVSIIEESHPKMVRMAHIAIIGSHKVNGVAELHSDLIKTTIFKDFVKIYGPDKFTNVTNGITPRRWLHQANPRLSDLIASKLGGYDFLKDLTLLDQLEAYVDDKAFRAEWSEIKTANKLRLAKHIKDTTGYSVNPNALFDVQVKRIHEYKRQQLNIFGVIHRYLIIKAMSREEKEKLVPRVSIFGGKAAPGYWMAKTIIHLINRVAAVVNNDADVGDLLKVIFIEDYNVSKAEIICPASDISEHISTAGTEASGTSNMKFVLNGGLIIGTCDGANVSLTRSTLFDMLLTGALQIEITREIGEQNIFLFGTLAEDVEELRHRHFYGDFQLDPQLSKVFEAIRSDMFGDASNFSALMSAIAEHGDYYLVSDDFNSYITTQEIVDEAFKNQDEWIAKSITSVARMGFFSTDRVISEYADSIWNIEPLEIRDD

SEQ ID NO: 5539 - protein, 424 aa, Methanosarcina barkeri str. fusaro
MTSEATLEKSRQMYEKAKTLIPGGVSSPVRAIKPYPFYTASANGSKIKDLDGNEYIDYCLAYGPALLGHNHPVIKEAIKAQLDKGWLYGTPTELEVNLAEKIAGYYPSIDMLRFVSTGTESTMSALRLARGFTGRNKFIKIEGGFHGAHDAVLVKAGSGATTLGEPDSLGIPADFTKYTLQAPYNDIEAMTGLVEKNRDELAAVIIEPVLGNIGPITPLPGYLEELRKLTLENDVLLIFDEVITGFRLAMGGAQEYFGIVPDMTTLGKIVGGGLPIGVFGGKREIMEMISPSGPVYQAGTFSGSPCSIAAGIAVLDYLEQEKIHEKVNSKGDYIRAVLTEIVEDEGIDYSVCGIASMFKIFFGAEPHNYQEALKCDKEGYLAFFHRMLASGIFLPPSQFETNFVSAAHSEEDIEKTLKAYTENL

SEQ ID NO: 5540 - protein, 175 aa, Triticum aestivum
MAPTVMASSATSVAPFQGLKSTAGLPVSRRSNGASLGSVSNGGRIRCMQVWPIEGIKKVETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVRFIAFKPPGCEESGKA

SEQ ID NO: 5541 - protein, 150 aa, Zea mays
MAEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 5542 - protein, 218 aa, Glycine max
MFTRIFGKPKPEVNTLTALDELNDKLEMLEKKEKVLLKKAAAEVEKAKEFTRAKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTAPAAPVQVPAGQQPTRPVPAKRTPEEDELAALQAEMAL

SEQ ID NO: 5543 - protein, 301 aa, Triticum aestivum
  misc_feature (254)..(254): Xaa can be any naturally occurring amino acid
  unsure (1)..(301): unsure at all Xaa locations
LRPAIYGDTIEYSSYASNALGALPYGRPAGGRTSDFERPPGQVCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPSTYDQIKAAIKEESEGNLKGILGYVDEDLVSTDFQGXDNRSSIFDAKAGIALNDNFVKLVSWYDNEWGYSTRVVDLIRHMHSTK

SEQ ID NO: 5544 - protein, 93 aa, Zea mays
MSSEQTFIAIKPDGVQRGLVGPIISRFESRGFKLAALKLVSPPRELLEKHYADLSEKPFFPGLVTYMLSGPIVAMVWEGRDAVKTGRTILGAT

SEQ ID NO: 5545 - protein, 235 aa, Helicobacter hepaticus ATCC 51449
MTIIAGNFKANLTRIQVATFAKELDSILTDMQTSSHLQVDIFPSHTALLTNNFKHFHIGAQNAYFAQNGGFTGEIGLSQLQEFNINRLIIGHSERRTLFGENQDFINKKFRFYAEAGFEIYYCIGEPLSMRQKGKNALKDFLGAQLDGIDITYPKLIIAYEPIWAIGTGESATLEQIESTHSMLATFTSAPLLYGGSVNPTNAREILCTPYVNGVLVGSASLNIQSFTDIIRASK

SEQ ID NO: 5546 - protein, 478 aa, Streptococcus pneumoniae
MDDNGYDIADYQAIAAIFGTMEDMDQLIAEAKKRDIRIIMDLVVNHTSDEHAWFVEACENTDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAHEALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 5547 - protein, 240 aa, Arabidopsis thaliana
MKGLVSTGWKGPVKFRMPTAENLVPIRLDIQFEGQRYKDAFTWNPSDPDNEVVIFAKRTVKDLKLPYAFVTQIAQSIQSQLSDFRAYEGQDMYTGEKIIPIKLDLRVNHTLIKDQFLWDLNNFESDPEEFARTLCKDLGVEDPEVGPAVAFAIREQLYEIAIQSVASARESRLSKKGRRGSDHGSASKASGLSMDLMKLFSFKSSVVRKRKDLDVYEPVVDLLTSEEVDALEAREERHAR

SEQ ID NO: 5548 - protein, 263 aa, Neisseria gonorrhoeae FA 1090
MITVNTLQKMKAAGEKIVMLTAYESSFAALMDDAGVDVLLVGDSLGMAVQGRQSTLPVSLRDMCYHTECVARGAKNAMIVSDLPFGAYQQSKEQAFAAAAELMAAGAHMVKLEGGVWMAETTEFLQMRGIPVCAHIGLTPQSVFAFGGYKVQGRGGKAQALLNDAKAHDEAGAAVVLMECVPAELAKKVTETVSCPTIGIGAGADCDGQVLVMHDMLGIFPGKTAKFVKNFMRGQSSIQAAVRAYVAEVKAKTFPAAEHIFAD

SEQ ID NO: 5549 - protein, 258 aa, Oryza sativa (japonica cultivar-group)
MAAATVSVRFHPAASAARSAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 5550 - protein, 231 aa, Arabidopsis thaliana
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 5551 - protein, 815 aa, Schizosaccharomyces pombe 972h-
MNAPSTMTDKKPEVEHLQGENPPKDTYSAEDTATAILRKKRKPNSLVVDDATNDDNSVITLSSNTMETLQLFRGDTVVVKGKRRKDTVLIVLTDEEMEDGVARINRVVRNNLRVRLGDIVTINPCPDIKYAERISVLPLADTVEGLTGSLFDVYLKPYFVEAYRPIRKGDLFVVRGSMRQVEFKVVDVAPDEFGIVSQDTIIHWEGEPINREDEESSLAEVGYDDIGGCRRQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDVGIPDPTGRLEILRIHTKNMKLADDVDLEQIAAETHGYVGSDLASLCSEAAMQQIREKMDMIDLDEDEIDAEVLDSLGVTMDNFRFALGSSNPSALRETVVEVPNVRWEDIGGLEEVKRELRETVQMPVMYAEKFLRFGVTPSKGVLFFGPPGTGKTLLAKAIANECSANFISVKGPELLSMWFGESESNVRDIFDKARAAAPCVVFLDELDSIAKARGASAGDSGGGDRVVNQLLTEMDGVNSKKNVFVIGATNRPDQIDPALMRPGRLDQLIYVPLPDEEARFSILQTQLRHTPVAEDVDLRAVAKATHGFSGADLEFVVQRAVKLAIKDSIEEDIKRENETGEAPADDVVMDEDASVSQVQRHHVEEAMKMARRSVSDAEVRRYEAYAHQLLTSRGLTGFQFDSADSNTNGPSFGNDGADDLYA

SEQ ID NO: 5552 - protein, 382 aa, Oryza sativa
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQASKQFSSISISLQEEDAILINVVLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 5553 - protein, 280 aa, Streptococcus pyogenes MGAS10394
MMVTTVKMTSGYEIPVLGFGTYQAADGEEAYQSTLAAIKADYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTPEDKKTIRYLSGMSAIPNPDTTSF

SEQ ID NO: 5554 - protein, 421 aa, Brucella melitensis 16M
MRKTGPRPVTVNRACHLWRSIMAFLADALSRVKPSATIAVSQKARELKAKGKDVIVLGAGEPDFDTPENIKQAAIAAINRGETKYTPVSGIPQLRQAIVSKFKRENGLDYKPEQTIVGTGGKQILFNAFMATLNPGDEVIIAAPYWVSYPEMVAINGGTPVFVDTKIEDNFKLTAADLEKAITPKTKWLIFNSPSNPTGAAYTQAELKSLTDVLVRHPHVWILTDDMYEHLVYGDFVFTTPAQVEPSLYDRTLTMNGVSKAYAMTGWRIGYAAGPIELIKAMDMIQGQQTSGACSIAQWAAVEALNGTQDFIPANKKIFQARRDLVVSMLNQATGLQCPTPEGAFYVYPSCAGLIGKKTEAGKVIETDKDFVTELLETEGVAVVHGSAFGLGPNFRISYATSDELLEKACIRIQRFCASLR

SEQ ID NO: 5555 - protein, 145 aa, Actinidia deliciosa
MEQDFHAERIKEFLREVAIMKRLRHPNIVLFMGAVTQPPNLSIVTEYLSRGSLYRLLHKPGAREVLDERRRLSMAYDVAKGVNYLHNRNPPIVHRDLKSPNLLVDKKYTVKVCDFGLSRLKANTFLSSKSAAGTPEWMAPEVQRD

SEQ ID NO: 5556 - protein, 486 aa, Bradyrhizobium japonicum USDA 110
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 5557 - protein, 319 aa, Glycine max
MFCLLNSVRVRLREDDRRGWKDASSIPFPSFLALKTNSFQLNPSKPSLSIFVLSTFLRSQSLIFLSSNSNFFIWGDRLTNREDLIAREGLGFQSIASHITIMFSRMFGKPKQETNAVATLDKLNETLEMLEKKEKVLLKKVAAEVEKAKEFTRGKNKRAAIQCLKRKRLYEQQIEQLGNFQLRIHDQMIMLEGAKATTETVDALRTGAAAMKAMQKATNIDDVDKTMDEINEQTENMKQIQDALSAPIGAAADFDEDELEAELEELEGAELEEQLLQPATTAPAAPVQVPAGQQPTRPVPAKRTPEEDELAALQAEMAL

SEQ ID NO: 5558 - protein, 478 aa, Vibrio sp. Ex25
MMQQIKNETLKSVFKQWSSEEGIVVINPATEQELVRLKPSSLEELDTLIGQCKTEQVRWAKLSAKERSRRLKKWYQLLLDNAEDIATIITLEQGKPLTESKGEVMYGASFVEWFSEEAKRAYGEVIPAPTTDRRLSAIRQPVGVCAAITPWNFPIAMITRKAAPALAAGCGMLIKPSELTPLTAIAVVELAYQAGIPKELLPVVVSEQAAEFGQVLSTDPRIKKVSFTGSTRVGKILMKQASDSVKAVSMELGGNAPFIVFDDADLDAAAEGLVASKFRNAGQTCVCTNRLYVHEDVKQAFIEKVLSKLNKLQLGNGLEKGVTLGPVITMASKHRLEAVIDQAVQEGASIANSPQRRSGRFMEPVLLDSVKQYMSIVQQELFGPVLPIITFENDEQVLGMANDTEYGLACYFYTNNFKRIVAFSEGLEYGMVGVNEGIISTEVAPFGGVKESGVGREGAKQGLDEYLETKYICLGGLS

SEQ ID NO: 5559 - protein, 521 aa, Zea mays
MGKGISGDARLAAAPYLQRVLLSPAGGSPRPPARYKHAAQLVQDKLYVVGGSRNGRSLSDVQVFDFKTSSWSALSPARGSKHPNHENDATGGSFPALAGHSMVKWKNYLLAVAGSTRSSSSLNKVSVWLIDVQANSWSAVETYGKVPTARDGQSVSILGSRLLMFGGEDNKRRLLNDLHILDLETMMWEEVKSEKGGPAPRYDHSAAVYADQYLLIFGGSSHSTCFNDLYLLDLQTLEWSQPDAQGAHITPRSGHAGAMIDENWYIVGGGDNASGSTDTVVINASKSFWSVVTSVSARDPLACEGLTLCSTTVDGEKVLIAFGGYNGKYSNEIFVLKPKPRNLVQPRLLQSAAAAAAAASVTAAYAVITATDEKTRDIVATDDFDIKRAQPASNSKKFVAEIDVLNGENGKLAARLAEVRDENSKLKDKLDMTNLSYGELAKELKSVQDQLAAEGSRCQKLESQIAAARKRLESAGSLENELEVLHQHISQVEETIATTQRRKSGGVWKWVAGSTEVSDDE

SEQ ID NO: 5560 - protein, 203 aa, Brassica napus
MSYKKLPVDVQPGHTILCADGSISLAVLSCDPKSGTVRCRCENTAMLGERKNVNLPGVVVDLPTLTEKDVEDILKWGVPNKIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDC

SEQ ID NO: 5561 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCRYYTKSFRGSVDPFHVDAVDTTGAGDSFVGALLCKIVDDRAVLEDEARLREVLRLANACGAITTTKKGAIPALPTESEVQSLLKGN

SEQ ID NO: 5562 - protein, 364 aa, Magnetospirillum magnetotacticum MS-1
QSVPGSLSRTARTRPPEGGPVDDDEGRGARRPALRRPRRGPVGAGSVGLRPMSDTRGALLGPAEIRDLAGRLGVRPTKTLGQNFVHDGGTVRKIVRAADVRPGERVVEVGPGLGSLTLGLLEAGASVVAVEIDPVLARQLPDTVVTHVPDVGDRLEVVGADALEVTSLPGEPPTALVANLPYNVAVPVLLTFLERFDSLERVLVMVQAEVADRLAAPPGSRTYGVPSVKAAWYADARRAGTIGRSVFWPVPNVDSALVALDRREPPATAATREQVFAVVDAAFAQRRKMLRSALSGLAGSASVAAEVLEAADVDPQARGEVLDVAAFARVAEQLVRRVGLADRPARGAAPAAERPTGRPGTVDA

SEQ ID NO: 5563 - protein, 400 aa, Rickettsiella grylli
MKINLSHRVSQIKPSPTLSLSATANQLKAQGKPVINLTVGEPDFDTPYHIKRAAHQAIDDGFTKYTAVDGIPRLKQAVIDKFKRDNQLDYSLDQVIISSGAKQSIYNLMQSLLNPGDEVIIPAPYWVSYPDIVLLAEAKPVFIPTSTESSLKITPQQLQAAITDKTRLMIINSPSNPSGMVYTPTELKQLAQILLRTPHVFILTDDIYEHIYWGDQPFKNILNVCPELANRTLVLNGCSKAYAMTGWRIGYAAGPKTIIRGMMNLQSQSTSNPNSIAQFAATAALTGQQTDVLHMNKIYHWRHDFFVAELNKIPGIHCLPAQGAFYSFPSFHAFIGEDKPFASDYELADFLLNNAHVAVVPGSAFGAPGYLRLSYALEETLLEKALLQLKTTLMNAMPLT

SEQ ID NO: 5564 - protein, 278 aa, Triticum aestivum
  misc_feature (17)..(19): Xaa can be any naturally occurring amino acid
  misc_feature (24)..(24): Xaa can be any naturally occurring amino acid
  misc_feature (44)..(44): Xaa can be any naturally occurring amino acid
  misc_feature (76)..(76): Xaa can be any naturally occurring amino acid
  misc_feature (82)..(83): Xaa can be any naturally occurring amino acid
  unsure (1)..(278): unsure at all Xaa locations
NQCENVETTRRALRELXXXCTCAXQYLSGVILLRETLYQSTKVXKPFVDILKAGNVLPGIKVTKGTIELAGTQREXTTTQGXXDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNSFEKKKKKKKKRAAALEYPSRGPSLRVPSFLVQSGPNLAS

SEQ ID NO: 5565 - protein, 282 aa, Prochlorococcus marinus str. MIT 9211
MSFSGHSARKRFGQHWLKDVAILEKIVEAAELCENDRVLEIGPGRGALTHKLLNSKVSLVHAIELDTDLVVGLRERFFHETRFSLKGGDALKISLLPPDGIEVNKVVANIPYNITSPLLERLIGKLGFFPETRYERLVLLLQKEVADRILAMPGQSSFSAMSVRVQLLCKSRSVCDVSPKCFKPSPKVHSKVVVIEPFAFSERLNVDIEKRVESLLRTAFLGRRKKLRNTLASIRPLNQLESLADQLGISLNQRPQEISPMMWVSLAKRIHDMDKLVGEIQS

SEQ ID NO: 5566 - protein, 270 aa, Nostoc sp. PCC 7120
MTIKFGLIGGGVMGEALLSRLIARGIYQPSEVIVSEPQTARQAFLQQKYHVGVTTDNSLVFTQAQDVVFLAVKPQVFSAIAQELADTVFTDHSPLVVSILAGVSLSQLEAAFPQSPVIRAMPNTPATVGSGMTAICSGAYTYAQHQKLAQQIFSAVGEVVEVSESLMDAVTGLSGSGPAYVALLVEALADGGVASGLPRGIANQLALQTVLGTAQLLHESKLHPAELKDRVTSPGGTTIAGIAQLEKAGFRSALIEAVKAATWRSQELGK

SEQ ID NO: 5567 - protein, 315 aa, uncultured bacterium
MASLDASPNARRALEEFPAQAPACRPRIAPTLAPDPPHMSSATPAALPARKPMNLHRLREMHAQGEKITMLTCYESSMTRVMDDAGVDAILIGDSLGMVVQGQPSTVPVTLDEIAYHTRCVVRGNRNVWIVSDLPFGTYQENREQALRSSVALMQAGAHMVKLEGGGWTAETVHFLTERGIPVCAHLGLTPQSVHALGGYRIQGRDAAGAETLRRHAKELAQAGAAMAVLELMPSDVAADVQADNPGLITIGIGAGQRTAGQVLVMHDMLHITRGKLPRFVRNFMAEGGSIEDAIRRFVVSVKDGSFPDEALHGY

SEQ ID NO: 5568 - protein, 309 aa, Pseudomonas aeruginosa UCBPP-PA14
MHPWARRNIPQLAGRLALVTGANSGLGWQAARTLAGKGATVVMACRNREQAERARRAILDEYPQARLELADLDLADLASIRACAAGFRQRHERLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 5569 - protein, 346 aa, Gibberella zeae PH-1
MPKATKGKNAGPRKGPYEKPAANRVFKFNTNIGQHILKNPGIADTIVAKAYLKPTDTVLEIGPGTGVLTTRILEQAKAVKAVELDTRMAAELTKRVQGGPLQQKLEIIMGDFAKLDVVQALPPIDVCISNTPYQISSIIVSKLISMPKPPRVSILMVQREFGLRLCARAGDSLYSRLSVNTQFTSKVSMVAKVGKNNFSPPPEVESVVVRIEPRTDVPAVGLEELDGVLRICFSRKNKTLRASFLDSHEICERNWITWTSMYPDKVSEKDLDLLRDSMDTAEKAADSKQSVCGVPVSKASLKNLIRTKIEHVLETTELAEARAVKCDENDFLKLILAFRENNIYFT

SEQ ID NO: 5570 - protein, 453 aa, Fusobacterium nucleatum subsp. nucleatum ATCC 25586
MKFWSIVLLTINSIIGTGIFLSPGAVAKLVGDKAATIYLAAAVFAAVLAVTFAAASKYVVKSGAAYAYSKAAFGDEVGSYVGITRVVSASIAWGVMATGVVKTTLSIFGQDSSNVKNVTIGFITLMFVLLIINLIGTKLLTLISNISTIGKIGALGITIIAGIFILVFSDGANLQGLTLLKDAEGNNLIPEFTTSVFVTALVGAFYAFTGFESVASGSADMEKPEKNLPRAIPLAIAIIAAIYFGIVFVSMYIDPVAMVTSKDPVVLASVFKNQLLQKIIVMGALMSMFGINVAASFHTPRVFEAMAKEKQVPDFFAKRTKSGLPLTSFILTAIIAVVIPLAFNYNMAGIIIISSISRFIQFIVVPVAVIVFFYGKSKEEILNTNKNFIIDVIIPIIALLLTILLLVKFNWAQQFSTKLDDGTVTVNLKAVVSMVIGYLILPIVLRIYMRTKK

SEQ ID NO: 5571 - protein, 565 aa, Bradyrhizobium japonicum USDA 110
MIDDLWYKNGVIYCLSVGTYMDADGDGVGDFKGLLRRLDYLHGLGITTIWLMPFQTSPGRDDGYDIADYYSVDSRYGTLGDFVEFAHGCKQRGIRIIIDLVVNHTSDQHRWFKDARRDKNSPYRDWYVWSDTKPANANKGMVFPGVQKSTWTRDKDAGAWYFHRFYDFQPDLNTSNPHVQAEILKIMGFWIQLGVSGFRMDAVPFVIATKGAKVKKPVEQYDMLRAFREFLQWRQGDAIILAEANVLPETDMEYFGRDADRMHMMFNFHVNQHLFYALASADSRPLAKALKATKPRPGSAQWGLFLRNHDELDLGRLTPAQRDTVFKSFGPDKDMQLYDRGIRRRLAPMLGGDRRRLELAYSLMCTLPGTPVIRYGDEIGMGDDLSLPERNCARTPMQWSTEPHGGFTKNDKPACPVIDKGPYGFPHVNVAKQRRDANSMLNWTERIVRMRKEVPEIGWGDFAVIATRDPAVFIMRYDWRNNSVLFVHNLDEKPREIAFSTGLPDDAGAHLINLLAEDHSHADKRGQHRVVLEPYGYRWYRVGGLDYLLKRSDIDGDTAGNKHPG

SEQ ID NO: 5572 - protein, 246 aa, Zea mays
  misc_feature (202)..(202): Xaa can be any naturally occurring amino acid
  misc_feature (221)..(221): Xaa can be any naturally occurring amino acid
  unsure (1)..(246): unsure at all Xaa locations
MGRQFFVGGNFKMNGSIKSITDIVENLNKGKLDPNTEVVIAPPALYLLLTREHLRKGLEVAAQNIFDKPNGAFTGEISAEQLKDSGITWTLVGHSERRQILQENDDFIANKTKTATDNGLGVILCCGESLEQREAGETVSVVTKQLKAVADKVKDWSKIVVAYEPIWAIGTGKVATTEQAQEVHAALREWLKKEVSPEASEXARILYGGRVSEKTATSLPXEANIDGFLVGGASLKPAFVDIITLT

SEQ ID NO: 5573 - protein, 472 aa, Haemophilus influenzae R2866
MPNANAIANVFKLIEENNVKFVLLRFTDIKGKEHGVSIPVSLVDEEMFEDGKMFDGSSVEGWKTINKADMLLMPMAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKHVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 5574 - protein, 984 aa, Rhodococcus sp. RHA1
MSGAVRTQRNRSHLVPAEPRTAIRGVPLTSDFPSRHIGPDAAASRRMLDALGYDSLANLIDSAVPDQIRSSQPLNLPAARSEQQVLADLRALSERNETRVQMIGLGYSDTITPAVLRRNMLESPAWYTAYTPYQPEISQGRLEALLTFQTVIEDLTALPLAGASLLDEATAVMEAVLLMRRANKSKSATNRVVLDADCLPQTLAVVRGRAKAVGIEVVVAELSGELPDGDMFGVVFQAPGASGAVRDLAPMIAAAKARGALTTVAADLLSLTILTPPGEQGADIAVGSAQRFGVPLFFGGPHAGYMAVRSGLERMLPGRLVGVSVDVDGKTAYRLALQTREQHIRRDKATSNICTAQALLANVAAMYAAYHGPEGLRAIANRVHTHATTIAGSLRAAGHTIVHDSFFDTVLVRVPAGAGAIVESADRDGINLRLVDSDHVAIACDECTTDDIVRRVVAVFGAQPTTVAVPELPSALARTSNYLQHPVFHDHRSETAMLRFLRTLSDKDLALDRTMIPLGSCTMKLNSAVEMEPISWPGFASIHPYAPVAQTAGYLELVADLERWLGEITGYDRVSLQPNAGSQGELAGLLAIHGYHESRGDFERNVCLIPQSAHGTNAASAVLAGMKVVVVATAENGNIDVGDLRAKIAAHEGAIAAIMLTYPSTHGVYENDVRTVCDLVHEAGGQVYVDGANLNALVGLAQPGKFGGDVSHLNLHKTFCIPHGGGGPGVGPVAVRKHLAPFLPGNPLGGDDLGTPVSAANYGSAGILPITWAYIALMGPDGLTSATETAVLAANYVAQSLDRHFPVLYTGPSGLVAHECILDLRHVTKATGVTAEDVAKRLIDYGFHAPTLSFPVNGTLMVEPTESEDLAELDRFIEAMVSIRREIDLVGDGVWPLERSPLRQAPHTAEQVTADEWDLPYPRHLAAYPVASLRAAKYWPPVRRIDGVHGDRNLVCSCPAPEAFENTTDIDTSAIAETPEEAFA

SEQ ID NO: 5575 - protein, 101 aa, Oryza sativa
MSARTDTEATQNQLSSGITADSLGEALKTRLEASHVDIQDLSGGCGQMFEAIIVSAQFEKKMTLARHRLVNAALKEEIAAIHAWTPKCFTPAEWEKKKGSA

SEQ ID NO: 5576 - protein, 156 aa, Brassica napus
MKEGDALPTTANSKKEHSETVLFGRGRYKFYAFAALLLLAFWSMFTGTVTLRLSTGNLNRLSEDLGVRNYDHLDALEMEKRERVVKRMWDVYTNSRRIKLPQFWQEAFVAAYEELTSDVPGVRDAAIGEIAKMSVQSINLDSNPSRSMRKLVEQVW

SEQ ID NO: 5577 - protein, 572 aa, Debaryomyces hansenii CBS767
MGNNSSKPKDLRGSPLSRTDTGNSAKSSRSIRSRISMLRDDNSTSGSPKTGSKATSRKNSSTSLNNMNSSSHSMNIPINGNNSAHSNNNSSANLSNSFSNLSLHKNPSNQHSNNNFNLPPSMIQVEPKEPILIRRNTGPDGEDTPLSPKNHSFNSNSPHLASSFDNSNPSSNPSNNISRTSTNHSHHSGSINNYPLSPQPTSSSANGSTKDLQEDTSKNFDSQLLNENRNKDVLINNLLHSSTTESNESDDSGSIDIENLIQRLLDAGYSGKKTKSVCLKNHEIQLICAKARNILLLQPSLLELSPPVKVVGDVHGQYGDLIRIFTKCGFPPQTNYLFLGDYVDRGKQSLETILLLLCYKIKYPENFFLLRGNHECANVTRVYGFYDECKRRCNIKTWKLFIDTFNTLPIAAIVAGKIFCVHGGLSPVLNSMEEIRNIARPTDVPDFGLLNDLLWSDPADTMNEWEDNERGVSYVFSRVAINKFLQKFGFDLVCRAHMVVEDGYEFFNDRTLVTVFSAPNYCGEFDNWGAVMSVSDELLCLFELLDPLDSIALKQVMKKGKEERKNAQLQQL

SEQ ID NO: 5578 - protein, 405 aa, Arabidopsis thaliana
MEEDNQEIQRDNVGSSSFFKTCFNALNALSGIGILSVPYSLARGGWLSLSLLLLLAVTAFYTSLLITKCMNADRNIKTYPDIGERAFGRPGRIIVSVFMHLELYLVTTGFLILEGDNLHNLFPGFTIEMIGLRLNGKQAFMATVAFVIMPTLWWDNLSVLSYVSMSGVLATTVTLGSISWIGAFDGIGFHQKGKLINWSGIPTALSLYAFCYGAHPVLPTLYSSMKSKHQFNNVLLICFILCTIGYTSMAVLGYLMYGSQTLSQITLNLPIHKTSSKVAIYTTLVNPVAKYALMITPTVNTIKDWFPSRYSKKAYLHLLISTFFIISSVVIAETLPFFGYMMSLVGALLSVTVSILLPCLCYLKIFGNYKKIGCETIMLFGMVVMSVFVGVIGTYIALRDIIGSV

SEQ ID NO: 5579 - protein, 286 aa, Wolbachia endosymbiont of Drosophila melanogaster
MNFRQLIFKILYNENNMKKFLLKPKKSLGQNFILSSEITKKIVALAGSLENFNVIEIGPGYGALTREILVHNPKSLLSIEKDRDLVKHHDQLLNEHQGKYRIIEADALHIIEEELIERPVKVIANLPYNISVALFLKWLDSIKFFTSLTLMFQKEVADRITARPNSKDYGPLSVLSQLLCDIKKEFDIEPKEFFPRPKIHSSVITVNPLPTPKFVVNLETLIKLIRAVFAQRRKMLRNSLQNITNHAETVLENAKLSGNERPENLTIEQFCLLANNVECLLCNKMY

SEQ ID NO: 5580 - protein, 499 aa, Enterococcus faecalis V583
MTNFLFVVFKLEILKEIAILKRDRHRIFHENSYYFRYLFKKVEILLRFFSLNEMRESMEKKQLKREITTFGALSTVMGTVIGAGVFFKAASVVGHAQSASLAIFAWVLGGALTICAGLTSAELATAIPETGGAVKYIEYTYGKLAGFLLGWAQSIIYYPANISALSIIFSTQLINLFHLSANLLIPIAILAGTSITIINLLGTKIASLVQSTTLVVKLIPIALISLVGLFTPGQVAVSLFPVETTANTGFLVAFSGALVATMFAYDGWLGVGNVAGEMKRPERDLPKAIIFGLLLITLIYALINFVFLKTLPIEQIAGNLNAASDASVAIFGPIGGKIVTIGILISVYGALNGYTMTGIRIPYALALDNLMPFSRQFQKLSKRFVVPYVAGIFQLAVAIIMMFFGTFDLLTDMLVFVMWLFNLLIFLAVFILRKREPELKRPYKVPGYPIIPIIASLGGIFILVTTSITQPILALIGIGITLLGIPVYLVNKQKTKPKT

SEQ ID NO: 5581 - protein, 242 aa, Wolbachia endosymbiont of Drosophila melanogaster
MSFLIVANWKMNGMRSSFVDFIGKLNNKSNEITSKLVICPPFTSFPSSIELNNNIDIGAQNCHHKKFGSYTGEISAEMLKELGCTYVMLGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLSISNLSGVLIGSASLDFDHFYKIIQQVEKKFSLINSKISN

SEQ ID NO: 5582 - protein, 493 aa, delta proteobacterium MLMS-1
MIEQREAGVMAEGRPRRTKIVCTIGPATASFEAICRLAEQGMNVARLNMSHGSREWHRGVIGNIKRYNKKYAGSLAVLLDTRGAEIRSGDLKQDLELRVGDGLTLTTRRQAELEPGCVEVSHDGFVAEVTPGDIILVDGGMLRLKVVEVGRTDVRCQSLDEGVLGSRRHLNIRGKSADLPAITEQDWADIEFGMEQRVDFIALSFVRTAEPIQVVQQHLAARGVTMEVMAKIESAASIAQLDAIIAAADGVMVARGDLGAELPYEEVPLLQDEIVAKCRRAGKPVVVATHMLESMIVNPTPTRAEVTDITHAVQQGSDAIMLSGETATGRYPYKALEVMDAVARRIERHQEQQGGQAGFGCACQLGRQGGGSDRLHAKMEISRSAAILGNNLGAAGTLVITRRGLMAALLSNCRPTAPILAFTNTTHVRRRLGIYWGVQAFVVKLSSDPEVSIQRAVEQLQRKGIVHRGQRIIVLSDILAGGLFVETVQVRVI

SEQ ID NO: 5583 - protein, 286 aa, Saccharomyces cerevisiae
MSNAEASRVYEIIVESVVNEVREDFENAGIDEQTLQDLKNIWQKKLTETKVTTFSWDNQFNEGNINGVQNDLNFNLATPGVNSSEFNIKEENTGNEGLILPNINSNNNIPHSGETNINTNTVEATNNSGATLNTNTSGNTNADVTSQPKIEVKPEIELTINNANITTVENIDDESEKKDDEEKEEDVEKTRKEKEQIEQVKLQAKKEKRSALLDTDEVGSELDDSDDDYLISEGEEDGPDENLMLCLYDKVTRTKARWKCSLKDGVVTINRNDYTFQKAQVEAEWV

SEQ ID NO: 5584 - protein, 484 aa, Xanthomonas campestris pv. vesicatoria str. 85-10
MEVKWIAVPGALAQIVVATLLGWALAWSMGWSLIHGLVFGLALSVASTVVLLRALEERRLLDTQRGRIAVGWLIVEDLVMVLALVLLPALADVLGSGAPATTHDAQSPSLLAALGVTLLKMVAFVAAMLVIGRRVIPWSLEKVAATGSRELFTLAVLGIALGVAFVSATLFGVSFALGAFFAGMLLKESELSHKAANDSLPLRDAFAVLFFVSVGMLFDPMILIAHPWQVLATFLTITVGKSLAAFLIVRAFGHPTGTALTISTSLAQIGEFSFILAGLGVQLAILPETGRDLILAGALLSIVANPFLFSWLDRWQAKQAQDAPAAVEPELPPGPPLPADGHAIVIGYGRVGSSLAQLLRSRGVPVLVIDDNGDHVAKAHAAGIPGIRGSAAADRVLAEARPEHAKIAILAIPQPLEAGEALAKLRAINPSLTLLARAHSDAEVKHLLEHGADGAVLAERELAYSLAEMVMSTPPYRALNVPAS

SEQ ID NO: 5585 - protein, 520 aa, Bacillus megaterium
MKGKKWTALALTLPLAASLSTGVDAETVHKGKAPTADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKNTDLNEKGSWGQQVWHKAPNGEYFYGTFWEGMPDLNYDNPEVRKEMINVGKFWLKQGVDGFRLDAALHIFKGQTPEGAKKNILWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGIGQTSWETPVYNKGGNGVSVEAQTKQKDSLLNHYREMIRVRQQHEELVKGTLQSISVDSKEVVAYSRTYKGKSISVYHNISNQPVKVSVAAKGNLIFASEKGAKKVKNQLVIPANRTVLIK

SEQ ID NO: 5586 - protein, 372 aa, Coccidioides immitis RS
MPGRTLPTFTSSEVKSHSTAKSCWVTRGSKVYDITSFVDDHPGGGDLILQHAGRDVSQILRDTISHEHSEAAYEILEEYHIGFMTSESTSKSDTNGTMNGQPNGCIIQSNGRRVYAATGMSSEEDLSIDTDATADYKEHKFLDLSRPLFGQLWFGGFSKAFYLEQVHRPRHYKGGSSAPLFGNFLEPLTKTAWWVVPMVWFPCVAYGMAIGFAGLRNVMMGCVYWLTGLFIWTLVEYGMHRYLPDNRVGLSLHFLLHGIHHYLPMDKYRLVMPPALFLILAAPFYKLTHFVFFYNWYAAVLVYSGGIFGYVCYDTTHYFLHHRNLPAYYRQLKKYHLQHHFADYENGFGVTSRFWDRVFGTELPPLPSAKAE

SEQ ID NO: 5587 - protein, 141 aa, Acidovorax sp. JS42
MAIERTLSIIKPDAVAKNVIGQIYARFEAAGLKIAAARMIHLSRAEAEQFYAVHKERPFFKDLVDFMISGPVMVQALEGENAVLKNRELMGATDPKKAAPGTIRADFADSIDANAVHGSDAAETAQVEVAFFFPGLNIYSR

SEQ ID NO: 5588 - protein, 510 aa, Antithamnion sp.
MNNKSISPIILMILDGWGHSTNAKGNAIHEANTPIIDKLWDNYPKTLLSASGEHVGLPHKQMGNSEVGHTTIGAGRIINQDLVKISKSIKNKEFFNNYQLHNIYKYSCEKNSKVHIVGLCSNGGVHSHINHLKALIQISKQYKVMTCLHLITDGRDTLPKQAKLFVKEIIDIIDENYNTEICTISGRYYSMDRDCRWSRTEKAYKAMVENSCNQNSSSDILSIIDKYYEQNISDEFLPPTKISMHNIVHNDSLIFFNFRPDRIRQLLHSFAKPNFKGFQRKTIKNLMLTTFTEYDSTLSIPTVFPNEPKKNFLGQIISNSGLKQLRLAETEKYAHVTYFFNGGIEEPFPGENRELIASPKVETYDLPPEMSAYQLTNSLIEAINKQLYQFIVINYANPDMIGHTGNMNATIEAIEIVDQCIEKVLHTIEDTNNILIITSDHGNADYMLTDENKPCTSHSINPVPFILINNRQKKQTNLHSHGSLADIAPTILDILNINIPNEMNGKSLIT

SEQ ID NO: 5589 - protein, 278 aa, Corynebacterium sp. ATCC 31090
MTVPSIVLNDGNSIPQLGYGVFKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPKSVRRERLEENLDVFDFDLTDTEIAAIDAMDPGDGSGRVSAHPDEVD

SEQ ID NO: 5590 - protein, 470 aa, Haemophilus influenzae 86-028NP
MSNAIASVFKLIEENDIRFVLLRFTDIKGKEHGVSIPVSLVDEDMFEDGKMFDGSSVEGWKTINKADMLLMPIAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKYVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 5591 - protein, 199 aa, Debaryomyces hansenii CBS767
MSQYSPKMNNNNNDDNNLLTPTQSHHSAHTVTTRKRRSSSIIQHLEPDTLETKIDQSLNPNVNANWVHSKGAWVIHIVLILFLKIFFNFITVLNNDWKWTLTNLTYNIGSYIMFHQVKGTPFEFNSGAYDNLTMWEQIDNGDQYTPTKKFLMLVPISLFLISTHYSNYNLNLFILNGVSCLCVVVPKLAVSHRLRVTLY

SEQ ID NO: 5592 - protein, 398 aa, Ochromonas danica
MKIKKKDLNIELKNFTINFGPQHPAAHGVLRLILELDGEVVEKADPHIGLLHRGTEKLIEFKTYLQALPYFDRLDYVSMMAQEHTYSLAIEKIGNIVIPERAKIIRTIFAEITRLLNHLLAVGCHAMDVGAMTPFLWAFEEREKLMEFYERVSGARMHAAYIRPGGVSMDIPLGLLDDLYIFVNQFNYRLDEMEEMLTKSRIWKERLVDIGVVSAAKAIEWGFSGVMLRGSGISWDLRKNQPYEIYSEIDFSIPVGNSGDCYDRYLVRVEEMRQSIYIISKCLTKIKEGPIKSNNYKISPPSRLEMKNSMEAVIHHFKYFSEGFVLPCGETYTSTEAPKGEFGVYLVSNNTEKPYRCKIKAPGFGHLQALNDMSKGHLIADVVTIIGTQDIVFGEIDR

SEQ ID NO: 5593 - protein, 279 aa, Helicobacter hepaticus ATCC 51449
MISIIIDSLRESALHIDSLLKDTSTSYLQSINASGDMQLEIDVRVDKFLSEKLLNLPCVKAICSEEQEEIMYSENKNAPYIIAYDPLDGSSLIDSNLSIGTIFGIYNEELSAKHLIASGYIIYGPRLEMVVAQEQALHYRYNGNMWRNLGALALNTKGKINAPGGTQKHWENKHKAMIESLFAQGYRLRYSGGMVPDLHQILIKGGGLFSYPATSDAPNGKLRKLFEVFPFAFVYEKAGGFATNGTYRILELEVAHLHDSTPCFFGSQSEMNLVKEVYE

SEQ ID NO: 5594 - protein, 600 aa, Photobacterium profundum SS9
MANDVLSVTVVFLAAAVVAVPIAQRLGLGSVLGYLIAGIAIGPWGLGLISDVEAILHFSEFGVVLLLFLIGLELNPKKLWQMRSPILGLGGGQVLVTSLVIASIVMACSSMMPSITWRDALVIGMGLALSSTAIALRIIEEKNLDGSETGQSSFSVLLFQDIAVIPMLAVLPILAGGGGGSWLDFAWMIGGIAALLVGGHFLLRPLFRWVVLSGVRELFNVAALLLVIGIALGMQSLGLSMALGTFLAGVLLAESEYRHELEIAIEPFKGLLLGLFFISVGMAVNLGLLFEFPLQILAAVAALVIVKGLLLYGLARLFGIRAKSRSQMAAILSQGGEFAFVLFTAAQGEGLLGTQLSSFLLVVVSISMMTTPLILLLQDRWFIHTFKSEDEALESDVIDREPRVIITGFGRFGQVVGRLLFANKIRVTVLERDPSQIQFLRKFGYKVYYGDATQLDLLRAAGADKAEAIIICTDEPDEVMEVVTLCQQHFPKLKVLARARSRVEAHQLLSHGVDNFSRETFAGALDLGRQALISLGMHPYKAKRAEAHFRKLDTTALRDLLPQHSEDVHLASRSKEARKELEEIFDREMRGERDRHNGWD

SEQ ID NO: 5595 - protein, 608 aa, Arabidopsis thaliana
  misc_feature (218)..(218): Xaa can be any naturally occurring amino acid
  unsure (1)..(608): unsure at all Xaa locations
LNQFGLIRNLTDVKVLSEWGILFLLFEMGLELSLARLKALAKFAFGMGLTQVLPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIXPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 5596 - protein, 231 aa, Oryza sativa
MLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVRDGFHQDRIYGYPT

SEQ ID NO: 5597 - protein, 461 aa, Xanthomonas campestris pv. vesicatoria str. 85-10
MSIRTRSRKTPSKQPESALRRWLKERSITEVECLVPDITGNARGKIIPADKFSHDYGTRLPEGIFATTVTGDFPDDYYALTSPSDSDMHLRPDASTVRMVPWAADPTAQVIHDCYTKDGQPHELAPRNVLRRVLDAYAQAKLQPVVAPELEFFLVQKNTDPDFPLLPPAGRSGRPETARQSYSIDAVNEFDPILDLMYDYCDAMELDVDTLIHESGAAQLEVNFTHADPMSRADQVFLFKRTMREAALRHGVYATFLAKPMETEPGSAMHIHQSLLHAGTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIGEKLEPTAPISSNGKEQGYDLPRSLGEALDELEGCEALQEMLGRRFVRAYISVKRKEYETFFRVISSWEREFLLLNV

SEQ ID NO: 5598 - protein, 129 aa, Glycine max
  misc_feature (84)..(84): Xaa can be any naturally occurring amino acid
  misc_feature (110)..(110): Xaa can be any naturally occurring amino acid
  unsure (1)..(129): unsure at all Xaa locations
ENSFSNPSPPSLYNINVFFNLEIIFFWRNCCVKESKSKRVSLKKKYKVIRKVREHNRKKTKEEQKLRLSGERKGKKDLGIPNDXDFKEQELKGLEARRAKAIEGGEQKKXERGGRARKRKLGLLEDERY

SEQ ID NO: 5599 - protein, 483 aa, Escherichia coli
MSQCLYPVIIAGGTGSRLWPLSRVLYPKQFLNLVGDSTMLQTTITRLDGIECENPIVICNEDHRFIVAEQLRQIGKLTKNIILEPKGRNTAPAIALAAFIAQKNNPNDDPLLLVLAADHSINNEKAFRESIIKAMPYATSGKLVTFGIIPDTANTGYGYIKRSSSADPNKEFPAYNVAEFVEKPDVKTAQEYISSGNYYWNSGMFLFRASKYLDELRKFRPDIYHSCECATATANIDMDFVRINEAEFINCPEESIDYAVMEKTKDAVVLPIDIGWNDVGSWSSLWDISQKDCHGNVCHGDVLNHDGENSFIYSESSLVATVGVSNLVIVQTKDAVLVADRDKVQNVKNIVDDLKKRKRAEYYMHRAVFRPWGKFDAIDQGDRYRVKKIIVKPGEGLDLRMHHHRAEHWIVVSGTAKVSLGSEVKLLVSNESIYIPQGAKYSLENPGVIPLHLIEVSSGDYLESDDIVRFTDRYNSKQFLKRD

SEQ ID NO: 5600 - protein, 393 aa, Panax ginseng
MTASATRNDLMIVNLGPQHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFLADIGAQTPFFYIFRERELIYDLFEAATGMRMMHNYFRIGGVAADLPHGWIDKCLDFCDFFLTRVTEYQKLITRNPIFLERVEGVGIIGGAEAINWGLSGPMLRASGIQWDLRKVDHYESYDEFDWGVQWQKEGDSLARYLVRISEMTESIKIIQQALEGIPGGPYENLEIRRFDKVRDPEWNDFDYRFISKKPSPTFELSKQELYVRVEAPKGELGIFLIGDRGVFPWRWKIRPPGFINLQILPQLVKRMKLADIMTILGSIDIIMGEVDR

SEQ ID NO: 5601 - protein, 841 aa, Bradyrhizobium japonicum USDA 110
MTALQDQSFQPNFPAPDQPIDELALAEIKGAILAKLRLAIGKDAGMATKHDWYQAAALALRDRIVHRWLTAEKHSYDAGRKRVYYLSLEFLIGRLFTDALNNMGLLKIFEVALGDLGVSLPELRKCEPDAALGNGGLGRLAACFMESMATLSIPAIGYGIRYDYGLFRQIINQGWQQEYPDEWLGFGNPWELQRPEVIYNIHFGGGVEHVDDKGRDRAIWHPGETVQAIAYDTPIVGWRGQHVNALRLWSARSPDPLKLDAFNKGDYVSASAEQSRAEAICKFLYPNDESPAGRELRLRQEYFFVSASLQDLVKRHLSSDGQLRSLSSKVAVQLNDTHPSLAVTELMRILVDLHNFRWDEAWKITVATLSYTNHTLLPEALETWPVELFERLLPRHLEIIYRINVQHLALAEARAPGDIDFRASVSLIDEKSGRRVRMGQLAFVGSHRINGVSAMHSDLMRETVFHDLNHLYPGRITNKTNGITFRRWLMLANPKLTDLLRETCGDAVLDDPTQLSLIEARASDVEFQKKFRAVKHHNKTALARLIGERLGIKVDPGALFDVQIKRIHEYKRQLLNVIETVALYQSMKDDPNGNWVPRVKIFAGKAAASYKYAKLIIKLINDVAEVVNNDPAIGGKLKVVFLPDYNVSLAEVIIPAADLSEQISTAGMEASGTGNMKLALNGAITIGTLDGANIEIRDHVGNENIAIFGMEAGDVMIRRKQGLDASDVIRSSPKLQRAINAVGAGEFSPGDPGRFESIAHALRYLDHYMVSADFDSYYEAQRAVDARWQVAPAWTRASILNVARMAWFSSDRTIREYAEEIWNVPVNPTTPLLPDLRDAAG

SEQ ID NO: 5602 - protein, 394 aa, Staphylococcus epidermidis ATCC 12228
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKEQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 5603 - protein, 141 aa, Haemophilus influenzae 86-028NP
MMTERTFSIIKSDAVKRNLIGAILTRFEQNGFKIIASKMVRLTREQAEGFYAEHQGKEFFAPLVEYMMSSPIVVSVLEKENAVKDYRTLIGTTNPETAEEGTIRKDFALSQRENSVHGSDSIENANREIAYFFTDCEIFER

SEQ ID NO: 5604 - protein, 504 aa, Debaryomyces hansenii CBS767
MSNASLSWLTKLNTSETPDKVLRRSSIIGTIGPKTNNVDVLVKLRKAGLNIVRMNFSHGSYEYHQSVIDNAKQSEEIYKGRPLAIALDTKGPEIRTGTTIDDKDYPILPNHEMIFTTDEAYAKKCDDKVMFIDYKNITKVIEAGKIIYIDDGVVSFEVLQIVDDKTLKVRSVNSGKICSHKGVNLPGTDVDLPALSEKDKADIKFGVKNGVHMIFASFIRTGDDIKEIRKVLGEEGKDIQIIAKIENQQGVNNFDEILVETDGVMVARGDLGIEIPAPQVFVVQKQLIAKCNLAAKPVICATQMLESMTYNPRPTRAEVSDVGNAILDGADCVMLSGETAKGNYPFEAVSMMHNTAIIAEKAIAYQPLHNEIRSLANRPTPTTETCAMASVSAAYEQDAKAIVVLSTSGFTSRLVSKYKPNVPVMMVTRNHRAARYCHLYRGVYPFVYEKKTVDNWQEDVENRLRWAVSEAIDLGIIKKGDSIVTIQGWTRGSGHSNTVRVVQA

SEQ ID NO: 5605 - protein, 289 aa, Desulfovibrio desulfuricans G20
MSTHAETRAITAADIRAAKNTRRLAMLTAYDYPTASIADEGGMDMLLVGDSLAMVVLGHEDTLSVTLDEMIHHCRAVTRGASRALVVGDLPFMTYEQGPDQAMHSAARLFREGGVRAVKLEGGKEVAPQVEALVKAGIPVMGHIGLTPQRVAALGGFKVQGRSAAAARSLAEDARILEDAGCFALVLEAIPAPVAAHITRTSGIPTIGIGAGAQCDGQVLVVHDMLGLFDRFTPKFVKRYAELRGHAVKAVQQYGDEVRQGEFPAAQHSFGMPEDEQRRWEENVSGADD

SEQ ID NO: 5606 - protein, 145 aa, Arabidopsis thaliana
  misc_feature (114)..(114): Xaa can be any naturally occurring amino acid
  misc_feature (128)..(128): Xaa can be any naturally occurring amino acid
  misc_feature (130)..(130): Xaa can be any naturally occurring amino acid
  misc_feature (133)..(133): Xaa can be any naturally occurring amino acid
  unsure (1)..(145): unsure at all Xaa locations
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTXPGYYDGGYWTIWKXPXFGXTDPSSVGVKRPG

SEQ ID NO: 5607 - protein, 338 aa, Vibrio parahaemolyticus RIMD 2210633
MSGMRTLGEFIVEKQADFPHASGDLSSLLASIRLAAKIVNREINAAGLGDITGAVGTENVQGEAQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEDGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 5608 - protein, 67 aa, Brassica napus
MRKSTEIPAKASGFVKSEEKTVKPPFRLAVDDTKPVLQDPILRSDPMETEEAVLRLPSFPVMRPSKS

SEQ ID NO: 5609 - protein, 338 aa, Chlamydomonas reinhardtii
MPSTALQGHTLPSSSACLGRATRHVCRVSTRSRRAVTVRAGPLETLVKPLTTLGKVSDLKVGIANFYDESSELWENMWGEHMHHGYYPKGAPVKSNQQAQIDMIEETLKVAGVTQAKKMVDVGCGIGGSSRYISRKFGCTSNGITLSPKQAARANALSKEQGFGDKLQFQVGDALAQPFEAGAFDLVWSMESGEHMPDKKKFVSELARVCAPGGTVIVVTWCHRVLGPGEAGLREDEKALLDRINEAYYLPDWCSVADYQKLFEAQGLTDIQTRDWSQEVSPFWGAVIATALTSEGLAGLAKAGWTTIKGALVMPLMAEGFRRGLIKFNLISGRKLQQ

SEQ ID NO: 5610 - protein, 557 aa, Arabidopsis thaliana
  misc_feature (336)..(336): Xaa can be any naturally occurring amino acid
  unsure (1)..(557): unsure at all Xaa locations
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPXIDRTSGEYLAHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 5611 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVTAAVSA

SEQ ID NO: 5612 - protein, 396 aa, Myxococcus xanthus DK 1622
MKLAHRLQAIKPSPTLALNSRAKALVAKGVDVVVLAAGEPDFDTPDYVKQAAVDALRAGFTKYTPTNGIPELREAICAKLERDNGLRYTPDQVLVTSGGKQGLYNFCQAALEEGDEVIIFAPFWVSYPDMVRLAGATPVIVPTREEDGFAPDPDAIRRALTPRTRAVIINSPGNPTGAVYSRAALERIAEVLRPHDCLIVTDDIYEKLLYTDERLGISDVAPDLVPRLVVVNGMSKAYSMTGWRMGYVAGPKPLLAGMQMVQDQSTSNASSIGQKAALAALQGPPDTIAAMVKEYRERRDFFIAGLNALDGVRCRMPEGAFYAFADVRGLLGRSYKGKPVTSAMQLSEILLDDFRVAAVPGEPFGAEGYVRMSFVTSREVLQKGLARLGELVKALS

SEQ ID NO: 5613 - protein, 490 aa, Colwellia psychrerythraea 34H
MQEHQELGLQDNQLVRSFSYINGRWHSSDSYISVTNPANGKVIAQVSNAGVVETELAVKAAKDALKMWSAKSANERATLMRNWFNLIMENQDDLGRILTLEQGKPLAEAKGEIGYGAAFIEWFAEEGKRVYGDTIPAPSGDKRIIVIKQPVGVVASVTPWNFPNAMIARKAAAALSAGCTFVVRPATQTPLSALAMAELAERAGIPAGVFNVVVGEDAHGIGKVLTQHPDIAKFTFTGSTPVGKALISQCATSVKKVSMELGGNAPFIVFDDADIDAAVQGALVSKYRNAGQTCVCTNRIFVQKGVIEQFTKKFTSAVAALAIGDGLTDGVSIGPMISSDAVCDVELLVKDSITAGAILALGGERDQAGDAFYQPTILTNVTNDMPIAKNEIFGPVTPIISFEDEDEVIAMANDTEYGLASYFYARDIGRIWRVAEGLEYGMVGINEGMISNAAAPFGGVKQSGNGREGSKYGLDDYLEIKYLCMGGLGK

SEQ ID NO: 5614 - protein, 118 aa, Arabidopsis thaliana
  misc_feature (22)..(22): Xaa can be any naturally occurring amino acid
  unsure (1)..(118): unsure at all Xaa locations
RPTRPVVTSPAHATMVAPFTGXKSSAAFPVTRKTNKDMTSIASNGGRLNCMKGSPPIGNKKLETLSYLPDLNDVEWAKEVDYLLRNKRSPCVEFELQHGYVYREHRDTPGYYDGLYWT

SEQ ID NO: 5615 - protein, 170 aa, Arabidopsis thaliana
  misc_feature (112)..(112): Xaa can be any naturally occurring amino acid
  unsure (1)..(170): unsure at all Xaa locations
LIFLCVYLNCQEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWXKGVILEKTEQFIMVSLLVFLLPMMKLWCFVPDFGQYNITANLWLDSSHIWDHLPWNQN

SEQ ID NO: 5616 - protein, 841 aa, Prochlorococcus marinus str. MIT 9313
MSSSHPLDLRLPTPGCFADPERAGLDADAVFDGMTEHLFFTLGKLAPTASNHDLYMALSYAVRDRLMTRYLASLEAIRARPHKTVAYLSAEFLIGPQLNSNLLNLGISKEIAEQALRRFRIESLDQILEVEEEPGLGNGGLGRLAACYMESLASLQVPAIGYGIRYEFGIFNQLIRDGWQVEVTDKWLKGGWPWELPQPEEACFVGFGGRTESYTDGKGNYRSRWIPSEHAIGIPHDVPVLGYRVNTCNRLRLWRADATESFDFYAFNIGDYYGAVEEKVGSETLSKVLYPNDGTDEGRRLRLKQQHFFVSCSLQDMLRSLGNRGIPIEEFPNHWTVQLNDTHPAIAVAELMRLLIDEHYLDWDTAWDITTRSVAYTNHTLLPEALEKWDLTRFASLLPRHLELIYEINRRFLQQVRLRYPGNDAIQRKLSIIDEDGGKAVRMANLATIAAHHVNGVAALHSDLLKRQLMPEFAEIWPEKFTNITNGVTPRRWVALANPALSRLLDEHVGPEWITNMELLTKLEERQHDTAFLEQWGATKLSVKRKLAGYIHRQTGVLVDPSSLFDVQVKRIHEYKRQHLNALQVITHYLRIKNGQANGMAPRTVIFGGKAAPGYYMAKLIIRFINGIAETINADPDMEGRLRVVFLPDYNVKLAEQIYPASDLSEQVSTAGKEASGTGNMKFAMNGALTIGTLDGANVEIRERVGPENFFLFGKTETEIMELQTKGYRPRQIVETLPELAEALRLIGLGHFSNGDGELFRPLLDNLTGFDPFFVLADFADYLRAQDEVNQAWTNRKQWNRMSLLNTARTGFFSSDRSIQDYCQTIWKAEPFPVEITCDVP

SEQ ID NO: 5617 - protein, 307 aa, Cytophaga hutchinsonii ATCC 33406
MQGIQVHKIGVYKGHKDSIYALEKGMGDSCFYTSGADGLVVAWDMHAPDQGTLVAKLPNSVYALHYDAQASELVLGQNFEGVHVIDTSTNVEKRSAQITKDAIFDIKKILDWFLVATGDGHLIVLDVSDLSVIAKIKISDSSIRVIAIHPNKKQLAIGSSDHLIRIIDIPSLRIIHTLKGHTNSVFALTYSPDGEVLLSAGRDAHLKVWDMLTYTPMHSIAAHMYAINHIAYSPSGNYFVTASMDKSIKVWDAAAFKLLKVIDKSRHAGHATSVNKLWWSDFNNNIVSVSDDRTISIWNVDLPHSVL

SEQ ID NO: 5618 - protein, 484 aa, Prochlorococcus marinus str. MIT 9313
MATPPLIPVILCGGTGTRLWPLSRASYPKQYWALSGSSEETLLQQTQQRLKGIEGLSAPLLICNEEHRFIVAEQMRQIDVEPNAILLEPMGRNTAPAVTVAALQATERGEDPILLVLAADHVIRNATQFRHIIEAGRIPAEAGRLVTFGIVPTAPETGYGYIEAAESFGNGEPKAVPIARFVEKPDRIAAEQFLANGCFTWNSGMFMFKASAILSELERLSPEVVSCCRAALEQEVPDLDFLRLEREAFAKCPNVAIDVAVMEKTELGTVLPLDAGWSDVGSWSALWNTTDRDLNGNVLRGHVIAESSRNCYLRSEHRLVVGLGVEDLVVVETDDAVLIANRNQAQDVKTIVKQLEADGSPEGKAHRKIYRPWGHYTSVVKDSRWQVKHIELKPGASLSLQMHHHRAEHWIVVKGTALVEKDGDKQLVGENQSTYIPLGCKHRLTNPGRMPMELIEVQSGPYLCEDDIVRFEDRYGRSESVIVN

SEQ ID NO: 5619 - protein, 468 aa, Salmonella typhimurium
SAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 5620 - protein, 347 aa, Brassica oleracea
MKATLAPPSSLISLPRHKVSSLRSPSLLLQSQRPSSALMTTTATRGSVAVTAAATSSAEALREGIAEFYNETSGLWEEIWGDHMHHGFYDPDSSVQLSDSGHREAQIRMIEESLRFAGVTEEEKKIKRVVDVGCGIGGSSRYIASKFGAECIGITLSPVQAKRANDLAAAQSLSHKVSFQVADALDQPFEDGIFDLVWSMESGEHMPDKAKFVKELVRVTAPGGRIIIVTWCHRNLSQGEESLQPWEQNLLDRICKTFYLPAWCSTSDYVELLQSLSLQDIKCADWSENVAPFWPAVIRTALTWKGLVSLLRSGMKSIKGALTMPLMIEGYKKGVIKFGIIACQKPL

SEQ ID NO: 5621 - protein, 392 aa, Clostridium perfringens ATCC 13124
MILENMILDNVKNMPPSGIRKYFDLINEMEDVISLGVGEPDFVTPWNVREAGIYSLEQGHTHYSSNAGFIELREEISKYLNRRFSLRYNPKDEILVTVGGSEGIDLALRALVGPGDEVIIPEPSFVAYKGCTAFTGATAKTIDLRACDDFKLTPELLEEAITEKTKVVIIPFPNNPTGAIMNREELQKIVDVLKDRDVIIISDEIYAELSYDEDHVSIASFPEVKEKTIVINGFSKAYAMTGWRLGYVCAHKVLIDAMKKIHQYAIMCSPTTAQYAAIEALKNGDESVFEMAREYNRRRRVLVDGFRSMGLDCFEPLGALYVFPCIKSTGMSSDEFCEKLLLEEKVLAVPGNAFGECGEGFIRACYAASMEDIMEAIKRIRRFVERNNMQGK

SEQ ID NO: 5622 - protein, 275 aa, Salmonella typhi
  misc_feature (175)..(175): Xaa can be any naturally occurring amino acid
  unsure (1)..(275): unsure at all Xaa locations
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVPPVINQIELHPLMQQRQLHAXNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQSGG

SEQ ID NO: 5623 - protein, 348 aa, Ustilago maydis 521
MASYTSIVRDMLRPSTSSSSSTAWWDPNTSMPVLDDRIVIITGPTSGIGYETLRQLVLSSAHVYLFGRSLGRLEQTRATLCVECSAALDALEPRSLRYGAKVGSMHLIQCDLSDLHSIQRAVTEFLQSETHVDLVFANAGVMLSGKTAQGYEQMFGTNVLGHHALVRLLLPALRRSATLRNSASTGETRIVLTASDTHRWVNHRDHVTLSDDATNAKLGHMHLYGRSKLGNIYTAAHLAHLSHKHAWGLTVCSVHPGGVKSQLGSTNRILTAIKNMFLVPATLGAVTQLWAGAGAQAAQVNARYLVPYATVGTESELASNKLVRDNVWTWCEQQCLKHGLTQPQDLIL

SEQ ID NO: 5624 - protein, 212 aa, uncultured marine gamma proteobacterium EBAC31A08
MSGSKINVAKQAIEYIKNNLHPEMILGIGTGSTVNFFIEELKEHRHKFAGAVSSSDASSKLLNENGIEVFSLNDVVDIAYYIDGADEVSPENCLIKGGGGAHTREKIVASASNEFICIVDQSKMVNLLGAFPLPIEVIPESRSLVARKIISIGGIPTYRTGFITDQGNHILDISNMDISNPTEMEALINNIPGVVDNGIFAANKPKTVLVSK

SEQ ID NO: 5625 - protein, 575 aa, Schizosaccharomyces pombe 972h-
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 5626 - protein, 628 aa, Desulfotalea psychrophila LSv54
MEHFLLQLFIFLAAASIAVPIAKKLGLGSVLGYLIAGIIIGPFGLSLIGDIEEVMHFTEFGVVMMLFLVGLELKPSLLWQMRIPILGMGGAQVVLSSLAIGGVALFFLPWQQAVAIGLILSLSSTAIVLQTLREKGLMNTSPGKSIFSVLLFQDLAVIPMLAALPLLATVTIHDNKHHASALFNINLLPGYLQISATLLAILSIFFLGKFASRPIFRTIAATRVREVFVAAALALVVGISLLMTVVGLSPALGTFLAGVVLADSEYRHELESDLEPFKGLLLGIFFISIGSSLNFTLIGENILLIALLTIGLISLKWFVLVGTGFIFKMAKKERSFFGIALAQGGEFAFVLFQFTKINGVLPTQTIDPLISAVAISMFLAPLLLLAHDKFVSSNQREEAQRDTDTIDHSGQKVILAGFGRLGTDLGRFLISAGVKPVILDHDAANVDVLRKFGFEVYYGDITRLDLLEAAGAAEAELLIITIGDINKSRNLIELVAKHYPHLKIAVNASDRSSAYELMDLGITQIRRETFGSALALGQDSLEMLGFDPYDTHKLMRIFKKNDEVTMPELYKTHREDQNQYISMYQKQNEDLEELMTLDLDNDMEGFDKAWTSGNPQEYIPSAEQKKQL

SEQ ID NO: 5627 - protein, 238 aa, Arabidopsis thaliana
  misc_feature (31)..(31): Xaa can be any naturally occurring amino acid
  misc_feature (39)..(39): Xaa can be any naturally occurring amino acid
  misc_feature (84)..(84): Xaa can be any naturally occurring amino acid
  misc_feature (116)..(116): Xaa can be any naturally occurring amino acid
  misc_feature (128)..(128): Xaa can be any naturally occurring amino acid
  misc_feature (135)..(135): Xaa can be any naturally occurring amino acid
  misc_feature (157)..(157): Xaa can be any naturally occurring amino acid
  unsure (1)..(238): unsure at all Xaa locations
AKEEEKQREEEVAPSMLYSAGVVTSPTQATXMVAPCTGXKSYAAFPVTRKTNKDITCIASYGGRVICMKVWPPIGKKKFETLSXYLPDLSDVELAKEVDYLFRNKWIPCVEFELEXHGFVYREHGTTXPGYYDGXRYWTMWKLPIVRDAPDSAQVLXKEVEECKKEYPGAFIRIIGFDNTRQVQCISFIAYKPPSFTEALISFLKHSYELSLLISFPIVCVLFLFMRQFLSDCQMSDL

SEQ ID NO: 5628 - protein, 444 aa, Oryza sativa (japonica cultivar-group)
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 5629 - protein, 180 aa, Zea mays
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 5630 - protein, 340 aa, Brassica napus
  misc_feature (119)..(119): Xaa can be any naturally occurring amino acid
  misc_feature (152)..(152): Xaa can be any naturally occurring amino acid
  unsure (1)..(340): unsure at all Xaa locations
SLSHSPSCLTPHSLQLTTFSLFSFLFPCRCHPTVCSFSLRPPSLSPLPRPCLLLHPPLPLSRPFHLPLRLVSSSPLSPGPVAGKAWSGGFWMGEDFKCSMTKVSSDNIVPTLDSATFEXDVDVVGVHRSVCTSPVESTLTERILICGQNSWXLGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEVHVAVRDWLKKNVSEEVASKTRIIYGGSVNGGNCAELAKEEDIDGFLVGGASLKGPEFATIVNSVTSKKVAA

SEQ ID NO: 5631 - protein, 472 aa, Haemophilus somnus 129PT
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDVAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 5632 - protein, 230 aa, Arabidopsis thaliana
MKILLASLCLISLLVILPSVFSASSSSEDFDFFYFVQQWPGSYCDTQKKCCYPNSGKPAADFGIHGLWPNYKDGTYPSNCDDSKPFDSSTISDLLTSMKKSWPTLACPSGSGEAFWEHEWEKHGTCSESVIDQHEYFQTALNLKQKTNLLGALTKAGINPDGKSYSLESIRDSIKESIGFTPWVECNRDGSGNSQLYQVYLCVDRSGSGLIECPVFPHGKCGAEIEFPSF

SEQ ID NO: 5633 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNASCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 5634 - protein, 391 aa, Burkholderia pseudomallei K96243
MKALCWHGKHTVRYETVADPAVEDPRDAIVEVRACSIGGADLHLYDAVIPGLKDGDVLGRECVGEVVEIGAGVSRRRVGERVVVPFAIACGECDQCRRGNWSVCETTNPHRALADKVFGHATGGLLGCGHLAGGYPGGQAQYVRVPHADVAPATIPDGVDDERALFVGDSLATGWQAAAQCEIEPGNVVAVWGAGAVGLFAAMSARLLGAAEVIAIDRVPERLALAQKLGATPLDFERLGVADTLAERTRGKGPDKCIDAVGLEAQAGEALDAVTDRFRPTVAAGADQPHVLREMIYACRPGGVLSVPGVYGGLVDKLPMGALMHKGLTLRAGQTHVCRWTAGLLERIADGRLDPSCVITHRATLEEGPAMYETFGARRDGCIRPVLRPRH

SEQ ID NO: 5635 - protein, 362 aa, Burkholderia sp. 383
MTTPEAPPRMTAVVCHGPEDYRVEQVAKPRPGANELVIRIAACGICASDCKCYTGAKMFWGGPSPWVKAPVIPGHEFFGYVEALGDGAAEHFGVAVGDRVIAEQIVPCGKCRYCKSGQYWMCEVHNIFGFQREVADGGMAEYMRIPPTAIVHRIPLGVSLEDAAIIEPLSCAIHTVNRGDVQLDDVVVIAGAGPLGLMMTQVAHLKTPKKLVVIDLIDERLELAREYGADVTINPKRDDAREIVRSLTDGYGCDVYIETTGAPVGVSQGLDLIRKLGRFVEFSVFGEDATVDWSIIGDRKELDVRGAHLGPYCYPIAIDLLARGLVTSKGIVTHDFALEDWDDAIRVAKSPESIKVLLKPAR

SEQ ID NO: 5636 - protein, 280 aa, Streptococcus agalactiae NEM316
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDITTLIQLDSGIKPKDPDNVSF

SEQ ID NO: 5637 - protein, 320 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKEFYCVGIQG

SEQ ID NO: 5638 - protein, 281 aa, Clostridium perfringens ATCC 13124
MAINWFPGHMVKTKREIQNNLKLVDAVIEIRDARIPKSSKNPDIDTLCAGKPRVILLNKSDLTDPKVTKAWKDSLTNDETIVLEVNALKGEGLNAIKPALLKLLKDKHDRLKAKGLAKITTRAMVVGIPNVGKSTFINKMAKNNIAKTGDRPGVTKNKQWIKTKLGIELMDTPGVLWPKFEDEIVGLNLAFTGAIKDEIMDTEELALKLVERLQETNPEELMTRYKLTELHENPLDNLDAIARKRGAIMSGNQIDYNRIAGIILDEFRGGKIGKISLEKPE

SEQ ID NO: 5639 - protein, 107 aa, Glycine max
ETEAMKASVDRIWPPEIALGDVNKRLIRGLNGCEMARFKFRKGCITFYVYAVRQLGSFGFSCAADLRTILQSVVELKDFLDHTVMLSMPNQRSISFSQSQPQVAMAH

SEQ ID NO: 5640 - protein, 803 aa, Lactobacillus acidophilus NCFM
MQLTKDEFKKKLKNKVNIYFEEELDEASNSELYTALSGVVRDGYAPQWRRTRISEADQGQKQVYYFSIEFLPGTLLKTNLLNLGWLDTVRAALSDLGLDLDKIAAAEPDMALGNGGLGRLAAAFMDSLASTGYTGNGNGIRYKYGLFKQKFVNGYQKELPNDWLKKDDHWEVRRESKSVLVRFGGKVRMVDDNGWMTPQYEGGDVVRAVPYDTAIVGYRDGVTNTLRLWDAEIPPEEELSYPTISDRRRIEDLTSILYPDDSNYEGRLLRLKQEYFFVSAGLQSILDYYVKKLGNKDFTKLPDYVAVHINDTHPAMAIAELMRLLVDEHRVDWETAWDITLKVMSYTNHTIMSEAMEKWDTNMLSQLLPRIMQIITEIDRRYCAYLNGQVSNDVIERTRIIKNGQVQMAHLAIIGSHSINGVAALHTQLLETKVLKDFYNLYPDRFNNKTNGITLRRWLQIANPELSDLLDQTIGKDWRKNSDKMLNFEKYYNDTLVLERINQIKLDNKKKLAEFIKEQMGVEVDPNAIFDVQVKRLHEYKRQTLKLLHILKLYQDLKAGIDHPKRVVIFGAKAAPSYVFAKQVIKVINETANMINSDPDINGKLKVIFLENYDVSLAEKIIPAADVSEQISTTTKEASGTSNMKLMANGALTVATMDGANIEIADAVGEDNIITFGLNKDQVYKYYAEHSYHPREMYESDPVMKKTVDALTDGTIPNCFSEGQALANKFLSDNEQFFVLADFADYLKAQEKVEQEWKDKHSWAQMSLVNIAHSERFDVDKTIERYAQDIWHLKKLKVEKVDH

SEQ ID NO: 5641 - protein, 753 aa, Oryza sativa (japonica cultivar-group)
MAIDHWRSYLQMGEFIILTDHHSLMHLSDQRLHTPWQHKAFTKLLGLSYRICYRKGTCNGPADALSRKFQDTEDELCHISACTLTWIQEVTDGYKQDPFSTQLLTELAVNATGRKHFTLNSGLIRFKGRVWIGDNPTLQSKLLTELHSSPIGGHSGFPVTYRKLKQLFAWPKMKKMTKTFVQQCQICLQAKPDRARYPGLLQPLPVPEGAWQVISLDFIEGLPRDKVFTSQLWEHLFEGAVQATPFEVLYGHSPSHFGIGSQDCAIPDLAQWLKERRLMQNLVQQHLHRAQQQMKHFADKKRSFRSFEVGDWVYLKLQPYVQTSVAVRANHKLAFKYFGPYQVTAKIGTVAYQLQLPSSTSIHPVFHVSQLKSAIGFTGPVQHQLPASTAPLQVPLRILDRRLTKRGNSAVAQVLIQWSASVPEDATWEDLDDLRSRFPAALAWGQANSQGEGLVRDSQDHPGDISQGSTAEEPEEEEGSRPEVADEAGSREDKEEVIQTSGDNQAWVATRRPVRERRPNPKQRLLLNPFLLGTDVDQELRMLKSQRRFCAGCQTLARLQGDIQVEGIYPTQFLSTKVEAVSWGLDMLKRSHGGFRLGRKLLSAWRWALCCRRRRRRGYLRLQTTSGGCGGACKEGSEEAKRLAPVLRWGRSLVRRLSLGRKDGGRRRILDEPVSTPKGQVAVYVGGGNPGESLRYVVPVVYFNHPMFGELLREAEEEFGFQHPGGITIPCAASRFERAAAVAAAGKKAFGRW

SEQ ID NO: 5642 - protein, 189 aa, Brassica napus
NVTKIRQEVNINLLKICGQERPSNDYSIECLNKLGDLRGALYESMRLYPPVPFERMTPVRPDVLPSGHKVDASMKILIFIYALGRMEAVWGEDALEFKPGRWVSETGGFREEPSYKFFAFFGGPRSCLGKLLAMTLMKTVVVEILQNYDFQLVKGQTIEPATGPILRMKHGLRVKLTKRCSSYETNENT

SEQ ID NO: 5643 - protein, 416 aa, uncultured marine gamma proteobacterium EBAC31A08
MPGGVNSPVRAFKNINGNPIFFERASGAYLYDADHNEYIDYIGSWGPMIMGHSHPDIVGAIKNQVALGTSYGAPTSLESDVARLIKKCIPSIEKIRMVNSGTEATMTTIRLARGFTGRNKIIKFDGCYHGHVDSLLIKAGSGVATFGLPDSPGVPADLAKYTFSCEYNNKEQFLEIFNEIKDDLAAVIVEPVAGNMGFVPGHEDFLKLLRETTSANNSILIFDEVMSGFRVSLGGAQEIYNITPDLTALGKVIGGGLPVGAFGGKEEIMNYLAPSGPVYQAGTLSGNPLAMAGGTALLQLLIKENPFKELERNASVLLDGMKTLMIESGIPFSINRIGGMFGFFFSEELPNNINDVAKTDDVLFSNFLNSCIRSGIYFAPSKYEAGFISAMHKDQEINRTLETVKQIIQKGITHEI

SEQ ID NO: 5644 - protein, 149 aa, Oryza sativa (japonica cultivar-group)
VEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 5645 - protein, 915 aa, Oryza sativa
  misc_feature (795)..(795): Xaa can be any naturally occurring amino acid
  unsure (1)..(915): unsure at all Xaa locations
MGIINNTHIRDGNGPETRQSGGCVVDSAGLDGGNLHFYCYTLEFDGGLIVVGGRLPVKEAALRQMVGWVGHWVLTVFRIWDSEFSKFNILDLHELINKSIPLSFMEASSWLCYQARGFGSSRVWLWLLLALVLLNCSLVLSASPYLVGMGSFDITGPAADVNMMGYANTEQIASGIHFRLKSRAFIVAEPNGKRVVFVNIDACMASQIVTIKVLERLKARNIEEPRCPHVHWYGDLYNENNVAISGIHTHAGPGGYLQYVVYIVTSLGFVRQSFDVIVDGIEQSIVEAHNNLRPGKIFVNKESFITIDDLKPDFRCDLLDAGVNRSPSAYLNNPAEERSKYEYNVDKEMTLIKFVDDELGPVGSFNWFATHGTSMSRTNSLISGDNKGAAARFMEDWAEQMGLPKQSAHANSDDLRSLHKTSVLPRRVSTIIPEPNEITDDLIQLASSYEASGGRRLAGSSITRRIRSTQQNKPKFVSAFCQSNCGDVSPNVLGTFCIDTNLPCDFNHSTCNGKNELCYGRGPGYPDEFESTRVIGNRQFLKARDLFDSASEEIQGKIDYRHTYLDFSKLEVKVSTSAGGQQTVKTCPAAMGFAFAAGTTDGPGAFDFRQGDVKGNPFWKLVRNLLKTPGKDQVECHSPKPILLDTGEMKEPYDWAPAILPVQMIRIGQLVILCVPGEFTTMAGRRLRDAVKTVLTSGNSEFDKNIHVVLAGLTNSYSQYITTFEEYQIQRYEGASTLYGPHTLSAYIQEFQKLAMAMIANKEVPTNFQPPDMLDKQIGLLPGVVFDSTPLGVQXGNVRSDFPVNFNFNKGSTVNATFYSACPRNDLLTDGTFALVEKLDGNNNWVPVYDDDDWSLRFKWSRPARLSSRSFATLEWTVPEDAAAGVYRLRHFGASKPMFGSVRHFTGTSRAFAVR

SEQ ID NO: 5646 - protein, 277 aa, Burkholderia sp.
MILAKARIQGHTARKRFGQHFLIDSAVIDAIVSAIAPAPQDCLVEIGPGLGALTWPLLERLGGAGRLHAIEMDRDLAAHLQRLGHASLILHAGDALRFDFAQLARAEQARLRIVGNLPYNISSPLLFHLLDEMNEVVDQHFMLQREVAARIAAAPGSAHYGRLSVMLQSRYAVERLFDVPPCAFAPPPAVHSAVLRMAPHASRALPQLDWARFAALVRAAFSQRRKILRHTLSVYQKTPDFDALGFDHGRRAQEVPVGEYLKLAQHIEQNAHPNPKP

SEQ ID NO: 5647 - protein, 532 aa, Oryza sativa
MEVGTWAVVVAVAAAYMTWFWRMSRGLSGPRVWPVVGSLPGLVQHAENMHEWIAANLRRAGGTYQTCIFAVPGVARRGGLVTVTCDPRNLEHVLKSRFDNYPKGPFWHAVFRDLLGDGIFNSDGETWVAQRKTAALEFTTRTLRTAMSRWVSRSIHHRLLPILDDAAAGKAHVDLQDLLLRLTFDNICGLAFGKDPETLAKGLPENAFASAFDRATEATLNRFIFPEYLWRCKKWLGLGMETTLASSVAHVDQYLAAVIKARKLELAGNGKCDTVAMHDDLLSRFMRKGSYSDESLQHVALNFILAGRDTSSVALSWFFWLVSTHPAVERKVVHELCAVLAASRGAHDPALWLAAPFTFEELDSLVYLKAALSETLRLYPSVPEDSKHVVADDYLPDGTFVPAGSSVTYSIYSAGRMKTVWGEDCLEFRPERWLSADGSKFEPHDSYKFVAFNAGPRICLGKDLAYLQMKNIAGSVLLRHRLAVAQGHRVEQKMSLTLFMKNGLRMEVRPRDLAPVADELRGADVRATAPCA

SEQ ID NO: 5648 - protein, 481 aa, Haemophilus somnus 129PT
MNIQHLLKTQAYINGEFISAKNHRTFPVINPANQQVICEIACCGKEETELAIKSAKQAQVHWKKYTAKERSKILKKWFELIMQHQESLAYLLSLEQGKPLSESRAEIAYGASFVEWFAEEAKRAYGEIIPQVREDHRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 5649 - protein, 393 aa, Lycopersicon esculentum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGVAEYQKLITRNPIFLERVEGVGIIGRDEALNWGLSGPMLRASGIEWDLRKVDHYESYDEFDWQVQWQREGDSLARYLVRIGEMTESIKIIQQALEGIPGGPYENLEMRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 5650 - protein, 375 aa, Fucus distichus
MADEDVQALVVDNGSGMCKAGFGDDAPRAVFPSIVGRPKHPGIMVGMDQKDAYVGDEAQSKRGVLTLKYPIEHGIVTNWDDMEKIWHHTFYNELRVAPEEHPVLLTEVPLNPKANKERMTQIMFETFNVLAMYVNIQAVLSLYASGSTTGCVLDSGDGVSHTVPIYEGYALPHAINRLDLAGRDLTDNLMKVLTERGYSFTTTREREIVRDIREKLTYVALDFDQEMKTAGESSQLEKSYELPDGNVIVIGNERFRCPEVLFQPSFIGMESSGIHDCTFKTIMKCDVDIRKDLYGNIVLSGGTTMFPGIGERMTKELTALAPSTMKIKVVAPPERKYSVWIGGSILASLSTFQQMWISKAEYDESGPSIVHRKCF

SEQ ID NO: 5651 - protein, 130 aa, Zea mays
AFRAFLLKPSMGPPVPEAKARATRDQLAGSRVKFFNRRIPPSGPGIMFFSGGHSEVEATQNLNALNKGPNRGNVSFSYARALKKTCLKTWGGQPTRVKAAQNPLLLPARANSLAQFGRSTSNGKAARAKE

SEQ ID NO: 5652 - protein, 537 aa, Oryza sativa
  misc_feature (344)..(344): Xaa can be any naturally occurring amino acid
  misc_feature (425)..(425): Xaa can be any naturally occurring amino acid
  unsure (1)..(537): unsure at all Xaa locations
MSLVVSVASARARAISRARARTGASTMSTALPISTPGAIARAATIPGTLALVPVKERVVAPCSPLPSEKPEAMASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECQGQGXTPEQVSDYTLKLLHRRIPPAVPAIMFLSGGQSEVEATQNLNAMNQGPNPWHVSFSYARALQNTCLKTWGGQPENVKAAQDXRLLLRAKANSLAQLGKYTSDGEAAEATSRAPPTAPTRSATRPSSRSSSTCPRSSPSSPSSATTGCSTSTTPTPTRSSASPPSTTSGSCAGSRTWTRRCTASWWRGPRRRGTT

SEQ ID NO: 5653 - protein, 404 aa, Haemophilus influenzae R2866
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 5654 - protein, 262 aa, Glycine max
MGKESSKDTVPVTQWLNRMVSEPYYLFHFLTFFSYFVVRSSATQILAPHLTHHLLRREIQTLLVFAILAFIKGIKEETWEAFIADVLFLAKICLFLLAFTMDRRLAVWYILVFLVIHMLTQQPPFQGLGTSSKLTPLQLESLLTEGTTTRLWLVEFRSSYSPACIRSSQQFPELSITYSSKNLSFGIVDLGLFPNAAERFGISLSGSMGQLPTFILFENAAEVARFPELDFEAAYFHPKITKGLLSRHFELDRHLLEYVSGK

SEQ ID NO: 5655 - protein, 409 aa, Bordetella bronchiseptica RB50
MSRADLDTRLSDRLAASRPSATGAVSELARRLAAEGRSVISLSEGELDFDTPAHIQQAAIDAIKGGQTRYTSVGGTPALKAAIARKFARDHQLDYAPAELIAATGAKQILFNALLATIDPGDEALVVAPFWVSYTEMARIAGGTPVVITPDAANQFKLTPELLAAHITPRTRWLILNGPCNPSGALYSREELAALAEVVRQHPRLLVMSDDIYEQLVYEGKFTSFVEAAPDMRERTLTINGVSKTYAMTGWRLGYAGGPAWLIKALELLQSQSTSNPSSISQAAAAAALDGPQDFLQDWRASLSSRRDMALSVLRDAAPAMTFTRPPAAFYLFADCSQAIGMRTPKGERIGDDADFARYLLEEAGVAAVPGSAFGLAPYLRLTFCVAEARLRQACERIVAACARLARPA

SEQ ID NO: 5656 - protein, 618 aa, Haemophilus influenzae 86-028NP
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 5657 - protein, 404 aa, Lactobacillus plantarum WCFS1
MDTMKKVAAALAALKRGELIIVADDETREAEGDMVGLAAKATTATVNRMITSARGLLCVPMAPSIATRLHLTPMTSEHDAFGTAFTVSTDHHTTSTGISAADRATTIQALANPNSQAADFYHPGHVFPLIARTGGLLARRGHTEAAVTLAQLAGVTPAAYICEVIKKNGLMARRRDLKALAEGLQLPLITIEDITTYVIQTGAAQLTTTPSVNLPTKDGQFTMTGFEVPGHTALPVALQAGDISGDEPVLVRLHSECFTGDVLGSRRCDCGDQLHAALQKISQAQRGVFVYLRQEGRGIGLANKLAAYALQEHGVDTYDANVQLGFQPDERRYDIAALVLRQMGITRVRLLTNNPDKVEQLRAAGIDVVERVPLEIPANQYDQAYLKTKRDRFHHQLTLTEGHE

SEQ ID NO: 5658 - protein, 481 aa, Vibrio fischeri ES114
MSNRLRRTKIVTTLGPATDRDNNLEKIIAAGANVVRMNFSHGSPEDHIERTRKVREIAAKLGTHVAILGDLQGPKIRVSTFKEGKIQLAIGDKFTLDSDLPKGEGNQDSVGLDYKELPQDVTTGDVLLLDDGRVQLRVTAVEGNKVHTEVTVAGPLSNNKGINKQGGGLSADALTEKDKADIITAAAMKVDYLAVSFPRNGEDMNYARRLARDAGLEAQLVAKVERAETVASEEALDDIILASDVVMVARGDLGVEIGDPELVGVQKQLIRRARSLNRTVITATQMMESMISSPMPTRAEVMDVANAVLDGTDAVMLSAETAAGDFPVETVTSMAGVCMGAEKVPTVNVSNHRLDRRFTTPEETIAMSTMYAANHMEGITAMITLTESGRTPLMMSRLSSGLPIFALSRNEGTLNRAALYRGVTPVFFDEKADSGLPSTYAAINTLKSKGLLSTGDQVIITQGDVMDIVGSTNCMRIITVE

SEQ ID NO: 5659 - protein, 252 aa, Lactobacillus acidophilus NCFM
MSRTPIIAGNWKLHMNPEQTTEFVDAVKGKLPDPSKVESLICAPAVDLDALRKAAEGSNLHIGAENCYFEDEGAYTGETSPKVLKEMGIDYVIIGHSERRGYFHETDEDINKKAKAIFANGMKPIICCGESLETREANKQEDWVVAQIKAALDGLTAEQVSSLVIAYEPIWAIGTGKTASSDQAEEMCKTIRETVKDLYNEETAENVRIQYGGSVKPANVKELMSKPDIDGGLVGGASLDPESFLALVNYQD

SEQ ID NO: 5660 - protein, 122 aa, Burkholderia sp.
MDQYALKQRAALAGADYVQAHAPKGALLGVGAGSTVNILIDALVAQQAFGRHFRGAVSSSRATTARLESCGVPVFELNQADALPLYLDGADEIDPHGRMIKGGGGALTGEKIVAAAAKVFVC

SEQ ID NO: 5661 - protein, 331 aa, Rhodobacter capsulatus
MAIELEGLGLSPELADVMTRLARVGADLARTIARNGVETDLAAGVGTNAGGDGQKALDVMADDAFREALTGTAVAYYASEEQDEVVTLGKGTLALAIDPLDGSSNIDVNVSIGTIFSIFPATDDPNTSFLRKGSEQIAGGYIIYGPQCALVCSFGRGVHHWVLDLDSRSFKRLPDIKALPQDTSEYAINASNYRHWPSPIRAFIDDLVAGAEGPRGRNFNMRWIASLVAETHRILMRGGVFLYPGDERKGYARGRLRHVYECAPIAFLITQVGGGATDGCEDILSALPDKLHARTPFVFGCAAKVARVTAYHDLPGQETSAPFNTRGLFRS

SEQ ID NO: 5662 - protein, 329 aa, Bordetella bronchiseptica RB50
MPTCVIAQPVHPVGPQLLRAAGITVIEPAGPGLDALRQVIAGADAVLVRDQLPAELIDMAPRLCVIANHGTGTDKIAVAHADALGIPVVYTPQANVRSVAEHALMLMLVTARQAVQADAATRKGHWGFKYEQPMYSLYGKTLGVIGLGRTGRLLCEMAAPALNMQALVWSPSLPAGEALPPGARRVDTLQELLREADVVSLHRPLRPDTRHTLDAATLACMKPGAIVINTSRGGLIDEAALADALREGRLAGAGLDVFETEPLPAGSRVAGLPNAVLTPHVAGSTQEALHATASQCAEQIIAVLAGRRPPHLVKPSVWERRRAPVTPEQ

SEQ ID NO: 5663 - protein, 151 aa, Brassica napus
  misc_feature (10)..(10): Xaa can be any naturally occurring amino acid
  unsure (1)..(151): unsure at all Xaa locations
MKTVSVDERXNTVVLRAEHRDEEGRKAVDKLELKTRNPDTIKQVEKKLMDKGVQRMERHPSDGTQIKRPPPKSGHGGKYTWEGSDRMEDYEMQPDPAAMDEGDPNYDEEKIGGGGGDDVAVEVVKGEVEVAKEAPGGVARVEVGPRLISTP

SEQ ID NO: 5664 - protein, 165 aa, Oryza sativa
MAAEKRTIGLGMDYSPSSKAAAKWAVDNLVKAGDRIILVHVLPKGADASHKELWKSTGSPLIPLLEFMEMNVQARYGINPDKEVLEILQAESKSKQVEVLAKVYWGDAREKLCEAVDDLKVNTFVLGCRGLGPLKRALLGSVSNYVVNNATCPVTVVRAPTVSNA

SEQ ID NO: 5665 - protein, 321 aa, Shigella flexneri 2a str. 301
MKDNTVPLKLIALLANGEFHSGEQLGETLGMSRAAINKHIQTLRDWGVDVFTVPGKGYSLPEPIQLLNAEQILGQLDGGSVAVLPVIDSTNQFLLDRIGELKSGDACVAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 5666 - protein, 637 aa, Methanosarcina barkeri str. fusaro
MPIEDVLLDLKHKIEKNLPAGVTITDVEFEGPQLVLYTEEPRKFADDGNIIRNLAKELRTRIAMRPDPRVLATAEDSISIIEEVVPKESVISSYYFDPDSGEVIIEAEKPGLVIGKHGATLREITKQIGWIPKVVRTPPIKSRTVKNVREFMRNNLKERKEILKSVGRKIHKECTSKDQWVRVTSLGGCKEVGRSCFLLSTPESRILIDCGVNVGSDENMTPYLYVPEVFPLNQIDAVIVTHAHLDHQGLVPLLFKFGYEGPVYCTPPTRDLMVLLQLDYIDVAAKEGKKIPYESGMVAKTLKHTIPLDYEEVTDIAPDIKLTFHNAGHILGSAISHFHIGDGLHNVVFTGDYKYEKTRLFDPAVNKFPRVETVVSEATYGNSNAFQPSLKDAERHLQMVVKNTVERGGICIIPAFAVGRSQEVMIVLEESIRKGLIPEVPVYLDGMIWEATAIHATHPEYLNNDLRKLIFQKGQNPFLSECFKPVDSHDMRQKIIQNPHPCVIISTSGMMNGGPVMEYFKAFADEPRNSLVFVGYQADGTIGRRIQKGWKEIPMTGKGGSTEILKLNMEVQVVDGFSGHSDRRQLMDYIKRMQPRPERVFTEHGDEKACVDLASSIYKKLKIETRALTNLETVRLL

SEQ ID NO: 5667 - protein, 456 aa, Arabidopsis thaliana
MEIDSEKIHERKQSDYNSLVRTLLLYRLVQDERFEIQKEMYRGQQYSQIYFARLHLMRTLLYSLAPTWKSHLPVCKVLGLEKGKECIIVGTLFKHMKLKPCVLDEYSKERSVTPLVKPHNFMHPDDNLILEDESGRVKLAGSALSPAIYVTGVVVALHGKETNAGEFFVEDVLEAGLPPQIERPIDLQEDKYVVLLSGLCIGSKSANPLQFQLLVDHITGHLGDEEEQGLAAQIVHVVIAGNSFEFPRKLINGQVLITFNLASKDQSTLYEPIKELDIMLSQIAAGVSVDIMPGTNDPANFALPQQPLNRCLFPGSSPYNTFRSCTNPHSFDVDNIRFLGTSGQNIDDLGKYSEAKSKLDFVERTLRWRHLAPTAPNTLGCYPFTDRDPFLIETCPHVYFVGNQDKYDNRLIKGSEGQLVRLICIPKFCETGIAVAVNLRNLECHTLSFSTQINQS

SEQ ID NO: 5668 - protein, 959 aa, Yersinia pestis biovar Medievalis str. 91001
MTQNLSQLEHNDAFIQRHIGSSVEQQQQMLAAVGASSLSTLIQQIVPADIQLPGPPPVGEAATEHQALAELKGIASQNQCYKSYIGMGYSPVLTPPVILRNMLENPGWYTAYTPYQPEVSQGRLEALLNFQQLTQDLTGLDLASASLLDEATAAAESMALAKRASKLKDANRFFVADDVHPQTLDVVLTRAETFGFDVIVDRAEKVLELDGIFGVLLQQVGTTGELHDYSALLAELKKRKIITSVAADIMALVLLTAPGAQGADVVFGSAQRFGVPMGYGGPHAAFFACRDEFKRSMPGRIIGVSRDAAGNTALRMAMQTREQHIRREKANSNICTSQVLLANIASLYAVYHGPQGLQRIAGRIHRMTDILAAGLQHAGLTLRFKHWFDTLTVEVKDKAAVLARALSFGINLRTDIHGAVGITLNETTSREDIQTLFALFVGDNHGLDIDQLDAAVSQHSQSIQDSMLRRDPILTHPVFNRYHSETEMMRYMHRLERKDLALNQAMIPLGSCTMKLNAAAEMIPITWPEFAELHPFCPPEQAAGYQQMIGQLSQWLVQLTGYDAVCMQPNSGAQGEYAGLLAIRRYHESRNQANRHICLIPSSAHGTNPASAQMAGMSVVVVACDKQGNIDLHDLRQKAEHAGDELSCIMVTYPSTHGVYEETIREVCQIVHQFGGQVYLDGANMNAQVGITTPGYIGADVSHLNLHKTFCIPHGGGGPGMGPIGVKAHLAPFVPGHSVVQIDGMTTQQGAVSAAPFGSASILPISWMYIRMMGADGLKQASQVAILNANYIATRLKNAYPVLYTGHDGRVAHECILDIRPLKEATGISEMDIAKRLIDFGFHAPTMSFPVAGTLMVEPTESESKVELDRFIDAMLAIRAEIEKVAQGEWPLEDNPLVNAPHTQAELVGEWTHPYSRELAVFPVAGVLENKYWPTVKRLDDVYGDRNLFCSCVPISDYE

SEQ ID NO: 5669 - protein, 815 aa, Salmonella enterica subsp. enterica serovar Typhi
MNAPFTYASPTLSVEALKHSIAYKLMFTIGKDPVIANKHEWLNATLFAVRDRLVERWLRSNRAQLSQETRQVYYLSMEFLIGRTLSNALLSLGIYDDVKGALEAMGLDLEELIDEENDPGLGNGGLGRLAACFLDSLATLGLPGRGYGIRYDYGMFKQNIVDGRQKESPDYWLEYGNPWEFKRHNTRYKVLFGGRIQQEGKKARWIETEEILAVAYDQIIPGYDTDATNTLRLWNAQASSEINLGKFNQGDYFAAVEDKNHSENVSRVLYPDDSTYSGRELRLRQEYFLVSATVQDILHRHYQLHKTYENLADKIAIHLNDTHPVLSIPELMRLLIDEHKFSWDDAFEVCCQVFSYTNHTLMSEALETWPVDMLGKILPRHLQIIFEINDYFLKTLQEQYPNDTSLLGRASIIDESNGRRVRMAWLAVVVSHKVNGVSELHSNLMVQSLFADFAKIFPTRFCNVTNGVTPRRWLALANPPLSDVLDENIGRTWRTDLSQLSELKQHCDYPLVNHAVRQAKLENKKRLAVVIAQQLNVVVNPKALFDVQIKRIHEYKRQLMNVLHVITRYNRIKENPEADWVPRVNIFAGKAASAYYMAKHIIHLINDVAKVINNDPQIGDKLKVVFIPNYSVSLAQVIIPAADLSEQISLAGTEASGTSNMKFALNGALTIGTLDGANVEMQEHVGEENIFIFGNTAEEVEALRRQGYKPRDYYEKDEELHQVLTQIGNGVFNPEEPGRYRDLVDSLINFGDHYQVLADYRSYVDCQDKVDELYRRPEEWTTKAMLNIANMGYFSSDRTIKEYAENIWHIDPVRL

SEQ ID NO: 5670 - protein, 109 aa, Brassica napus
MASSMLSSAAVVTSPAQATMVAPFTGLKSSSAFPVTRKANNDITSIVSNGGRVSCMKVWPPVGKKKFERRLISVLKEMVRLQSEFLKPMRPRPKLLKKRLQYQQQEEEE

SEQ ID NO: 5671 - protein, 401 aa, Bifidobacterium longum NCC2705
MAQWQTLSDRINTVAPSATLAVDSKAKAMKAAGLDVVGFGAGEPNFPTPANVVKAAADACLDPKNYKYTPTPGLPELREAIAAKMLRDSGYEVNADQVVVTNGGKQAVYESFQILLNDGDEVIIPAPYWTSYPEAVKLAGGVPVEVFAGADVNFEPSLEALEAARTEHTKAIIVNSPNNPTGAVWKPETVEAIGRWAVEHHIWVISDEIYEHLNYDDAHTTYIGAAVPECRGQLLVLNGVAKTYAMPGWRVGWMVAPLEVAKAAAKLQGHMTSNVANISQRAALAAVAGPLDEVHEMRKAFDARRRAIVTALNDIEGVNCPTPTGAFYVFADITALLGKPLGPKGTVSDTSADFAAALLDEAHVAAVPGEAFGAPGYLRFSYALADEDLAEGMRRFKEWAN

SEQ ID NO: 5672 - protein, 514 aa, Oryza sativa (japonica cultivar-group)
MDLLRDRRLGALLVVVLVLVSGAAVEASIHTYDREPFREVGNAFLLSGGSEGVVADGADLAAPASSFIKFTNVTFWRTPESAESHAKMAHSTGLVQAILFEAADRDNIGGSAYGGQRSICCTPDLAKLEGCKQGEVIRRPSSDDPDWPYVLDTHFSGSHLSVKLEDEVVRITKTGMYNLFFISCDPKLRGLSMSGKTVWRNPGGYLPGRMAPLMKFYVFMSLAYLLVMVVWSSQYIRFWRDIMPIQNWITLIIALGLFEMTLWYFEYLNFNSSGVRPIGITTWVVTVGAIRKTISRLLILSISMGYGVVRPTLGGLTSKVLLLGLTYFLASELLDIAENVGTINDISGKARLFLVLPDAFLDAFLILWIFTSLSRTLEKLQARRSSVKLDIYRKFTNALAVSVIASVAWIGYEVYFKATDPFSERWQSAWIITAFWDVLAFVLLLVICYLWAPSQSSQRYAYSGEAADDDDEESQSLTKGTDGDVGMVKVDKDRSGGVSSAFSLEDEAEEDKRE

SEQ ID NO: 5673 - protein, 507 aa, Rhodococcus sp. RHA1
MLTVTACPFIVVHITPPLRSSTLDITKISPRPPGLAGALRARKSVDAIVARNDQEPGHGLKRSMGLVHLTALSIGASLGTGIFVILGEATPKAGPAVVLAFVLAAFTALFSALSYAELAGSIPVSGSSYSYTYATMGELFAWICGWCLMLEYGVSVAAVAVGWGEYINELLHGMFGIALPTAISESPGAGGIVNVPAIVIVLVAVALLTRGASESALVNTVMVALKILVLVFFCAVAFTAFRAGNFAPFIPLGAAGVTAAASQVFFAYIGFDAASTAGDEAKNAKRDLPRAIILSLLIVTILYCLVAIAAVGAMPWQDIAGEGAALATILNAATTSTWPAILLSAGAVIAIASVVLAVMYGQTRILYAMSLDGLVPRVFSRVNPRTRVPVVNIVVVGGVVSALAGFVPLGELADATSIGSLFAFMLVNIAVIILRRRHPDLHRSFRTPLFPLMPVLGVVFCALLLFGLGVSTWVAFALWMAVGLAIYFAYGVRKSELRNSPEEVTAP

SEQ ID NO: 5674 - protein, 366 aa, Leptospira interrogans serovar Lai str. 56601
MLEYVLANRIQGLDTSAIRKAFELAGTLKNPINLSIGQPHFPCPSNIIEAGSKALKEGKTAYTLTGGIPELKSALSEKYKNENEISYAKPERILVTSGISSAFLLLFNALLNEGDECLVITPHFLMYPAYIKIYGGKMNSIHESFEPEELKEFANKKLKIIIYSSPSNPTGKILSKKQLEALAELAEKTGAYLISDEIYEKFDYDKKFISVGSFYEKAITLSGFSKTYSMTGLRLASILAPESITKTLTTLQQYTLVCAPSITQWMGIEALKTDMSPYIADYKEKRDFVFESLKDHYEITKSEGAFYFFIKIKEKDEDFILKAVKEKELILVPGYIFTSSKNYIRISFASEWENLKRGISALVDLA

SEQ ID NO: 5675 - protein, 797 aa, Salmonella enterica subsp. enterica serovar Typhi
MSQPTFNKDQFQAALTRQWQRFGLLSASDMTPRQWWQAVSGALAELLSAQPVAQPTKGQRHVNYISMEFLIGRLTGNNLLNLGWYQDVSDVLKAHDINLTDLLEEEVDPALGNGGLGRLAACFLDSMATVGQSATGYGLNYQYGLFRQSFVEGKQMEAPDDWHRGSYPWFRHNEALDVQVGIGGKVTKEGRWKPGFVITGQSWDLPVLGYRNGVAQPLRLWQATHAHPFDLTKFNDGAFLRAEQQGIDAEKLTKVLYPNDNHTAGKKLRLMQQYFQCACSVADILRRHHLAGRKLHELADYEVIQLNDTHPTIAIPELLRVLLDEHQMSWDDAWAITSKTFAYTNHTLMPEALECWDERLIKALLPRHMQIIKQINDRFKALVDNTWPGDKQVWAKLAVVHDRQVRMANMCVVSGFAVNGVAALHSDLVVKDLFPEYHQLWPNKFHNVTNGITPRRWIKQCNPQLAALLDKTLKKEWANDLDQLINLEKYADDATFRQQYRDIKRANKERLVKFIQARTGIEISSHAIFDIQIKRLHEYKRQHLNLLHILALYKEIRENPQADRVPRVFLFGAKAAPGYYLAKNIIFAINKVAEAINNDPAVGDKLKVVFLPDYCVSAAEMLIPAADISEQISTAGKEASGTGNMKLALNGALTVGTLDGANVEIAEKVGEENIFIFGHTVEEVKALKAKGYDPVKWRKKDKVLDAVLKELESGQYSDGDKHAFDQMLHSLGKQGGDPYLVMADFAAYVEAQKQVDALYRDQEAWTRAAILNTARCGMFSSDRSIRDYQARIWQAKR

SEQ ID NO: 5676 - protein, 958 aa, Pseudomonas aeruginosa PAO1
MSQTPSLAQLQPADAFLRRHLGPDPAEQQAMLAFLGVSTRAELIVQTVPPAIRLNRPLELPAALDEQAALARLRGYAGLNQRWTSLIGMGYYGTVTPSVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLLLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLKSKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPRGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSATPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 5677 - protein, 661 aa, Acidovorax sp. JS42
MSSLALTLLYLLAAVLGVVACRSLRLPPMMGYLAAGILIGPHALALTQNSEGVRHLGEFGVVFLMFTIGLEFNLPKLRAMRRHVFGLGLLQVLACMAAFSAWLLLLARLTGGVWDMGWQTALALGGTLAMSSTAIVVKLMSERGELESEHGRRVLGILLFQDLAVVPMLVLVPALGSEPEQLLTALAVALLKATVLVAVLLVGGQRVMRWWLTQVARRKSDELFMLNLLLVTLGLAWLTELAGLSLALGAFIAGVLVSETEYRHQVGTDIRPFHDVLLGLFFITVGMMLDWHVLVERWSLVLVLLAAPLLIKTAIIVALARGLGTTTGVSLRTALYVAQAGEFSFVLLSLMQVHGLLQPALMNPVLAAMVLSMLATPFLIQYSNRIVMKLVASDWLQQSLQVTTIARQAINTSGHVLICGYGRSGQNLARMLEREGIAYMALDLDPDRVRQAAAAGNSVVFGDATRLQALKAAGLARAAALVVTYLDTPAALKVIHHARTHAPQLPVVVRTQDDSQLEKLQEAGATEVVPEAIEGSLMLASHALALVGVPMRRVLRLVQDQRDARYGLLRGYFHGADDDTPSERDQERLYSLSLPAGAAVVGKPLADLPLHGIGVRLVNVRRASGAMSPPDDRTPLAEGDTLVLSGHPTALGLAEEKLLRG

SEQ ID NO: 5678 - protein, 419 aa, Chlamydophila caviae GPIC
MMKSEGDASASCFVPIEKAIADISEGKFVIVVDEASREDEGDLIIAGEKITVEKMAFLLKYTTGIVCASLEQERIRDLEFPPMVEDNRCRYRTAFTVSVDAAKGITTGVSAADRTKVVELLSNPNSRPEDFVRPGHFFPLAGTPGGVLKRAGHTEAALDLMRLANMQPCGVLSELVNEDHTMMRLAQIIEFAKEHEISVISISDLIAYRMLSERLVIPVSSARLPTEYGDFNIHVYESLLDGIQHIALVKGDVSGKENVLVRVHSECLTGDIMGSMRCDCGHQLRSAMEYIGLEGEGVIVYLRGQEGRGIGLGHKVRAYALQDRGYDTVDANLEIGFPVDSREYGIGAQILVDLGLTKIKLITHNPHKYFGLQGFGLEIVDRIALPIHVSEENEHYLRTKKERMGHWIDLPYAEEVNIR

SEQ ID NO: 5679 - protein, 175 aa, Arabidopsis thaliana
  misc_feature (17)..(17): Xaa can be any naturally occurring amino acid
  misc_feature (101)..(101): Xaa can be any naturally occurring amino acid
  misc_feature (136)..(136): Xaa can be any naturally occurring amino acid
  unsure (1)..(175): unsure at all Xaa locations
MASSMLSSAAVVTSPAXQATMVAPFTGLKSSAAFPVTRKTNKDITSIASNGGRVSCMKVWPPIGKKKFETLSYLPDLSDVELAKEVDYLLRNKWIPCVEFXYSTDFVYREHGNTPGYYQWTDWTRWKLPLFPCTDXSAQGVEGKLKKCRKEHPGRPSLRSWGIRQHPVQVQCRQV

SEQ ID NO: 5680 - protein, 401 aa, Actinobacillus pleuropneumoniae serovar 1 str. 4074
MTDFQFSKVEDAIEAIRQGKIILVTDDEDRENEGDFICAAEFATPENINFMATYGKGLICTPISTEIAKKLNFHPMVAVNQDNHETAFTVSVDHIDTGTGISAFERSITAMKIVDDNAKATDFRRPGHMFPLIAKEGGVLVRNGHTEATVDLARLAGLKHAGLCCEIMADDGTMMTMPDLQKFAVEHNMPFITIQQLQEYRRKHDSLVKQISVVKMPTKYGEFMAHSFVEVISGKEHVALVKGDLTDGEQVLARIHSECLTGDAFGSQRCDCGQQFAAAMTQIEQEGRGVILYLRQEGRGIGLINKLRAYELQDKGMDTVEANVALGFKEDEREYYIGAQMFQQLGVKSIRLLTNNPAKIEGLKEQGLNIVAREPIIVEPNKNDIDYLKVKQIKMGHMFNF

SEQ ID NO: 5681 - protein, 853 aa, Oryza sativa
MAASPPPPPRPLLLLLPLLLVWGVVVAAAAATDTLRQGESLTGAATLVSSPSGVFEVGFFAPDPKLPSRLYLGIWYRSISPRTVVWVANRAAPATAPSPSLTLAANGELRVLDGSAADADAPLLWRSNASTQSAPRGGYKAVIQDTGSLEVRSDDGTLWDSFWHPSDTMLSGMRITVRTPGRGPSEPMRFTSWTSETDPSPGRYALGLDPANSGQAYIWRDGNVTIWRSGQWTGQNFVGIPWRPLYLYGFKPANDANLGAYYTYTASNTSLQRFVVMPNGTDICYMVKKSAQEWETVWMQPSNECEYYATCGANAKCTAMQDGKAKCTCLKGFQPKLLDQWNMGNGSQGCVRSPPLGCQVNQTGDGFLSIPNIKWPDFSYWPSTVQDENGCMNACLSNCSCGAYVYMTTIGCLLWGSDLIDMYQFQSGGYTLNLKLPASELRSHHAVWKIATIVSAVVLFVLLACLFLWWKRGRNIKDVMHKSWRSMHTSTRSQQNSGMLDISQSIPFEDDTEDGKSHELKVYSFDRIKAATCNFSDSNKLGAGGFGPVYMGKLPGGEEVAVKRLCRKSGQGLEEFKNEVILIAKLQHRNLVRLLGCCIQGEEKILVYEYMPNKSLDAFLFNPEKQGLLDWRKRFDIIEGIARGLLYLHRDSRLRVVHRDLKASNILLDKDMNPKISDFGMARMFGGDQNQFNTNRVVGTFGYMSPEYAMEGIFSVKSDIYSFGVLMLEIITGKRALSFHGQQDSLNIAGFAWRQWNEDKGEELIDPLIRASCSLRQVLRCIHIALLCVQDHAQERPDIPAVILMLSSDSSSLPMPRPPTLMLHGRSAETSKSSEKDQSHSIGTVSMTQLHGR

SEQ ID NO: 5682 - protein, 377 aa, Pisum sativum
MSHLAVSQMAVTVPVSSDFSVRRSAFKSSNLNFRDKSWAPVFTLGMKAKNCGWRNHNVICMSVQQASVPKVTVSPLELENPSEPPLNLHKPKEPYTATIVSVERLVGPKAPGETCHIVINHDGNVPYWEGQSYGVIPPGENPKKPGSPHNVRLYSIASTRYGDNFDGKTASLCVRRAVYYDPVTGKEDPSKNGVCSNFLCDSKPGDKIKIAGPSGKIMLLPEDDPNATHIMIATGTGVAPYRGYLRRMFMESVPTFKFGGLAWLFLGVANVDSLLYDDEFTKYLKDYPDNFRYNRALSREEKNKNGGKMYVQDKIEEYSDEIFKLLDNGAHIYFCGLRGMMPGIQETLKRVAEKRGESWEEKLSQLKKNKQWHVEVY

SEQ ID NO: 5683 - protein, 815 aa, Shigella flexneri 2a str. 301
MNAPFTYSSPTLSVEALKHSIAYKLMFTIGKDPVVANKHEWLNATLFAVRDRLVERWLRSNRAQLSQETRQVYYLSMEFLIGRTLSNAMLSLGIYEDVQGALEAMGLNLEELIDEENDPGLGNGGLGRLAACFLDSLATLGLPGRGYGIRYDYGMFKQNIVNGSQKESPDYWLEYGNPWEFKRHNTRYKVRFGGRIQQEGKKTRWIETEEILGVAYDQIIPGYDTDATNTLRLWSAQASSEINLGKFNQGDYFAAVEDKNHSENVSRVLYPDDSTYSGRELRLRQEYFLVSSTIQDILSRHYQLHKTYDNLADKIAIHLNDTHPVLSIPEMMRLLIDEHQFSWDDAFEVCCQVFSYTNHTLMSEALETWPVDMLGKILPRHLQIIFEINDYFLKTLQEQYPNDTDLLGRASIIDESNGRRVRMAWLAVVVSHKVNGVSELHSNLMVQSLFADFAKIFPGRFTNVTNGVTPRRWLAVANPSLSAVLDEHLGRNWRTDLSLLNELQQHCDFPMVNHAVHQAKLENKKRLAEYIAQQLNVVVNPKALFDVQIKRIHEYKRQLMNVLHVITRYNRIKADPDAKWVPRVNIFGGKAASAYYMAKHIIHLINDVAKVINNDPQIGDKLKVVFIPNYSVSLAQLIIPAADLSEQISLAGTEASGTSNMKFALNGALTIGTLDGANVEMLDHVGADNIFIFGNTAEEVEELRRQGYKPREYYEKDEELHQVLTQIGSGVFSPEDPGRYRDLVDSLINFGDHYQVLADYRSYVDCQDKVDELYELQEEWTAKAMLNIANMGYFSSDRTIKEYADHIWHIDPVRL

SEQ ID NO: 5684 - protein, 275 aa, Bifidobacterium longum NCC2705
MAIQSTIMLNNGTVIPQVGLGVFQTPDGDTTVNAVQTALENGYRHIDTAMIYHNEASVGEGIRRAGVPRSDFFLTTKLWNDDIRARRGKDAFQESLDRLGVDYVDLYLIHWPADGWQQAWDDLQEIYASGRAKAIGVSNFQKHHIDELLTHSDVVPAVDQVESSPQFTNQELIGQLRAKGIHTEAWSPLGGTGGNLLSNPVLAGIGAKYGRSAAQVVIRWHIQRGIVVLPKSTHAERIKQNFEVFDFNLSVDDMTAISAINTGKRNGADPDNFNF

SEQ ID NO: 5685 - protein, 82 aa, Arabidopsis thaliana
  misc_feature (9)..(9): Xaa can be any naturally occurring amino acid
  misc_feature (13)..(13): Xaa can be any naturally occurring amino acid
  misc_feature (15)..(15): Xaa can be any naturally occurring amino acid
  misc_feature (30)..(30): Xaa can be any naturally occurring amino acid
  misc_feature (53)..(53): Xaa can be any naturally occurring amino acid
  misc_feature (68)..(68): Xaa can be any naturally occurring amino acid
  misc_feature (72)..(72): Xaa can be any naturally occurring amino acid
  misc_feature (76)..(76): Xaa can be any naturally occurring amino acid
  misc_feature (79)..(79): Xaa can be any naturally occurring amino acid
  unsure (1)..(82): unsure at all Xaa locations
TDRATPEQXASYXLXLLRNRIPPAVPGIMXLSGGQSELEATLNLNAMNQAPNXWHVSFSYARALQNTXCLKXWGGXEGXVKV

SEQ ID NO: 5686 - protein, 447 aa, Yersinia pestis biovar Medievalis str. 91001
MYCCLRNICYVDRVLTGFIRYRQPHLKSENRVGDMAKVSLEKDRIKFLLVEGVHQSAVDNLRAAGYSNIEYHKGALDAESLKASIRDAHFIGIRSRTHLSEDVFAAAEKLVAVGCFCIGTNQVDLKAATKRGVPVFNAPFSNTRSVAEMVLGELLLMFRGIPSANAKAHRGEWNKLAVGSFEARGKKLGIIGYGHIGTQLGILAESIGMKVFFYDIENKLSLGNAQQVRQLSDLLNMSDVVSLHVPENHTTKNMIGAEQLAQMKPGALLINASRGTVVDIPALCDALSSNHLSGAAIDVFPEEPATNKDPFNSPLCEFDNVLLTPHIGGSTQEAQENIGDEVAGKLAKYSDNGSTLSAVNFPEVSLPAHGDNTRRLLHIHENRPGILTSINTIFAEQNVNIAAQYLQTSADIGYVVIDVETDDADNAEKALQAMKAIPGTIRARLLY

SEQ ID NO: 5687 - protein, 218 aa, Yersinia pestis biovar Medievalis str. 91001
MTQDELKKAVGWAALDYVKPGTIVGVGTGSTAAHFIDALGSIKHQIEGAVSSSDASTAKLKSYGIPVFDCNDVDVLDIYVDGADEINGQMQMIKGGGAALTREKIIAAIARKFICIADESKQVGVLGKFPLPVEVIPMARSYVARELIKLGGLPEYRQNVLTDNGNVILDVHNLSILDAIALENQINGIAGVVTVGLFANRGADVALIGTANGVKVIG

SEQ ID NO: 5688 - protein, 137 aa, Desulfotalea psychrophila LSv54
MEKTFAIIKPDAFAAGNAGKILARIYQEGFTVIGLKKLCMSQREAEGFYAVHNKKPFFAELTKFMSSGPCIVMVLEAEGCIGKWRDLMGATNPADAKPGSLRREFGTIVGENATHGSDAPETAAVELEYFFSGLELL

SEQ ID NO: 5689 - protein, 401 aa, Arabidopsis thaliana
MGFVDVVLNYNVKRTTCSIQLQNLGSTSNLKDVFNLAFFTFVFLICIYEAPTSLRTTCLKTVKDQLVTCRSRQGSKLLMVQLGSNLEEQWMRSLNLAITNWIIEIKAFQHLKSPSPLFSYAFSTQGLWKVHMYCPVVAMEMESVNSSLNDERLFFSLNYHQLEGVIQLNHRIYVREKWFNVAVNIDNVRCDIIRLVNEKLLSERGMGTEEKHFPSRISLQLTPTNQSNILMVSVQKSSENPLTEFEVEKGIEATIDPPNTFFGLKVSANETTTKSMKPWKFEEWVHGYSANLTWFLHDLDDGREVSSSKPSKVSMMNPRAWFKNRYSSAFRPFTKQGGVVFAGDSYGQSVLWKVDKTAIGKVMEFEVKGCVWLTYWPNKHHTFYSDTRKLEFKEMLYLNLP

SEQ ID NO: 5690 - protein, 215 aa, Xanthomonas campestris pv. campestris str. ATCC 33913
MSEAKRLAAEKAIDYVEDGMIVGVGTGSTVAYFIDALGRIGHRIKGAVSSSEQSTARLRQHGIEVLDLNHTGTLSLYVDGADECDPNRCLIKGGGAALTREKIIAEASERFICIVDPSKQVPVLGNFPLPVEVIPMARSLVARQILALTGGQPVWRDGVVTDNGNVVLDVHNLHITDPVALERNLNQIPGVVCVGLFARRPADVVIVGGETPRVL

SEQ ID NO: 5691 - protein, 256 aa, Streptococcus thermophilus CNRZ1066
MIIGFIGVGKMATAIINGLNKSSHRIIISGSSLARSRQIAEELEVEAAASHQELVENADLIILGIKPQMFDKVLTDLNFHQPIMSMAAGVTLERLASLTSADLPLIRIMPNLNAQILKSTTGLCTNDKVSEDLLVIAKEITDSFGTTVELAEKDFDTFTALAGSSPAYIALFIEALAKAGVKNGLSKQVALTIATQTVLATAENLSLGSDSPHDLIDKVCSPGGTTIAGLMDLERTGLTHSVASSIDTTIAKAKKL

SEQ ID NO: 5692 - protein, 550 aa, Salmonella enterica subsp. enterica serovar Paratyphi A str.
MTIPLWWQNGVIYQIYPKSFQDTTGSGTGDLRGVTQRLDYLQRLGVDAIWLTPFYISPQVDNGYDVANYTAIDPTYGTLDDFDELVAQAKARGIRIILDMVFNHTSTQHTWFREALNKESPYRQFYIWRDGTPDVCPNNWQSKFGGSAWRWHSQSEQYYLHLFAPEQADLNWENPAVRAELKKVCEFWADRGVDGLRLDVVNLIAKDQDFPDDPTGDGRRFYTDGPRAHTFLREMNRDVFTPRNLMTVGEMSSTTLENCQQYAALSGDELSMTFNFHHLKVDYPNGEKWTLAKPDYVALKALFRHWQQGMHNVAWNALFWCNHDQPRIVSRFGDEGEYRVPAAKMLAMALHGMQGTPYIYQGEEIGMTNPHFTRITDYRDVESHNMFAALRAAGRDPDELLAILASKSRDNSRTPMQWDNGKNAGFTQGEPWISLCDNYTEVNVAAALRDENSVFYTYQKLIALRKTQPVLIWGDYQDLLPDSPSVWCYRRQWQGQILLVVANLSNQCQEWHPPHIKGQWQALLHNYGEVASQPAAMTLRPFEAIWWLQR

SEQ ID NO: 5693 - protein, 561 aa, Synechococcus elongatus PCC 7942
MTLPEDFQFDAIADAIAEIKAGRSVVVVDDENRENEGDLICAAQFATPEMINFMAVEARGLICLAMTGDRLDQLDLPLMVDRNTDSNQTAFTVSIDAAPHLGVSTGISAEDRARTIQATINPLTKPHDLRRPGHIFPLRSREGGVLKRAGHTEAAVDLARMAGLYPAGVICEIQNPNGSMARLPDLIDYARQHRLKLISIADLISYRLQHERFVIRETIATLPSEFGQFTIFAYRNSLDGSEHVALVKGDPSRFSQQPVMVRVHSECLTGDAFGSLRCDCRMQLQAAMKMIENAGQGVIVYLRQEGRGIGLINKLKAYSLQDLGLDTVEANARLGFPADLRNYGVGAQILNDLGVTRIRLITNNPRKIAGLKGYGLEVVDRVPLLIEATPYNSSYLATKGEKLGHLLLKTHLAAIALHLTPELQNNPYRQTLIGQIRSLVQGEGLFLQEELRSVASALFGPQVLTLQVGLAQSEAIAADWYRSPDSPLADQLQHCLEQMAAIDGLEDLEFLLADGHDPLTSLQVQLDRQSLPLPDLSRQFKTLKLQQIYHLQLQERPSFVS

SEQ ID NO: 5694 - protein, 314 aa, Vibrio fischeri ES114
MLNNKIQWFPGHMHKARKEIEEVVPKIDVIIEVLDARIPFSSENPLISSIRKDKPCVKVLNKRDLSDPEVTQLWIEHLEKEQGVTAMAVTTENPEEIHKIMEVCRKLVPHREAMGKNVRTMIMGIPNVGKSTIINTLAGRTIAVTGNQPAVTRRQQRINLQNGVVLSDTPGILWPKVENPHSGFRLAATGAVKDTAMEYDEVAFYTVEYLAKQYPERLKERYKLDELPDNDLELMEAIGRSRGCLQAGGRINLYKASEILLHELRSGVLGQVTLELPEMITEELIQVEIDAARKEEEKAKKKEERRKRYLKNKR

SEQ ID NO: 5695 - protein, 375 aa, Nicotiana tabacum
MAHSALSQVSVAVPLQTDSSFRRSTFKATSITFSDRSSWISMPPIDLKAAPSRNQHIVCMSVQQASKAKVSVSPLSLEDAKEPPLNIYKPKEPYTATIVSVERLVGPKAPGETCHIVIDHDGNLPYWEGQSYGVIPPGENPKKPGNPHNVRLYLIASTRYGDSFDGKTASLCVRRAVYYDPETGKEDPSKNGVCSNFLCDSKPGDKVKITGPSGKIMLLPEEIPNATHIMIGTGTGVAPFRGYLRRMFMESVPTKFNGLAWLFLGVANTDSLLYDDEFTKYLNDYPGNFRYDRALSREQKNNKGGKMYVQDKIEEYSDEIFKLLDEGAHIYFCGLKGMMPGIQDTLKRVAERRGESWEQKLSQLKKNKQWHVEVY

SEQ ID NO: 5696 - protein, 543 aa, Debaryomyces hansenii CBS767
MSVLFTGSPDSIDSSKSPTYQQLSSGPEGGPIVIGRPSQLQELEEVPQGRHLGLFSTIVLFVSRIVGSGIFATSSGIYQDVGGSPFLFFLSWLLAAALSFSGLYVYLELGSLVPRSGGTKVFLEFIYGKPYMLACVVFLIYSVMFGFNMLNALVFGEYFLHSIGVKADEFHTRLAGLLCVYIAAAIHGISYNHGVKVQNIIGALKLLLLLIMVLTGIYLVLIPSSISHLNSNMHWDDFFKTKTSMSSSTFAGAIIKASFSFYGWNSAHTVSNEVKDPINTFRIAGPVSLIIVTVAYMFTNLAYIVVILHDEIINSGQLIGSLLFEKVFGHKVGKQLLTFSVALCAGGNIFVVLYTISRVSQEVFREGFLPCSRFMASNWPFGAPLPTLVLSCTLTTLVILAPKGDLYNYIIALEGYPNQIFLGLTAIGIFIIRKRSPELRAPIRASLIGTVFLLLITLYLTVSPFTSTRSPNPKGLENWPSYAVVAVMCLGICILYWVVMFKLLPYLWGYKLTSKEIELSDGLVVKKWIKVYGDISVDLDFID

SEQ ID NO: 5697 - protein, 273 aa, Glycine max
EKKRRGRLSVSRKSLSLDQFVVPQTVFALTDKPVCSFLGHLHDVLDLSWSKTQRLLSSSMDKTVRLWHLSSKSCLKIFSHSDYVTCIQFNPVDDRYFISGSLDAKVRIWSIPDRQVVDWTDLHEMVTAACYTPDGQGALVGSYKGSCHLYNTSENKLQQKSQINLQNKKKKSHHKKITGFQFAPGSSSEVLITSADSRIRVVDGVDLVHKFKGFRNATSPISASLTANGKYVVAASEDSHVFIWKNEADCRPNRSKGVTVTRSYEHFHCKDVS

SEQ ID NO: 5698 - protein, 534 aa, Arabidopsis thaliana
MGKKSGSSSSWLTAVKRAFRSPTKKEHNNNAHGNEVDEDEDKKKEKRRWLFRKSTNHDSPVKTSGVGKDAPAQKSTETTTIINPTVLSSVTEQRYDASTPPATVSAASETHPPSTTKELPNLTRRTYTAREDYAAVVIQTGFRGYLARRALRALKGLVKLQALVRGHNVRKQAKMTLRCMQALVRVQSRVLDQRKRLSHDGSRKSAFSDTQSVLESRYLQEISDRRSMSREGSSIAEDWDDRPHTIEEVKAMLQQRRDNALRRESNNSISQAFSHQVRRTRGSYSTGDEYEEERPKWLDRWMASKPWDKRASTDQRVPPVYKTVEIDTSQPYLTRGNSRTGASPSRSQRPSSPSRTSHHYQQHNFSSATPSPAKSRPIQIRSASPRIQRDDRSAYNYTSNTPSLRSNYSFTARSGYSVCTTTTTATNAALPNYMAITESAKARIRSQSAPRQRPSTPEKERISSARKRLSFPVPPLPQQMDGQSLRSPSFKSIGGSQLGALEQQSNYSSCCTESLGGGGEISPASTSDYRRWLR

SEQ ID NO: 5699 - protein, 361 aa, Ralstonia eutropha JMP134
MKAAVLHQPKSPLVIEDVAIGKPGPHEVLIRTAAVGVCHSDLHFLDGAYPHPMPAVLGHEAAGVVEQVGELVRTVRPGDHVITCLSAYCGHCEHCLTGHLSLCTEPDTRRGEDEPPRLTAHHGGPMNQFINLSAFAEQMLVHEHALVAIRRDMPLDRAALIGCAVTTGFGAVVHTARVQPGETVAVIGCGGIGLATINGAAIAGAGRIIAIDRVPGKLELARQFGATDVVQAGDDTVDAVRALTGGGVHHAFEAIGLKQTAEQAFAMLRRGGTATIIGMIAPGVKIELKGSDFLGEKKIQGSLMGSNRFPVDMPRMVDFYMAGRLKLDELISRRLPLEEINSAFDELRRGELARSVVVFGD

SEQ ID NO: 5700 - protein, 288 aa, Bacillus subtilis
MLFEKLKEAEGLLTSGTSGPSINRELLEHAPKLKVVSNQSVGYDNFDIEAMKERGVVGTHTPYTLDDTVADLAFSLILSSARRVAELDRFVRAGKWGTVEEEALFGIDVHHQTLGIIGMGRIGEQAARRAKFGFDMEVLYHNRHRKQETEDSIGVKYAELDTLLEQSDFILLITPLTDETYHMIGEREFKLMKNSAIFVNISRGKTVDEKALIRALQEGWIRGAGLDVYEKEPVTQDNPLLQLDNVTLLPHIGSATAKVRFNMCKQAAENMLAAIQGQTPKNLTREFQ

SEQ ID NO: 5701 - protein, 389 aa, Anabaena variabilis ATCC 29413
MKAVCWNGANDVRVETVPDPKIINPRDAVIKITTTAICGSDLHLYNGYVPTMEKGDILGHEMMGEVVEIGSAVKNLNIGDRVVVPFPIACGNCWYCQHDFWSLCDNSNPNAWLAEKFMGYSPSGIFGYSHMLGGYAGGQAEYARVPFADTGLFKIPDGLTDEQVVFLTDIFPTGYMAADNCNIQPGDIVAVWGCGPVAQFTIRSAYLLGAERVIAIDRIPERLQMAKDQGKAEILNYEEVNVSEALKEMTGGRGPDACIDAVGLEAHGTGLEGVYDEVKQAVRLETDRPHVLRQVMMDCRKGGHVSIPGVYVGVVDKIPMGAAMNKALVFKMGQTHVHKYLNTLLDHIQNGRIDPSFVITHRLPLDEAPRGYGIFKDKKENCIKVVLKP

SEQ ID NO: 5702 - protein, 429 aa, Xanthomonas campestris pv. campestris str. ATCC 33913
MNHSRSHALFSQAQNLMPGGVNSPVRAFKSVGGEPFFVARADGAYLFDVDGNRYIDYVGSWGPMIAGHNHPAVREAVERAIRDGLSFGAPCEAEVTMAETITRLVPSCEMVRMVNSGTEATLSAIRLARGATGRNRIVKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGGRDLMEQISPAGPIYQAGTLSGNPVAMAAGLAMLQLVQEPGFHARLSETTSLLCEGLEDAARAAGVAVTTNQVGGMFGLFFTDQIVENYAQATACDVTTFNRFFHAMLQQGVYLAPSAYEAGFVSSAHDEAVIEATLAAAREAFADVMR

SEQ ID NO: 5703 - protein, 263 aa, Prunus ilicifolia
AHYKTEVDVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTLPSKTWGLDVYA

SEQ ID NO: 5704 - protein, 250 aa, Prunus andersonii
LKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 5705 - protein, 253 aa, Triticum aestivum
  misc_feature (88)..(88): Xaa can be any naturally occurring amino acid
  misc_feature (217)..(217): Xaa can be any naturally occurring amino acid
  unsure (1)..(253): unsure at all Xaa locations
MGRKFFVGGNWKCNGTVEQVESIVNTLNAGQIASTDVVEVVVSPPYVFLPTVKAKLRPEIQVAAQNCWVKKGGAFTGEVSAEMLVNLXVPWVILGHSERRSLMGESSEFVGEKVAYALAQGLKVIACVGETLEQREAGSTMAVVAEQTKAIADKIKDWTNVVVAYEPVWAIGTGKVATPAQAQEVHANLRDWLKTNVSPEVAESTRIIYGGSVTGAXCKELAAQPDVDGFLVGGASLKPEFIDIINAATVKSA

SEQ ID NO: 5706 - protein, 150 aa, Glycine max
  misc_feature (53)..(53): Xaa can be any naturally occurring amino acid
  misc_feature (120)..(120): Xaa can be any naturally occurring amino acid
  unsure (1)..(150): unsure at all Xaa locations
HGHWWKDQEGRRRRKGGGQKKKPVSRSVKAGLQFPVGRIGRYLKKGRGAQRVXGTGAPVYLAAVLEYLAAEVLELAGNAARDNKKNRIIPRHVLLAVRNDEELGKLLAGVTIAHGGVLPXINPVLLPKKTERASKEPKSPSKATKSPKKS

SEQ ID NO: 5707 - protein, 249 aa, uncultured marine gamma proteobacterium EBAC31A08
MKLNTLNKIKILKNIDVDRINIAMYNTIGSTNDKCKTLEQSNDFNIVLAEEQTKGKGRMGKEWSSPLGNIYMSIAFSGSKSNEPLSLISGLICQEAINKVIGEDSIVLKWPNDIILNKKKVGGILIEKEVLGSDVTNIVGIGLNLKLVKKESWWGDLSEYQHIDRNELINTILIKFISYCDKGIDNWKEKWETSCMHLNSNIKIQSNNIKINEGMCIGITNRGALRISSNKDGKICEYEYGDISIKGVY

SEQ ID NO: 5708 - protein, 409 aa, Trifolium pratense
MGVCLSAQIKAESPYNTGLNSKNSNSAGNDLSSTNSKVSTGSVPQTPRSEGEILKSTNVKSYTLAELKSATRNFRPDSVLGEGGFGSVFKGWIDENSLAPAKPGTGIVIAVKRLNQESFQGHREWLAEVNYLGQFSHPHLVRLIGYCLEDEHRLLVYEFMPRGSLENHLFRRGSYFQPLSWSLRLKVALDAAKGLAFLHSSETKVIYRDFKTSNILLDSDYNAKLSDFGLAKDGPTGDKSHVSTRVMGTYGYAAPEYLATGHLTTKSDVYSYGVVLLEMLSGKRAVDKNRPSGQHSLVEWAKPYLANKRKVFSVLDSRLEGQYSSDESYRVATLALRCLSTESKYRPNMDEVVRILEQLKVPNVNVGNQRRYRRKSADDVTHARTHKKSCASARAHTSYPRPSASPLYA

SEQ ID NO: 5709 - protein, 453 aa, Aquifex aeolicus VF5
MKILILSGGKGTRLWPLSRENFPKQFIRLFSKHSLFQETVKRAKKLAKDEDIVVITGEKYEWIIRSELEEIDANEVRVVVEPEGRNTAPAIALGVKYLIHSETPPSETVLVLPSDHLIKDTEKFVEAVKKGEKYAKEGYIVLFGEKPTYPETGYGYIRLNGKLEEGVYEIEKFEEKPDYEKAKEYVSDGKHFWNCGIFLFTLDRIVKDYTQLMPEIPFHEKWEDFIKDFKNFEEISFDYAILERTKKLAVVKMDAGWSDVGSWKAVYDNLPKDEKRNVLIGDVKAMDTECSLLLSQGKNLIACIGLEDFVVVGTEDATLIVKRDYSQKVKEIVKELEEENDERAIEHVTSFTPFGSITKLDRGERYKIRKVVVKKDKEIPLRMHHHRTVHFVVLKGTAKVKVGDKEEFVHENESFFVPKSTPYKIINVGKIPLEMIEVQSGEYLGEDDVETLE

SEQ ID NO: 5710 - protein, 336 aa, Trichodesmium erythraeum IMS101
MTAVNTQKLDVYGVGNALVDILALVEEDFITKFSLQKSGMTLMDAQKQGGILAGLKDISLKKRSGGSAANSMIALAQSGGTGIFVAKVASDPNGELYRQDMLNFKMDFNVPPAPTADNPTGTCVVLTTPDAERTMCTNLGVSVNLSVSDIDVEQIKRCKYSYVEGYLWTGDSTKEACKQAMQYSKDEKVKVCFTFSDQFLVDMFADEFRSLLLDYCDVLFCNADEARSFCKKDSLDDSAKSIGELVETAFITNGKEGCLVVKDKQITSVPGFNATAIDTVGAGDAFAGGVLYGLTHGYEPTQAARWGNYLASNVVQIQGPRLEGSWADKVQQIINA

SEQ ID NO: 5711 - protein, 898 aa, Candida albicans SC5314
MDYLTPSTLPHPKLKRTNTGFTPNQIIALDAAIPESAKHIWYKYSQLKILDSHKRNGPEDEDNVKSVVDDPDRFEEEFVKHVETSLGRSMYNCDNLAAYQAASNTIRDALVIDWANTQQRQTIQDGKRVYYLSLEFLMGRAMDNALINLNSEQNTQKSLSDLGFNLEDVLDQEPDAALGNGGLGRLAACFVDSLSSKNYSGWGYGLNYQYGIFKQKIIDGYQIETPDYWLNYSNPWVIDRNEIQIPVDFYGYVYEEHDPNTGKVKKNWNGGERVLAVAADFPIPGFNTTNTNNLRLWNAKPTTEFDFSKFNAGDYQQSVAAQQRAESITSVLYPNDNFEKGKELRLKQQYFWVAASLHDIVRRFKKNHKSNWQKFPDQVAIQLNDTHPTLAVVELQRILVDLEGLDWDEAWSIVTKVFAYTNHTVMAEALEKWPVDLVGRLLPRHLEIIYDINYFFLKNVEHRYPNDRDLLRRVSIIEESPKSVRMAYLAIVGSHKVNGVAELHSELIKTTIFKDFVKVFGPDKFTNVTNGITPRRWLRQANPKLAALIAEKLEDPNYDYLTNLGKLKKLEAFVDDYEFLKRWDAIKFDNKRRLATLIKETTDVDVDPTVLFDVQVKRIHEYKRQQLNIFAVIYRYLHIKELLSKGVSIEEIKTKHHIPKASIFGGKAAPGYYMAKTIIHLINKVGDVINNDPEIGNLLKVVFIPDYNVSKAEIICPGSDLSNHISTAGTEASGTSNMKFALNGGLIIGTVDGANVEITREIGEENIFLFGNLAESVEEIRHRHVYEGVKVPESLQKVFHAIESGDFGSPEEFKPLIESIRDHGDYYLVTDDFDLFLEAHKKLEKVYGHHGGDEHDKSHMNEWVKKSVLSVANMGFFSSDRCIDEYAENIWNVEPSNV

SEQ ID NO: 5712 - protein, 446 aa, Rhodococcus sp. RHA1
MECDAWNAPAVIGCDAKRGGVPTFWCCFQFRALSRLPQRHDSFGRSHVIACGRRAGIHRETQHQGVEMKALVYDGPREVHVKDMPDARIEQPTDVLVKITSTNICGSDLHMYEGRTDLEPGMVLGHENLGIVAEVGNAVVKVSPGDRVCLPFNIGCGFCRNCEEGLTAFCLTVHPDPKMAGAAYGFAGMGPFWGGQAEYLRVPFGDFNCLRLPEDAQDKETDYVMLSDIFPTGWHCTRLADMQPGDSMVVYGAGPVGLMAAYSAMIQGASKVMIVDRHPDRLKLAEQIGVIPIDDSKGDPVEQVLEQTRGQGADKGCECVGYQAHDPQGHEDAAMTMNRLVDSVRFTGHIGVVGIFLPQDRNGPDELERHGKIAFDMGKFWFKGQKVGTGQANVKHYNRQLRDLIHQGRAKPSWIVSHELPLAEAESGYQHFDARDDGWTKVVLHP

SEQ ID NO: 5713 - protein, 206 aa, Mesorhizobium sp. BNC1
MSGTLILVRHGQSEWNLKNLFTGWRDPGLSELGHEEATSAGRKIKDRGLRPDIAFTSVLSRAKVTNTHILEVLGLPALETIEDVALNERDYGDLSGLNKDDARKKWGEEQVHIWRRSYDIPPPGGESLRDTGARVWPYYLREILPQVLRGKTVLVSAHGNSLRSLAMVLDGLSGEEIVKMEIATGVPIVYRLNPDSTVASKEILEG

SEQ ID NO: 5714 - protein, 280 aa, Thermobifida fusca YX
MSSHTPAPALYGGSANRRVTVQDLAAAKERGERWPMLTAYDALTARIFDEAGIPVLLVGDSAAMVVFGYDSTIPVTLDDMIPLTAAVSRATKRALVVADLPFGSYQAGPEQALESAARLMKEGGAQAVKLEGGHRVIAQVEALVSAGIPVMGHIGLTPQSVNVLGGYRVQGRSEEAAEALLSDAKELERAGVFSVVLECVPARVGAEITRQLTVPTIGIGAGPDTDAQVLVWQDMAGLSPRVAKFVKSYANLAEQLRDAATSFAEEVVAGTFPDEQHSYA

SEQ ID NO: 5715 - protein, 513 aa, Thiobacillus denitrificans ATCC 25259
MKALPVLLIILDGFGCRDERANNAIAQANKPNWDRLWKHHPHTLIHASESEVGLPKGQMGNSEVGHLNIGAGRVVYQEFTRIDRAIESGYFYTNPALLNAVHLARDNGKTLHVLGLLSDGGVHSHELHFHALLDLAAREGLSKVCLHVFLDGRDTPPKSAELYLRRLTDKIAQAGVGHVASMIGRYFAMDRDRRWQRVKSAYDLLTQGAAEFSAGSAQAGLEAAYARGETDEFVKATAIVPADGRPVTMEDGDSVIFLNFRSDRARQLSRPFIEPDFSEFERERTPRLATYCTLTGYSDDFDVSVAFPPERIKNGLGEYVANLGLRQLRIAETEKYPHVTFFFNGGEEVSFPGEDRILVSSPDVATYDLKPEMSAFEVTEKLLAAIGSKQYDLIVCNYANPDMVGHTGNLEAAIKAIETVDTCLGRVVEAQLARGGEVLITADHGNAELMLDAETGQAHTAHTMNLVPVIFVGRRHASLAETGALEDVSPTLLRMMGLPQPPEMSGESLLAFE

SEQ ID NO: 5716 - protein, 453 aa, Thermobifida fusca YX
MNRQQEFVLRTLEERDIRFVRLWFTDVLGYLKSVAVAPAELEAAFTEGIGFDGSAIEGFARVYESDMLAQPDPTTFQVLPWRNEPHGAARMFCNILLPDGSPSYADPRNVLKRQLSRASDLGFTFYTHPEIEFYLLKKKPERGELPEPSDEGGYFDHTPHSLARDFRRNAIMMLEEMGISVEFSHHEGGPGQQEIDLRYADALTTADNIMTFRMVMKEVAIEQGVYATFMPKPFTEHPGSGMHTHMSLFEGDRNAFYEAGAEYQLSKIGRGFIAGLLRHAAEITAVCNQFVNSYKRLWGNAAASAGAGGEAPAYICWGHNNRSALVRVPMYKPRKSNSARIEFRALDSACNPYLAFTVILAAGLKGIEEGYELPPGASDDVWALTDAERRALGIMPLPQSLDEALRVMERSELVAEALGEHVFDFFLRNKKAEWEDYRRQVTPYELERYLPTL

SEQ ID NO: 5717 - protein, 470 aa, Lactobacillus casei subsp. casei ATCC 393
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 5718 - protein, 502 aa, Thermococcus kodakarensis KOD1
MFHQAKWDEPTIFELSRPGRIGYTLPKPIEDVDVDIPEKLRRKSPLNLPELSEPEVVKHYTRLSEMNYGVDSGIYPLGSCTMKYNPKINEEIASHPGVAYVHPYQDEGTVQGALKIMWELEQWLKEITGMDRFTLQPAAGANGEFTGVSIIRAYHIDRGETQRTEMLVPDSAHGTNPASAAMAGFKVIEIPSNENGTVDLEALENAVSERTAGLMLTNPNTLGIFEDEILEIAKIVHKAGGLLYYDGANLNAVLGKIRPGDMGFDVVHLNLHKTFSTPHGGGGPGSGPVGVKDFLKDYLPVPLVSYDAENDRYYLDYNVPRSIGKVKELYGNFAVIVRALTYLKIMGREGLKEVSEVAVLNANYLTQKLKGTRGYELPGKELRKHETVFSAEPMKKETGVKALDVAKRLLDFCMHAPTIYFPLIVHEALMIEPTETVSKEELDAYVEALKRISEEAYSNPEVVTSAPHNTAVRRVDDVLAAKKPVITWRMYRELKERGEIDY

SEQ ID NO: 5719 - protein, 451 aa, Thermococcus kodakarensis KOD1
MGKHYIPNSAHKDEMLKEIGFSSIEDLFSDVPKGMVKEFNLPEGKSEYEVFTELNETLSKNKTVLEMPSFLGAGTYFHYVPAHVKYLIERSEFLTAYTPYQPEISQGMLQALFEYQSLIAELVGLPIVNSSMYDWGTAMAEAALMSARVTKRNKFVVPKHLSPEKKLVLKTYTAGPGLETVEVPWDERGQMDIEKLKEAVEGAAGVYIEMPNFFGLLEENIREIGEIAHDAGALFVVGVDPTILGIVEAPGELGADIVVGEAAYFGNPMNFGGPRAGIFAVRNDRKLIRQMPGRIIGMTKDADGKRAFVMTLQTREQHIRRAKATSNICSNEALVAVAAAIHLATLGPKGVRELGEVILKNTAYLKKRLAEVGEIVFDGVNFKDVPVRFEVPYSVIHERLLERNIHGGYYIGKHFQELGETALFAATETTRKEWVDGLVDALREIIGEAEL

SEQ ID NO: 5720 - protein, 251 aa, Prunus andersonii
AHYKSEADVGNAIAEAIQRGLVKREELFITSKASNHGHVVEACKNSLKKLQLDYLDLYLVHYPLATKHSVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 5721 - protein, 384 aa, Leptospira interrogans serovar Copenhageni str. Fiocruz L1-130
MFQKDGFNVRLLPAAFSEKELLDEIENIHVLGIRSKTNVTSAVLEKAKRLLTIGCFCIGTNQVDLVGAEKKGIPVFNAPYSNTRSVAELVISEIIMLARRVPDHIRNTHSGIWNKISKNCFEVRGKTIGIVGYGHIGSQVSVLAEAMGMKVIYYDIQTVLPLGNATPVSSYEELLKNSDFISFHVPETPQTMNLYGKKEIEVTKKGAYMINLSRGKVVDLEALAKAIQSGHIAGAGIDVFPEEPESNNDPFLTPMQNLPNVILTPHIGGSTEEAQRNIGSEVASKLLKFINNGSTTFSVNFPNLEITPLPAGQYRILNVHKNQPGFLKDINSMVSAIGANISSQHLGTSAEIGYLSMVIDKSVGDELKEKIEKHPFSIKTRILY

SEQ ID NO: 5722 - protein, 485 aa, Mesorhizobium loti MAFF303099
MLQKTSHFMRQANLINGEWVQADSGQTVDVNNPATGLKIGTVPKSGKAETRRAIEAADAAFKTWRKTTALERSKLLRKLHDAMMDNQDVLAELLTIEQGKSLFESKGEIGSAAAYILWFAEEGRRTYGDVVPSPWADRRILVTKEPVGVIAAITPWNFPSSMLARKLGPALAAGCTAVVKPASQTPYSGLAWGALAEEVGFPKGVVNILTGSASEIGDEICANPLVSKITFTGSTEVGKLLIQKSSVTVKKVSMELGGNAPFIVFDDADIERAVAGAITAKYRNSGQTCVCTNRFLVQAGVYDKFVEKLAAASNGLKVGSGLEEGVQQGPLIDEKAVEKVEELIADATSKGGKIVAGGKRHALGGSFFQPTVIANATPKMRFMKEEIFGPVAPVFKFETEAEAIALANDTEFGLACYFYTGDLGRAFRVMEGLKYGMVGVNEGLITTPEAPFGGVKESGLGKEGGHQGIEDYLDTKYVCIGGLGL

SEQ ID NO: 5723 - protein, 252 aa, Prunus mexicana
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 5724 - protein, 251 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTTDKKSRPL

SEQ ID NO: 5725 - protein, 252 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTIDKKSRTTL

SEQ ID NO: 5726 - protein, 408 aa, Pseudomonas syringae pv. phaseolicola 1448A
MKHLIGGISSGGRALPEIDGQAFNVARSNGPWLWDSKGVRYVDTAMGFGATMLGHAQMEVMAAASAAMLNGPMPSFAHADEEAAAAALATFTGDLSQVIFLNTGSEAVHLACRTARVATGRQRIVKFAAGYDGWYDSVAFGNAGQASALMSGTTRPERDGMLLLRYNDFEDAEQLFRDYSDIAALVVEPVLANAGCIEPAPGYLKHLSDLAHRNGALVILDEVLMGLRLCPGLTGTLLGAEPDLATVGKAIGSGIPVAALVGKPEYMRLFEQGKIVRAGTYSGAPPACAAVLATLKQLATANYAALLTRGDQLRAQLVAAFASKGMAVSSTGYGSVFTLWPSATPPRTYADAAHVADSEWTLALHKALRRERVMSMPFAFGRTYLTFAHQEKALQAVLEGYKAAIASL

SEQ ID NO: 5727 - protein, 252 aa, Prunus subcordata
AHYKSEADVGNAIAEAIHSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDIELINTIDKKSRTTL

SEQ ID NO: 5728 - protein, 369 aa, Dechloromonas aromatica RCB
MPPHPAIASTAEIVTELKAGRMVILVDEEDRENEGDLVMAAEHITPEAINFMAKFGRGLVCLTLTEARCKKLGLTQMARNNGTVYGTAFTVSIEAAEGVTTGISAADRARTIQVAVNKASTADDIVQPGHVFPITAREGGVLVRAGHTEAGCDLAGMAGLEPSSVICEIMNDDGTMARLPELIEFAKEHGLKIGTIADLIHYRASSETLVERVTSKTVSTAHGDFTLHAYVDRASGATHLAMVKGSLPAGGETLVRVHEPLSVLDFLDPASKRQAFSIDQAQAALAKHGHGVIVLMHRPEDGAALLSRLTGTAPTAPAKWDPRSYGIGAQILRDLGVTKMRLLSSPRKMPSMTGFELEVTGFVTSPAEL

SEQ ID NO: 5729 - protein, 148 aa, Bacillus cereus ATCC 14579
MEKTFLMVKPDGVQRAFIGEIVARFEKKGFQLVGAKLMQVTPEIAGQHYAEHKEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 5730 - protein, 281 aa, Eremothecium gossypii
RVAPEEHPVLLTEAPMNPKSNREKMTQIMFETFNVPAFYVSIQAVLSLYSSGRTTGIVLDSGDGVTHVVPIYAGFSLPHAILRIDLAGRDMTDYLMKILSERGYSFSTTAEREIVRDIKEKLCYVALDFEQEMQTAAQSSAIEKSYELPDGQVITIGNERFRAPEALFHPSVLGLEAAGIDQTTYNSIMKCDVDVRKELYGNIVMSGGTTMFPGIAERMQKEITALAPSSMKVKIIAPPERKYSVWIGGSILASLTTFQQMWISKQEYDESGPSIVHHKCF

SEQ ID NO: 5731 - protein, 483 aa, Rhodococcus sp. RHA1
MTENVLLPGAESPGDTAEGTSVPVRIAVVAALGGLLFGYDSAVINGAVSAIEGKFQVDSALLGFAIASALLGAAAGAMLAGRIADRYGRLVTMRAAAVMFLLSAIGTGFAANVEMLVTFRIVGGIGVGLASVIAPAYIAEISPARVRGRLGSLQQLAIVTGIFVSLLVDYALAAIAGGSQEELWFGLEAWRWMFLAMCVPALAYGLLSLTIPESPRYLIAQGRLGEARGILAVLLGEKGLDLKIESIRSTLARETQPSIRDLKGSAFGLMPIVWIGIGLSVFQQFVGINVIFYYSSVLWQAVGFDEGSSLQITVITSVVNIATTLIAIAYIDRVGRRPLLIIGSAGMAVTLATMAFIFGTASTTVVDGVTTPQLTGLQGPIALVAANLFVVAFGMSWGPVVWVLLGEAFPNRIRAAALSLAAGAQWAANWLITVTFPSMKDFSLGISYGFYAVCAVLSLVFVLRWVKETKGVELEAMHSDSVA

SEQ ID NO: 5732 - protein, 422 aa, Sulfolobus tokodaii str. 7
MEYSIKILGGGKEVGRAAIEVTTSSESIILDYGVNFDANDNPNLPLQEVPSRVKGFIVSHSHLDHVGALPLYQISGNFPIFGTRLTRLITELMLKDFLKLSGAKVPFEWTEVRKVMDNFRSVKYHEEFEVGTFKTELGDAGHIPGSSMIKIKTEKGNIVYTGDTNVINTHLVKPAELEFLRDANVLIIESTYGRFNHPERKVVEDEFFESVKEVVEGGGTVLVPAFSLSRSQEILSVLSSKNFDYPVYYDGMVKEITELMIQNPEFINDYESLKKAYNYFKYVNGWNDRNKATRNEGVIVSSAGMLKGGPAVYYFKKIADNPKNAVFLVSYQAENTPGRRLLETGKFDEYSPMLKARFQIFDFSSHAGKNQLKDMIKSAKNLEKVILVHGSPDSSSVLAEELKRELGVEVIVAENGQEIKVF

SEQ ID NO: 5733 - protein, 458 aa, Methanosarcina barkeri str. fusaro
MTGIKSIILAGGSGTRLWPLSREMYPKQFLKFGNTSLFQETVLRCLEISDISEIFVVTNEAQKFFVIGQIEEIGYSLPTENVLIEPEGKNTLPAIFFGMKEIEKKYGRSVVGIFSSDHVLDRVAMQTIASAEDLASDYLVTFGVVPVFPHTGYGYIKPSEACVPGYRVSEFREKPDRETAEKYIKEGCLWNSGMFLFDTELFFDEVKKYAPSVFTCFENGKDINEIYACVDKISIDYGIMEKSERVAVVKLEQKWSDLGNFAAIYDEFEKDPVGNVVHECDPIMLNSDGNLVYSSCGKLVSLIDIKDMVIVDTSDALLVCPKSSSQKVKDIVSALKERNDERAYIGQTVYRPWGSYTLLEASPEHKIKNITVLPDHKLSLQLHYHRSEHWVVVKGMACVEVRGQQFFLRPGESTFISAGEKHRLSNPGKIPLEIIEVQLGELVDEADIVRFDDVYGRS

SEQ ID NO: 5734 - protein, 474 aa, Thermobifida fusca YX
MFSNADEALAYIRTEGVQFVDVRFTDLFGGVHHVTLPAEKVDEDFLTNGQMFDGSSIRGFQAIHESDMLLLPDLSTAVLDPFREYKTLNITFFVHDPLTRESYSRDPRNVARKAEAYLKSTGIADTAYFGPEAEFYIFDDVQFATAPNTGFYAIDSVEGAWNTGSKREGGNLGYRPRYKGGYFPVEPSDHYSDLRSRMVRTMIEVGLPVELHHHEVGTAGQSEIGIKFGTLLQQADRVQLYKYIVKNVANAAGKTVTFMPKPLFGDNGSGMHCHQSLWKDGAPLFFDENGYAQLSDIARYYIGGLLKHAPSLLAFTNPTINSYHRLVPGYEAPINLVYSQRNRSACIRIPLTGSDPKAKRLEFRVPDPSANPYLAFSAMLMAGIDGIQNKIEPPEPLDKDLYELPPEEAAEIEKVPASLEEALDHLEEDHEYLVEGGVFTEDLIETYINYKRTVEIDSVRLRPHPREFELYYDV

SEQ ID NO: 5735 - protein, 150 aa, Zea mays
MLSEQAFIMINPDGVQRGLIGEVISRFEKKGFYLTGLKIQSVDQSFLEQQYADMSSQPFPGLVEYIVLVLVVAMVWEGKSVVSTGRKIIDSDNTVSCERVAIRGDFSVVIGRNVIHGSESFASARNEIALCFPSVIAEWRSIHLTRMYEP

SEQ ID NO: 5736 - protein, 444 aa, Burkholderia thailandensis E264
MQDIDEFLKKHRITEIEAIIPDMAGIARGKIIPRSKFETGESMRLPQAVMIQTVTGDYPEDGSLTGVTDPDMVCLPDASTIRLIPWAIDPTAQVIHDCVHFDGTPVEISPRRVLRRVLELYKAKGWKPVIAPELEFYLVDMNKDPDLPLAPPIGRTGRPETGRQSYSIEAVNEFDPLFEDIYEYCEVQDLEVDTLIHEVGAAQMEINFLHGDPLNLADRVFLFKRTVREAALRHHMYATFMAKPMENEPGSAMHVHQSIVDEETGRNLFTSNDGGPTDMFYAYIAGLQKYTPALMPIFAPYINSYRRLSRFMAAPINVQWGYDNRTVGFRIPHSSSASRRVENRIPGVDCNPYLAIAATLAAGYVGMTQRLVPTEPLVSDGYSLPYQLPRNLEEGLTLMAACEPIAQILGEKFVTAYLALKETEYEAFFRVISSWERKHLLLHV

SEQ ID NO: 5737 - protein, 229 aa, Glycine max
MGEKEKRNKNKKQKHQHPNDQSTKQNSDFSFKPSSEVKGIKFGGQFIVKSFTIRRARPLELLKVLSFPPTNNTNKPKDKLPFPSTTAFLPTNFTILAHHAWHTLTLGLGTKKSKVLLFVFETEAMKASVDRIWPPEIALGDVNKRLIRGLNGCEMARFKFRKGCITFYVYAVRQVGSFGFSCAEDLRTILQSVVELKDFLDHTVMLSMPNQRSISYSQSQSQPQVAMAH

SEQ ID NO: 5738 - protein, 260 aa, Prochlorococcus marinus str. MIT 9313
MPGCGLGGMRTSDSWTGAAAVARLWRRQSCGARPWQLRWQPVCASTELMLSGWLKQQPCSAQQPRALFADRQTHGRGQRGRVWQSPIGGVWISAALPWFDAQCSAGIFGIAVAVALAERLERRGVPVSIKWPNDLMVGNRKLAGLLPRLVHRGNRVRLARIGLGLNVCNRVPREGIALDELLRSGQCQPLVWMAEVLCALDRTMDLAGRADWVCAEAERRLWTKQVRDPKGGELWDVIGLGLDGSLLLSQGSRTMRWTRW

SEQ ID NO: 5739 - protein, 252 aa, Prunus pumila var. besseyi
AHYKSEADVGNAIAEAIQSGLVKREELFITSKASNHGHVVEACKNSLKKLQLDYLDLYLVHYPLATKHSGVGTTASLLGENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKGNLEILNFKLEKEDIELINSIDKKSRTTL

SEQ ID NO: 5740 - protein, 252 aa, Prunus salicina
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 5741 - protein, 252 aa, Prunus armeniaca
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYKRSVAQIALRWNLERGTPVIPKSSKVERLKENLEILNFKLEKEDIELINTIDKKSRTTL

SEQ ID NO: 5742 - protein, 434 aa, Acidovorax sp. JS42
MHNDPLSCPAARAAWVFSSPLNLHAMAKTSLDKSKIKFLLLEGIHPSAVEVLRSAGYTQVEVLAGALEGEELRRKIADVHFIGIRSRTQLTADVFAHAHKLVAVGCFCIGTNQVDLNAARERGIAVFNAPYSNTRSVAELVLAEAILLLRGVPEKNAAAHRGGWLKSATNAYEIRGKTLGIVGYGSIGTQLSVLAEALGMHVIFHDVVHKLPLGNARQVGSLHELLGQADIVTLHVPELPSTQWMIGAAEIAAMKPGGILINASRGTVVEIDPLAQALKGGNLLGAAVDVFPVEPKSNKDEFVSPLRGLDNALLTPHIGGSTMEAQANIGLEVAEKLVRYSDNGTSTSSVNFPEVALPEHAGKHRLLHVHHNVPGVLSQINSILSDNHINIAAQYLQTNEKIGYVVIDLDARSSDLALEKLAQVPGTIRSRVLY

SEQ ID NO: 5743 - protein, 484 aa, Dechloromonas aromatica RCB
MNLQNTELLRSTNLIGGIWARADDGAQLAVINPATGEKLADVPLCGATETRRAIDAANAAWPAWRALTARRRSQLLQAWFSLIIKNADDLAQLVTAECGKPLQEAKGEVIYGASFVEWFAEEGKRTYGESIPSPAANTRLLVIKQPIGVCAAITPWNFPLAMITRKVAPALAAGCPVVVKPAEATPLTALALAVLAEQAGFPAGVFNVVTGKPAEIGGELCANPIVRKLSFTGSTGVGRLLMAQCAPTIKKLSLELGGNAPFIVFDDADVNAAVDGAIAAKYRNTGQTCVCANRFLIQAGIYDEFAAKFAEKASALKVGAGIEADVAQGPLINAAGLSKVEAHVADAVGKGARVLCGGARHERGGNFFQPTVLADVTTAMMVAREETFGPVAPLFRFETEEQAIAMANDTEFGLAAYFFTRNVGRCWRVGEALEYGMVGINTGMISNEVSPFGGIKQSGLGREGSKYGIEDYLEIKYLCFDVNT

SEQ ID NO: 5744 - protein, 321 aa, Xanthomonas campestris pv. campestris str. ATCC 33913
MDDRALLAKLATGRLSGDTLAREAGLTRAAVWKRIQNLRAAGVAIDGQAGEGYQLAAPLDLLDAQRIRAALQADAAAGLAALELAWTVDSTNTSLLARPAPEQGVAVLLAERQTGGRGRRGRQWASPLGAHLYLSASRRFSGGLGQLAGLSLAVGVAVAEALRGCGFNEVGLKWPNDLLARGRKLGGLLIEGGGEMAGNARAVIGLGLNVHMPPAAAASIDQPWVDLDTLAGRPVSRDQMVAAVLSGLIPALALFEAQGLAPFLSRYAALDLLSGRAVQVEEAGSLHRGTALGLAADGALRVQIGSDVRLFHSGEVSVRPA

SEQ ID NO: 5745 - protein, 117 aa, Streptococcus thermophilus CNRZ1066
MPYLSELGVDMVWLNPFYPSPQRDNGYDISDYTAVNSVFGDMADFEEMVRVGKEHKIDFMLDMVLYHCSTEHEWFQKALAGDKYYQDLYFIQDQTTDWLSKFGGSAWAPFWGYGEIL

SEQ ID NO: 5746 - protein, 458 aa, Trifolium pratense
MDQQNKQSFQNPKHIIFDKYEMGKVLGQGNFAKVYHCRSLSTNESVATKVIKKEKLRKERLVKQIKREVSVMRLVRHPHIVDLKEVMATKGKIFLVMEYVKGGELFAKVAKGKLKEDVARKYFQQLISAVDFCHSRGVTHRDLKPENLLLDENEDLKVSDFGLSALPEQHREDGMLLTPCGTPAYVAPEVLKKKGYDGSKADLWSCGVILYALVCGYLPFQGENVMRIYKKAFKGEYEFPEWISPQAKILISNLLVADPKKRYSIVDIMNDPWFRIGFVRPIAFSMNGSSIEDNDKDINIDFNEVGEDNVDVPELIMVKPSRPFYNAFEIISSLSHGFDLRNLFETRKKLPSMFISKFSASTVLEKLEVMAKKLNFRMTGKKEFVVRFEGTKDGRKGKVAVTMEVFGVAPDVAVVEFSKCGGDTLEYVKLCDEQLRPSLKDIVWSWQGDDNHNDNNSQ

SEQ ID NO: 5747 - protein, 253 aa, Debaryomyces hansenii CBS767
MAVHKLIILRHGESEWNHENRFCGWIDIPLSEKGRDEAKFAGHLIQKYNLKPTITYTSKLTRSIQTGDIILEELGRLWCDVVKTWRLNERHYGAFQGRDKNEVYRELGAEKYQYIRRNYNGTPPPMETQYKDDCIDERYEVDDVDIADLPRGESLKLVMERVIPYLRKEIVEGSLIGDNKTVLVVTHGSIVRSVIKYFKGVSDADISKINVPTGVPMVFELDDDCNMVKDYYYLDPELAKKGIEKVSNEGTKK

SEQ ID NO: 5748 - protein, 209 aa, Triticum aestivum
  misc_feature (153)..(153): Xaa can be any naturally occurring amino acid
  misc_feature (169)..(169): Xaa can be any naturally occurring amino acid
  misc_feature (177)..(177): Xaa can be any naturally occurring amino acid
  unsure (1)..(209): unsure at all Xaa locations
RMQYHYFGDAITFDTTYRTNLYDIPFRLFVGVNNHFQSIIFGGVLVRDETSETFEWVFNEFIRMMGGKHPQTILTDQCWAMELAIEKTMPETTHRWCKWHILKKAKEKLGTYYTKRSNFRAEFHKIVNHMLTEDEFENAWRELLDKYSLQKTXYMASIYEVRQKWAKPXFWGKFCAXMTSTQRSESANHMLKGYVPASCPMHLFVRQYM

SEQ ID NO: 5749 - protein, 461 aa, Arabidopsis thaliana
MDPCPFIRLTIGNLALKVPLAAKTTSSVVHPSSSPCFCKIKLKNFPPQTAAIPYIPLETTQFPEIQTLAATFHLSSSDIQRLASRSIFTSKPCLKILIYTGRAGAACGVHSGRLLAKVSVPLDLSGTQSKPCVFHNGWISVGKGAGKSSSSAQFHLNVKAEPDPRFVFQFDGEPECSPQVVQIQGNIRQPVFTCKFSCRHTGDRTQRSRSLPTETSVSRSWLNSFGSERERPGKERKGWSITVHDLSGSPVAMASIVTPFVASPGTDRVSRSNPGSWLILRPGDCTWRPWGRLEAWRERGGATDGLGYRFELIPDGSSGAGIVLAESTISSHRGGKFSIELGSSPSSSSPTSVVNRSRSRIGGSSGSGGGASPANSPRGGSGDYGYGLWPWNVYKGFVMSASVEGEGKCSKPCVEVSVQHVSCMEDAAAYVALSAAIDLSMDACRLFNQRMRKELCHESLS

SEQ ID NO: 5750 - protein, 398 aa, Dehalococcoides sp. BAV1
MTSQVGTDKGFISERAKELKPSGIRKFFDLAAKMGSGAISLGVGEPDFTTPWHIRESAIYALEKGYTMYTSNAGLLELRQEISKYLYQTYGLEYNPETEVLITVGSSEALDLVMRATLNPGDEVLMTDPAYVAYPSCVFMSYGNPVQIPTFEANNFEISAADIAPRITPKTRSILLGYPSNPTGAVMPKAKLAEIAKLACEKNLLVVSDEIYDKIIYSGFEHTCFATLPGMRERSVIINGFSKTYAMTGWRIGYAVGPAAIIQAMTKIHQHTMLCAPIAAQKAALEALRNGQDDVRLMVEEYDRRRRFIVKNFNDMGLSCFEPKGAFYTFPSVRKTGLSSNEFAEKLLMEEKVAAVPGTAFGESGEGYLRCCYATSLKDIEEAMKRFRHFLKHNCPQM

SEQ ID NO: 5751 - protein, 401 aa, Oryza sativa (japonica cultivar-group)
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSATIFCISFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 5752 - protein, 469 aa, Erwinia carotovora subsp. atroseptica SCRI1043
MSAEHVLTMLNEHEVKFVDLRFTDTKGKEQHVTIPAHQVNADFFEEGKMFDGSSIGGWKGINESDMVLMPDASTAMIDPFFEDTTLIIRCDILEPGTMQGYDRDPRSIAKRAEDFLRSSGIADTVLFGPEPEFFLFDDIRFGSSTSGSHVAIDDVEAYWNSGKAYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKDGTNLFAGDKYGGLSEMALFYIGGVIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEALAALNEDREFLTRGGVFTDDAIEAYIELRKPEIDRVRMTPHPVEFELYYSV

SEQ ID NO: 5753 - protein, 441 aa, Alkaliphilus metalliredigenes QYMF
MNHKEALLKKAKELEVEFIHLQFTDILGVMKNVSITIEQLEKALDNEIMFDGSSIDGFVRIEESDMYLAPDLSTFIVLPWTDSPREARLICNVYKTDGTPFHGCPRNALKKVVKEALDMGYTINIGPECEFFLFHTDEKGEPSLQTHDNAGYFDLAPVDLGGNARKDMTMTLKQMGFEIEASHHEVAPGQHEIDFKYADALVTADRIMTFKMVVRIIAQRHGLHATFMPKPKFGINGSGMHINMSLETMDGKNAFYDDKDKLKLSKVAYHFLAGVLKQAKGFAAVTNPTVNSYKRLIPGYEAPVLIAWSASNRSPLVRIPAKRGNSTRIELRNPDPSANPYLALAAVLKSGIDGIKNEIDPPKPVDSNVYDMDELEMKEKGIEGLPANLYEAVKMLSTNEVVKEALGQHIFKKLTGAALYEWNEYSKDVSQWEINRYLRKY

SEQ ID NO: 5754 - protein, 271 aa, Thiobacillus denitrificans ATCC 25259
MHKVSFIGGGNVAAAIIGGLVASGTAPTDIEVVEINADARDKLATRFGVVTHTDLSQARLHALVVLAVKPQTLPEVAAALAQRLSGQLVVSIAAGVRVADLARWLGGHARIVRAMPNTPALVQAGITGLFAPDAVSQESRSQAESVLRAVGGVVWVDDEPQLDAVTAVSGSGPAYVFYFIESLEAAAEAQGLAPGVARQLALQTFFGATKLALESGEEPALLRQRVTSKGGTTERGLAALDAAGVKQAVGQAVDAASRRGAELGDELGRLA

SEQ ID NO: 5755 - protein, 533 aa, Brucella suis 1330
MAPRVLVSDKLSPTAVQIFKDRGVDVDYLPDLGKDKEKLLEVIGEYDGLAIRSATKVTEKLIAAAKKLKVVGRAGIGVDNVDIPAASRRGIIVMNTPFGNSITTAEHAIALMFAVARQLPEADTSTRAGKWEKNRFMGVEITGKTLGVVGCGNIGSIVATRGIGLKMHVVAFDPFLSDARAQELGVEKVELDELLARADFITLHTPLTDKTRNIINAQTLAKMKPGVRIVNCARGGLIVEKDLIAALKSGHVAGAGIDVYETEPATENELFSLPNVVCTPHLGASTSEAQENVALQVAEQMSDYLVKGAVSNAINMPSITAEEAPRLKPFVKLADVLGAFVGQVTDEPIQEVEVLFDGSTASMNTRALLSAALAGLIRSQVADVNMVSAPIMVKERGIIVSEVKRDKSGIFDGYIKLTVKTTVRERSIAGTCFSDGKPRFIQIKGINLDAEVGPHMLYVTNKDVPGMIGLLGTICGKHDVNIANFALGRDHPGGDAIAMLYVDEQIPQAALDELMAQEAIRAATPLEFNVGEV

SEQ ID NO: 5756 - protein, 252 aa, Prunus fremontii
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 5757 - protein, 390 aa, Pyrococcus abyssi GE5
MRQKRKYFIAERVILIKRSKIRELFERASKMENVISLGIGEPDFDTPKNIKEACKRALDEGWTHYTPNAGIQQLREAVVEYYKKFYDVDIDVENVIITAGAYEGTYLAFESLLESGDEVLIPDPAFVSYVEDAKLAEAKPVRIPLREENNFMPDPDELLELVTKKTRMIVINYPNNPTGATLDKEVAKAIADIAQDYNIYILSDEPYEHFIYDDAKHYPMLKFAPENTILANSFSKTFAMTGWRLGFVVAPSEIIKEMIKLHAYIIGNVASFIQVAGVEALRSEESWKAVKEMRKEYNERRKLVLKRLKEMPGIRVKEPKGAFYVFPSIKDTGMSSEKFSEWLLEKARVVVIPGTAFGKMGEGYVRISYATSREKLMEAMDRMEKALSEL

SEQ ID NO: 5758 - protein, 231 aa, Magnaporthe grisea 70-15
MARKFFVGGNFKIFTSSEVVISPPHVYLSHTRSLAKKEIEVAAQNVFDKADGAYTGETSVSQLKDLGINWVILGHSERRTILGESDEVVASKTKYAIDNGLKVIWCCGESLEERESDKTVEVVTRQLEALKAKVGTSGWENIVIAYEPIWAIGTGKVATPEQAQDAHAAIRGYLKSKVSDKVAEETRILYGGSVNEKNCGELSQKPDIDGFLVGGASLKPAFVDICTCKSA

SEQ ID NO: 5759 - protein, 252 aa, Prunus dulcis
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKHQKSVAQFALRWNLERGTPVIPKSSKVERLKENLEVLNFKLEKEDIELINTIDKKFRTTL

SEQ ID NO: 5760 - protein, 233 aa, Prunus persica
NAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEVLNFKLEKEDIELINT

SEQ ID NO: 5761 - protein, 199 aa, Zea mays
MPRRRHGGFRLGWKLLGVWRWAALCRRRRRGRGYLRLHPRQQGGGSDRSPPLQAGVAAVCATKQKKQQQQQRDDSADSPRMLTWGRSLARRMSLLRRRAGGKGRLLEDEDAAEATTPKGQVAVYVGGAEPGAESMRYVVPVVYFNHPLFGELLREAEEEFGFQHPGGITIPCAASRFERAAAVVAAGGGAGKKVPAGWW

SEQ ID NO: 5762 - protein, 638 aa, Oryza sativa
MAASRVALSVPVAAAVALLLLALPRAAVSYPWGLCNDTAGEFPARRSSYLASINLIAATLPGNASASPDLFATAEGVGAPPDQVSALALCRGDANASTCLACLTQAFLDLPNACAYHKVAAIFYDSCLLAYSNATIAAGDFSSEKIPIYGFYSNANATTEQARFNRLVAALVNATADYAARNSTRRRYASGEADFNAEFPKVYSWAQCTPDLTPASCRSCLAQIIGTYIGFFENRVGGFVRAVWCSFQYSTTPFLDGPMLVRLQGTSGASPAPSPAAVVPAVNQTPPAATPTLEGDANYSTEAEDIENLDSMLIDISILRSATGDFAESNKLGEGGFGAVYKGVLPDGYEIAVKRLSKSSTQGVEELKNELALVAKLKHKNLVSLVGVCLEQQERLLVYEFVPNRSLDLILFDTEKSEQLDWEKRYKIINGIARGLQYLHEDSQLKVVHRDLKASNILLDVNMNPKISDFGLARIFGRDQTQAVTKNVIGTYGYMAPEYLTRGNYSVKSDVFSFGVMVLEIVTGRKNNHSYNSQQSEDLLTMIWEQWVAGTVLEMVDPSMNSFFSESDVMRCIHIGLLCVQGDPANRPVMSSVVLMLGTDTVELHAPAKPTLFARKGGGDESGVASGGMSIVSLEEQS

SEQ ID NO: 5763 - protein, 425 aa, Schizosaccharomyces pombe
MSNNSRLPENGVQSGNGEDAELKKSMRIIEREIPDSLLEKIPEAEDYIALQDLERKLDSLIVRKRFDLQDSLSRNSHKTRILRMYIHSTVANQSWQQKGENQENNSGDINSLPIPEWTLHIEGRLLVNPDDEDDKAFELAPFTNFFRKIAIQILRSDDLYPSGNYVEWNKLPDNSNTSNGITVTRKGDQSVDVKIMLYPEEHPERYKLSKAFANILGIREGTRPDIVSYLWQYIKFHRLQDMEEKRLINCDKALRDLFEADRLYFPRIPELMNRFLEPIDPIVIPYTINVSEHTVEKVTIFDIRINTEDPRHSQIRSFLATMMSQDKIRSIDDKLTELIQAITYSQSKYDFMKKFSESPIEFINEWIESQSRDLEIVLDGTNMNYAEKRSADYYQQPWVHESAFHYLNLLNSKKQQSVLNASAKK

SEQ ID NO: 5764 - protein, 252 aa, Prunus maritima
AHYTSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSMAQIALRWNLERGTPVIPKSSKVERLKENLEILNFKLEKEDIELINTIDKKSRTTL

SEQ ID NO: 5765 - protein, 293 aa, Schizosaccharomyces pombe
MDSADIRSAKAALEKAIQGKNIETIINIMTRLKNEVVATEELLKETRLGLVVGKLRSHPNEKVGEQAREIVKKWKADVSKGRPLKTTTTTSSTPSKHADVGSQAQKQVQKQSSSGQRTFKSDNVNVNVTDDKIRNNCIGLMYNALVIDSDESSSLIIAKAKEIDAQVLARAAGKTGSEYRNRMRSLYMNLKDKNNPKLRASVLRNEITPQRLSTMTSAELASEDRRKEDAKLEQENLFHAQGAKPQKAVTDLFTCGKCKQKKVSYYQMQTRSADEPMTTFCECTVCGNRWKFS

SEQ ID NO: 5766 - protein, 421 aa, Schizosaccharomyces pombe
MSSKSSLELANNAVKSNDIEKAIDLYKEVLNKGVSKDEKVANEQEQALTNLSDLYVRENRHNDLAQLVQQSRPLMANFSKAKSAKIVRTLIDKFSGEKKSLPLQIEVANDCIKWAIKEKRTFLRQALETKLISLYYDNSSYTDAINLINTLLSELKRMDDKMLLTEVHLLESKVYHAIRNIPKARASLTAAKTSANAVYCPPMLQGNLDLQSGILHADDMDFKTAYSYFYEAYEGFTSLDDDKKALSSLKYMLLSQIMLNSVSEVKSLLTGKHAIRYAGRDIEAMRAIAQAHENRSLADFEKALQDYKPELASDPIIRSHLSSLYDNLLEQNLLRVVEPFSRVEVSHIAELIGLSTVQVEGKLSQMILDKIFYGILDQGSGCLIVYDEPQQDKTYEAALEVIKNMGTVVDLLIENKASALL

SEQ ID NO: 5767 - protein, 550 aa, Arabidopsis thaliana
MKLDEEFLHDRDHSFLTDDEENQAALACSDDEHDGDDDGRRGGENSDSSSPLSRDRSDNNLSDVSNPPWPQSYRQSMDLLTGMTPPSVSFMPQSSSRRLASSFQKKQQSSFCDSLSSSSSKPLLSQPVPDKEETILPVNPQSQLKLSVTDLPLPEPNLCSFSQSVLNGTNVLCGLGLITMPYAIKESGWLGLPILLFFGVITCYTGVLMKRCLESSPGIQTYPDIGQAAFGITGRFIISILLYVELYAACVEYIIMMSDNLSGLFPNVSLSIASGISLDSPQIFAILTTLLVLPTVWLKDLSLLSYLSVGGVLASILLGICLFWVGAVDGIGFHATGRVFDLSNLPVTIGIFGFGYSGHSVFPNIYSSMKDPSRFPLVLVICFSFCTVLYIAVAVCGYTMFGEAVESQFTLNMPKHFFPSKVAVWTAVITPMTKYALTITPIVMSLEELIPTAKMRSRGVSILFRTMLVTSTLVVALSVPFFAIVAALIGSFLAMLVALIFPCLCYLSILKGKLSNTQIGLCIFIIVFGVVSGCCGTYSAISRLANQMTD

SEQ ID NO: 5768 - protein, 267 aa, Dechloromonas aromatica RCB
MPLIDPILLKARLGALAGRFDVDALDECDSTSSELMRRADRGAPAGTVIVADRQSAGRGRRGRSWLSSPERSLTFSLLWRFAGNASRLSGLSLAVGLGLAKALEKLGAVGVRLKWPNDVLLQSGSDFAKLAGILIELSSDRRGTQAIIGIGLNLETPDSDLPQPVAGLKQCCAQADRHEVLAAILVSLVGVLDIFAAEGFVGLRDEWLGYHAWQDQLVQVLGDDAEPLPGRCLGVDGDGSLLLETARGVEHIFSGDVSLRPVGRAQG

SEQ ID NO: 5769 - protein, 317 aa, Bacillus cereus ATCC 14579
MQVFSEADGEFVSGQTISDKLGCSRTAVWKHMEDLRSEGYELEAVRRLGYRIASKPDKVTANEIQLGLQTKRIGRTVYFEETVESTQHIAAKLAYEGAEEGTVVVAEEQTAGRGRLSRKWHSPKGTGIWMSIILRPSIPVHHAPQLTLLAAVSVAQAIEKCTGVNVGIKWPNDILIQGKKAVGILTEMQADLDKINAVIMGIGINANQKQEHFDEEIQHIATSLAIESGKPIVRAELMQQIYLQLEKLYEEYLQNGFSVIKILWESYAVSIGKEITARTMRETITGLAKGITEDGVLLLEDHEGKVHHIHSADIEIK

SEQ ID NO: 5770 - protein, 393 aa, Streptococcus agalactiae NEM316
MVFSVKTFNNINQIGLQELGNRFQIDGDMSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAEAFSIMKKGTTIINFARAELVNNQELFKAIETGVVKRYITDFGDKELLNQKGITVFPHVGGSTDEAELNCAIMASQTIRCFMETGEITNSVNFPNVHQIQTAPFRITLINKNVPNIVAKISTAVSELGINIDNIINRSKGDYAYTLIDLDETDNNKISTLIEEFEGDENIVRVRLIAKQQ

SEQ ID NO: 5771 - protein, 723 aa, Oryza sativa
MLCLIRFYLRGYAAADLGAWKNTRQQYSPSSPISLGSSVFSESSLELSTTTADGSTANAVLAAIVASIGNLLQGWDNAAIAGAIMYIKNEFNLQNDPMMEGLILAMSLIGATIITALSGMITNSIGKRPLLSVAAILYSISALIMFQASNEYMLLLARLIYGFGSGLVVTYAPLYISETAPTNMRGLLNTLPQFNGSLGMLLSYIMVFLMSLTLNPNWRIMLGSLSIPSFVFLLLCIFYLPESPVFLVSKGKIEEAKNVMKRLRGTNEVSSEIAFLIQGLTVDQDNYIEDYMIGHNNDEFDDQSISNTETTKLYGHEEGVTWFARPFKGKNVVESDHSPIPNLLDPIVTLFDSIHGNILNTPEFTSSGNMSNDIEQPKTDLESQEDLDTDYEDDLGHPLLFHQGSYMEGIDDACVNGGWHIAWKFVQRENEFGQTQDDFQQIFLQGDILQAGRVSHATALVSTPSFHHSIGPAMVHPSKFNLSTEGQSWSDLLQPGVKQGLIVGVTIQILQQLAGISGILYYTPQILEQAGAGILLKWFNVSSSSSSILTSALTTFTMLPSIGIAMKCMDRYGRRSLLLYTIPMLIVSLIILIVVNVMNLEAIFGAILSTFGVIIYVCCFVMGFGPIPNVLCSELFPPSCRNRCMSICTLTFWIVSIIVTYAFPVMLSSIGLIGVCGIYAVVCIVSFIFVLIKVPETKGMPLAVIANSLAVGARLSVKRNENI

SEQ ID NO: 5772 - protein, 316 aa, Gracilaria lemaneiformis
MAIPKVGINGFGRIGRLVLRAAIEKNTCTVVAINDPFIDLEYMAYMFKYDSTHGRYPGTVEASGGKLVVDGNVIQIFGCRDPAEIQWSAAGAEYVVESTGVFTLKEKAEKHFVGGAKKVIISAPSKDAPMFVCGVNEEKYTPDLNVISNASCTTNCLAPLVKVIHEKYGIEEGLMTTVHATTATQKTVDGPSHKDWRGGRGAGANIIPSSTGAAKAVGKVMPELNGKLTGMAFRVPTPDVSVVDLTVRLAVDTTYDDIKATMKAASEGKMEGILKYTEDSVVSTDFIHDDASCVFDAGAGIMLNSKFCSVLYDMMG

SEQ ID NO: 5773 - protein, 471 aa, Dechloromonas aromatica RCB
MATPQDVIKMIKENDAKFVDFRFTDTRGKEQHVTVPVSAFSEDKFENGHAFDGSSIAGWKGIQASDMQLNPDPATAYIDPFFDETTVVLTCDVVDPADGRGYDRDPRSIAKRAEAYLKSSGIGDTAYFGPEPEFFIFDGVEWNVDMSGCSLKIHSAEAAWGSGEKNDGNGSTGHRPTVKGGYFPVPPVDSLHDIRSAMVLTLEALGCPVEVHHHEVATAGQCEIGTVFNTLVKRADQTQILKYVVHNVAHQYGKTATFMPKPIVGDNGSGMHVHQSIWKDGKNLFAGDGYAGLSELALFYIGGIIKHAKALNAITNPGTNSYKRLVPHYEAPVKLAYSAKNRSASIRIPYVASTKARRIETRFPDPIANPYLCFAALLMAGLDGIQNKIHPGDPADKNLYDLPPEEDAKIPTVCASLEEALAALDKDREFLTRGGVFSNDWIDAFISLKMDEVNKVRMTTHPVEFDLYYSC

SEQ ID NO: 5774 - protein, 217 aa, Yersinia pestis biovar Medievalis str. 91001
MNQTLLSDFGTPVERVERAIDALRNGRGVMVLDDESRENEGDMVFAAEAMTLEQMALTIRHGSGIVCLCITDERRQQLDLPMMVTHNSSQFQTAFTVTIEAAEGVTTGVSAADRLTTIRKAIADNAKPADLNRPGHVFPLRGQPGGVLSRRGHTEASIDLATLAGYKPAGVLCELTNDDGSMAHAPEVIAFAKLHDMPVVTIDDLAAYLQSRAKKAS

SEQ ID NO: 5775 - protein, 526 aa, Candida albicans SC5314
MSSTTFNDIIDSVLPYLTKWYTILIGAGLIFVLSTNLKNAYYSYKLGCKNPVHLKRAGWTGIPALIDAIKAKNSGKLAEFGGDTFDELNSKNFYLNVAGVLKIIFTIEPENIKAVLATQFNDFSLGTRHAHFYPLLGDGIFTLDGEGWKHSRAMLRPQFAREQIAHVKSLEPHIQILAKQIKLNKGETFDLQELFFRFTVDTATEFLFGESVHSLYDDKLGIPPPNDIPGRDNFATAFITSQHYLATRSYSQTFYWLTNNKEFRDCNAKVHHLAKYFVDKALNSTEKEIEEKSQGGYVFLYELVKQTKNPKVLQDQLLNIMVAGRDTTAGLLSFAMFELARNPKVWNKLREEIEANFGVGEEARVEDITFENLKKCEYLKAILNETLRLYPSVPINFRTSTKDTTLPTGGGPNGTSPIFVPKGSTVAYTVFKTHRLEEYYGKDSHDFRPDRWFEPSTKKLGWAYLPFNGGPRICLGQQFALTEASYVISRLAQLFPVLESRDEQYPPNKCIHLTMNHDEGVFVSMN

SEQ ID NO: 5776 - protein, 159 aa, Triticum aestivum
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKAPKSPKKTAKSPKKAATPKKA

SEQ ID NO: 5777 - protein, 277 aa, Bacillus cereus ATCC 10987
MSLTSLKDYTTLHNGVKMPWFGLGVFKVEDGSEVIESVKAAIKNGYRSIDTAAIYQNEEGVGQAIRESGVSREELFITSKVWNSDQGYETTLQAFETTLEKLGLEYLDLYLVHWPVKGKYTESWKALEKLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 5778 - protein, 1111 aa, Geobacter sulfurreducens PCA
MARRTPLSDDTPLWYRDAVIYQLHVKAFADSDGDGVGDFRGLMGKLDYLQSLGITAIWILPFYPSPLRDDGYDIADYYNVNPSYNTLREFREFLREAHARRIRVITELVLNHTSDQHPWFQRARRAKPGSVHRDYYVWSDTPDRYRETRIIFQDFETSNWSWDPVAKAYYWHRFYSHQPDLNFDNPRVQSEVLRIIDYWLGMGVDGVRLDAVPYLFEREGTNCENLPETHDFLKRLRGHMDASFPNRMLLGEANQWPEDAVAYFGEGDECNMLFHFPLMPRMYMAIEMEDRFPVVDILDQTPAIPEGCQWAIFLRNHDELTLEMVTDEERDYMYRIYASDPKARINLGIRRRLAPLLGKDRRRIELMNALLFSLPGTPVIYYGDEIGMGDNYYLGDRNGVRTPMQWSPDRNAGFSGANPQRLFLPVIIDPEYHYEAVNVDIQERNPTSLLWWMRRIIAVRRRYRAFSRGAMEMLYPANHKVLAFLRRHEDEVILVVVNLSRFAQAINLDLQEFAGISPEDLFSRNRFPVIREATYPLTLGPHDHFWFLLRRREAPLQAEEELPRIRLRGELPWWETLRQTRGDAHLERVTTDYLKRSGWFRGKARAIIGYVLRDTVLLRQGERVFPIFFLEVRYQDGPPETYLIPVAFLTGAGAKRVSAESPRAAIAALSVGDEEGILCDAVHDREFRDALLALALGRRRLHGEENSLIVPVHAGAGRIGSREEMRHLASELPKAEQTNSIITYGDRHVLKLYRKVEPGINSEVEMARFLTAKSSYPNVAPFQGSLELRHPGVEPGAIGLLQGYVQNQGDGWRLSLHLLGQYFERILSCRGELPPPPSRFSSLMDGSACTVPEPAAELIGGFYLEMAGLLGRRTAELHLALAAGGNDPAWRPEEYSTLYQRSVYQSMRNQARRSLQLLAQHHKDLPAEALASADRILSAEKELLACLRPIVGRRIQAMKSRIHGNFRLEKVLFTGKDFMIIDLEGEPDRPLGERRIKRSPLRDVAGMIRSFHNATLTALARHGAGHPGDIPLLEPWAEACWYHVSCRYLAGYLEQMGTSPLVPTERSDLETLLRSFLLDNALHELGYALANRPERVSSYLRGVETVLREFR

SEQ ID NO: 5779 - protein, 1014 aa, Polaromonas sp. JS666
MGRPCAAHVRLSVFYRNKHMLMPSAKPLGELENPSEFIPRHIGIDEADEVHMLSVVGSASRRDLIDGIVPRSIARTSTMAIPAPVTEAAALKQLKAIAAKNQVFKNFIGQGYYGTYTPGVILRNILENPAWYTAYTPYQAEISQGRMEALINFQTMVCDLTGMPIANASMLDEATAAAEAMTLARRSVKSKSNVFIVAGDCHPQTIEVIQTRARPLGIEVKVSTAVTTLPQLMAEGNYFGVLAQYPATTGSIHDLRPLAGQAHVDGAALCVAADLLALTLLTPPGEWDADIVLGNTQRFGMPMGNGGPHAAYLACRDEFKRSLPGRLVGVSVDVHGNPTYRLALQTREQHIRREKATSNICTAQVLPAVIASMYAVYHGPQGLRRIAERVAAYTAIFVRGLQELGYEITDLGAFDSVTVKTGDATNLIAERARQSGANLRCRLNNHLGVSLDETTSRKDIELLWSFFAQPGQTVPVVSAFEEGIESLIPADLRRTSAFLTHPVFNTHHSETGMLRYIRMLSDKDLALDRSMIPLGSCTMKLNATSEMIPITWPEFANIHPFAPQEQLQGYAELDKQLRDWLCQATGYKGISLQPNAGSQGEYAGLLVIKAFHEAHGQGHRNICLIPSSAHGTNPASAQMAGMTVVVTACDAQGNVDMEDLKAKCEKHSANLACMMITYPSTHGVFETHVQDLCQLVHSHGGRVYVDGANMNALVGVAAPGEFGGDVSHLNLHKTFCIPHGGGGPGVGPVCVVADLVPYLPGHATAGYAGGGRAFGEGTSFSAGPPQGKEAPSGGSALHEVKSVGAISAAPLGNAAVLPISWMYCRMMGAEGLKQATEIAILSANYISSRLKDHYPTLYASENGHVAHECILDLRPLKETSGVTAEDVAKRLIDYGFHAPTLSFPVAGTLMVEPTESETLDELDRFIDAMIAIRQEIRRIEKGEWPQDDNPLKAAPHTAASLLKGEWMHAYTRDVGAAILSKTQHAKYWPPVGRVDNVYGDRNLFCSCVPVSDYA

SEQ ID NO: 5780 - protein, 267 aa, Bacillus cereus ATCC 10987
MLTKHRILFIGAGRMAEAIFSGLLKTSKEYIEEIIVSNRSNVEKLEQLQARYNVSTTTDWKQHVTSVDTIVLAMPPSAHEGLLAELSPLLSHQLVVTVAAGIGPSYLEERLPKGTPVAWIMPNTAAEIGKSISLYTMGQSVTEIHQETLQLLLRGIGTSQLCTEEEVHQLTAVTGSAPAFLYYFAESLIEATKSYGVDEATAKHLVIQMISGSASMLEQTQDPANLREQVTTPGGSTAEGLKALYEYNFSEAIQKAVEATNKKARGK

SEQ ID NO: 5781 - protein, 92 aa, Candida albicans SC5314
MSKFVIPTALKELRFHLSQTGEASIPVRNFLTKNYPSLKTQSNYKLPILIRESYGIPPTLTARFERGEEVKTSLEGLDEAGVEKALNELLKR

SEQ ID NO: 5782 - protein, 478 aa, Rhodospirillum rubrum ATCC 11170
MKRNRCAKILATLGPATSSESTLETLVRAGADMVRLNFSHGAHEEHRRRYDVVRAVENKLGRPIGILMDLQGPKLRVGDFVGGKVKLETGATFRLDMEKDLGTIQRVRLPHPEIFAAIGEGTDLLLDDGKLRLRVETFGADYAITRVITGGVLSDHKGLNVPNAVLPISALTEKDRRDLQFGLDLGVDWVGLSFVQRPEDVAEARKLIGGRAAIISKIEKPAALDHLTHIIELSDALMVARGDLGVEVPPERVPILQKRILAACHLAGKPVVVATQMLESMINAPTPTRAEASDVATAIYDGADAVMLSAETAVGQYPVEAVAMMDKIIQQVETDEHYQYLRNARRESPEGTAADAISAAASQVAETIKAAAIVTYTSSGSTTLRAARQRPGVPILCLTTNPRIARRMAMVWGVHSVLDKDISNFQEMVELAVKAAYREGFANIGERIVMTAGVPFGTPGTTNVLRIAWVEGDDSWAE

SEQ ID NO: 5783 - protein, 252 aa, Prunus maritima
AHYKSEADVGNAIAEAIQSGLVKREELFITSKASNHGHVVEACKNSLKKLQLDYLDLYLVHYPLATKHSGVGTTASLLDENKVLDIGVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 5784 - protein, 325 aa, Bacillus subtilis
MRSTLRKDLIELFSQAGSEFISGQKISDALGCSRTAVWKHIEELRKEGYEVEAVRRKGYRLIKKPGKLSESEIRFGLKTEVMGQHLIYQDVISSTQKTAHELANNNAPEGTLVVADKQTAGRGRMSRVWHSQEGNGIWMSLILRPDIPLQKTPQLTLLAAVAVVQGIEAAAGIQTDIKWPNDILINGKKTVGILTEMQAEEDRVRSVIIGIGINVNQQSDDFPDELKDIATSLSQASGEKIDRAGVIQHILLCFEKRYRDYMTHGFTPIKLLWESYALGIGTNMRARTLNGTFYGKALGIDDEGVLLLETQEGIKKIYSADIELG

SEQ ID NO: 5785 - protein, 252 aa, Prunus maritima
AHYKSEADVGNTIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGIPVIPKSSKVERLKENLEILNFKLEKEDIELINTIDKKSRTTL

SEQ ID NO: 5786 - protein, 184 aa, Yarrowia lipolytica CLIB122
MSLNPDPHTRRRSSSILRHLEPETITEQSDQNALPNLNATWVNNKGAWGVHFFIIGILKICFDLIPGVTRELSWTLTNITYVIGSYIMFHYVTGIPFEFNAGAFDNLTMWEQIDDGDQYTPAKKFLLGVPIGLFLISTHYTHYDLHMFILNLLACLVVVIPKLPSSHKLRVGLPDLSPDTPSTY

SEQ ID NO: 5787 - protein, 69 aa, Brassica napus
MPPKQQPKADLAKKQKQVEDKTFGLKNKNKSKNVQKYVQSLKQSVQPKPDASKVAAKKKKEEEKAREQE

SEQ ID NO: 5788 - protein, 231 aa, Prunus maritima
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATASVKAFGSISPLEDPVLIGLAKKYQKSVAQIALRWNLERGTPVIPKSSKVERLKENLEILNF

SEQ ID NO: 5789 - protein, 94 aa, Prunus salicina
PSNYSNPTMPSNCRGSQFDARNLSPRLQSKLKRSWPDVESSNDTRFWEGEWNKHGKCSEQTLNQMQYFERSHEMWSSFNITEILKNASIVPHPT

SEQ ID NO: 5790 - protein, 295 aa, Zea mays
  misc_feature (27)..(27): Xaa can be any naturally occurring amino acid
  unsure (1)..(295): unsure at all Xaa locations
RPNPAPPELRDAGRDILDPAPGEPDFXAPEHIKQAAYAAIAAGATKYTPTPGVKALRVAVQRKLAEENHLDYSLPNIVIANGAKQIIFNAFAATLDDGDQVLVPTPYWPSFPDSVRFNGGEPVFIECGLEQGCKLLPAQLEQHINQRTRWLILNGPGNPSGAVYSEVELQALAEVLRRHPQVLVLLDELYEHIRFDGRPAQSLLNVAPDLQDRCLLVGGVSKTYAMTGWRIGFGAGPQTLTNAMAVVQSQSTSGASSVGQAAALAAFTGGLGFLAEQVAAYQLRRDLLMMALGTG

SEQ ID NO: 5791 - protein, 738 aa, Oryza sativa (japonica cultivar-group)
MGTSVQVTPLSGAYGEGPLCYLLAVDGFRFLLDCGWTDLCDPSHLQPLAKVAPTIDAVLLSHADTMHLGALPYAMKHLGLSAPVYATEPVFRLGILTLYDYFISRRQVSDFDLFTLDDIDAAFQNVVRLKYSQNHLLNDKGEGIVIAPHVAGHDLGGTVWKITKDGEDVVYAVDFNHRKERHLNGTALGSFVRPAVLITDAYNALNNHVYKRQQDQDFIDALVKVLTGGGSVLLPIDTAGRVLEILLILEQYWAQRHLIYPIYFLTNVSTSTVDYVKSFLEWMNDSISKSFEHTRDNAFLLKCVTQIINKDELEKLGDAPKVVLASMASLEVGFSHDIFVDMANEAKNLVLFTEKGQFGTLARMLQVDPPPKAVKVTMSKRIPLVGDELKAYEEEQERIKKEEALKASLNKEEEKKASLGSNAKASDPMVIDASTSRKPSNAGSKFGGNVDILIDGFVPPSSSVAPMFPFFENTSEWDDFGEVINPEDYLMKQEEMDNTLMPGAGDGMDSMLDEGSARLLLDSTPSKVISNEMTVQVKCSLAYMDFEGRSDGRSVKSVIAHVAPLKLVLVHGSAEATEHLKMHCSKNSDLHVYAPQIEETIDVTSDLCAYKVQLSEKLMSNVISKKLGEHEIAWVDAEVGKTDDKLTLLPPSSTPAAHKSVLVGDLKLADFKQFLANKGLQVEFAGGALRCGEYITLRKIGDAGQKGSTGSQQIVIEGPLCEDYYKIRELLYSQFYLL

SEQ ID NO: 5792 - protein, 278 aa, Bacillus cereus ATCC 14579
MKTKTDFLKMKEQGEPITMLTAYDYPSAKLAEEAEVDMILVGDSLGMVVLGYDSTVPVTVEDMIHHTKAVRRGAKETFIVTDMPFMSYHVSLQETMVNARRIVQESGAHALKVEGAGEVISTIQYLTNAGIPVVAHLGLTPQSVGVLGGYKVQGKDAESAKKLIEDAKKCEEAGAIALVLECVPMQLAELISEQLTIPTIGIGAGQKVDGQVLVYHDLISYGVNRVPKFVKQYTSVQEEIVRGISQYVTEVKTRQFPEEKHSFTMKEEECLSLYGGKQ

SEQ ID NO: 5793 - protein, 99 aa, Glycine max
  misc_feature (13)..(13): Xaa can be any naturally occurring amino acid
  unsure (1)..(99): unsure at all Xaa locations
SMALAFKSWWKPXFTFSISATRDRADGKMQYGFGIQSESLREASYQRADPNYVMLTQSKEHLAKGIVWKAGKRPMLKSDIDAGHFDGLPRELQPLDKIL

SEQ ID NO: 5794 - protein, 252 aa, Prunus takesimensis
  misc_feature (18)..(18): Xaa can be any naturally occurring amino acid
  unsure (1)..(252): unsure at all Xaa locations
AHYKSEADVGNAIAEAIXSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 5795 - protein, 101 aa, Triticum aestivum
YADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 5796 - protein, 350 aa, Arabidopsis thaliana
MQGGSSGIGYGLKYQARCISDVKADRDHTSFLTGTLSLKEENEVHLLRLSSGGSELLCEGLFSHPNEIWDLASSPFDQRIFSTVFSTGDSYGAAIWQIPEPYGQSNSSTLECVASLDAHVGKINCVLWCPSGNSDKLISMDEQNLVFWSLDSSKKSAEVLSKESAGMRHSLSGGAWNPHDVNSVAATSESSIQFWDLRTMKKNNSIERAHVRNVDYDLKREHILVSADDESGIHLWDLRKTKFPVQELPGHTHWTWAVRCNPEYEELILSVGTDSAVNLWFASASSEHKTSESPVEASRQRVNPLLNSYTDYEDSVYGLAWSSREPWIFASLSYDGRVVIESVKPFLPRR

SEQ ID NO: 5797 - protein, 413 aa, Xanthomonas campestris pv. campestris str. 8004
MSPKKTSFPKQDIRVLLLEGISPTAVDVFRAAGYSQIELHAKSLPEDELKARIAEAHIVGIRSRTHLSADVLAHAKRLIAVGCFCIGTNQVDLEAAELAGIPVFNAPYSNTRSVAELVIAEAILLLRGIPQKNAQCHRGGWSKSAAGSHETRGKVLGIVGYGHIGTQVGVLAESLGMQVIFHDIETKLSLGNARAAIDLDDLLARSDVVTLHVPETPSTKDMIGAAEIARMKPGAHLINASRGTVIDIDALDAALTSGQIGGAAVDVFPIEPKGNGDAFESPLIAHDNVILTPHVGGSTLEAQDNIGIEVAAKLVRYSDNGSTLSAVNFPEVTLPEHPDSLRLLHIHRNVPGVLSQINELFSRHNLNIDGQFLRTDPKVGYVVIDVSASEELAGVLKDELGQITGTLRTRVLY

SEQ ID NO: 5798 - protein, 129 aa, Nocardioides sp. JS614
MGESDVRPWGSWEVLDEGLGYKVKRLVVRPRQRLSYQTHSYRAEHWVIVSGRATCVINGVVRKARPGDYVDVPVGAAHRLMNEEQEPLVVIEVQRGLYTGEDDIVRLEDDYGRSEVVIATPGRLLDALA

SEQ ID NO: 5799 - protein, 395 aa, Bacillus cereus ATCC 14579
MKLAKRVAALTPSSTLEITAKAQALKAEGHDVIGLGAGEPDFNTPEHIMDAAHKAMLEGHTKYTPTGGLQSLKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGVEYTSIAQLSNALKEQTLIINGVSKSHSMTGWRIGYAAGNKQLIKAMTNLASHSTSNPTSIAQYGAIAAYTGSQEPVETMRQAFEERLNIIYDKLIQIPGFTCIKPQGAFYLFPNVKEAVALSGYATVDDWAKALLEEEKVALVPGTGFGAPNNVRLSYATSLEQVEKALERIHTFMKSKVQA

SEQ ID NO: 5800 - protein, 504 aa, Bacteroides fragilis NCTC 9343
MSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDEFIKPIVNAGVDGTIKEGDVVIFFNYRNDRAKELTVVLTQQDMPEAGMHTIPGLQYYCMTPYDASFKGVHILFDKENVVNTLGEYLAANGKKQLHIAETEKYAHVTFFFNGGRETPYDNEDRILVPSPKVATYDLKPEMSAYEVKDKLVAAINENKYDFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 5801 - protein, 256 aa, Triticum aestivum
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKPEFVDIIKSATVKSSSA

SEQ ID NO: 5802 - protein, 128 aa, Geobacter sulfurreducens PCA
MELERGERPWGTYTVLEENKNYKIKRIEVKPGQRLSLQMHHHRSEHWIVVSGTARVTCGDDEYTVNVNESTFIPIGRNHRLENPGKIPLVIIEVQSGEYLGEDDIIRFDDDYHRCEAAAATCAEEEGA

SEQ ID NO: 5803 - protein, 360 aa, Candida albicans SC5314
MDLDTDVPMEDVEEQQQQQEQSLSKQSATKSLTNPQGTGATATSSAQQQRKDLDGSSINQLDVWIEKLSKCEPLSETDVKKLCDMAVEVLQFEENVQPVQVPVTICGDVHGQFHDLMELFKIGGPCPDTNYLFMGDYVDRGYYSVETVSYLVCMKVRFPNRITILRGNHESRQITQVYGFYDECLRKYGSATVWKLFTDLFDYFPITALVDNKVFCLHGGLSPMIETIDQVRELNRIQEVPHEGPMCDLLWSDPDDRGGWGISPRGAGFTFGQDISEQFNHTNDLSLIARAHQLVMEGFSWSHHENVVTIFSAPNYCYRCGNQAAIMEVDEQHNRQFLQYDPSVRPGEPTVTRKTPDYFL

SEQ ID NO: 5804 - protein, 411 aa, Mesorhizobium sp. BNC1
MDTQTAISDASFRPATRVASLGVSEILQIGARAAQMKRAGEDVIVLGAGEPDFDTPENVKDAATRAMARGETKYTHLDGSPAMKEAVRHKFLSENRLDFTTDEITVSAGAKQIIYNAFMATLDPGDEVILPAPYWTSYMDVVRICGATPVVVACDAENGFRATAEQIERAITPRTRWLLLNSPSNPSGAAYGAEDYRPILDMLMRNPHVWLMADDIYEHIVYDGFEFVTPLALEPRLRGRTLTINGVSKAYAMTGWRIGYGAGPQPLVKAMSVIQSQSTSNPCSISQAAAIEALTGPQEFLAERRESFRERRDLVVTGLNTIEGIECRVPEGAFYAFAGCGGLLGRRTSDGSEIVSDRDLANYLLKDAKVAVVPGSAFGLSPFFRISYATSKSELTEALRRIGEACRRLVS

SEQ ID NO: 5805 - protein, 227 aa, Pyrus x bretschneideri
MGITRMIYMVTMVFSLLVSILSSSTVGFDYFQFTQQYQPAACNSNPTPCKDPPDKLFTVHGLWPSNKIGRDPEYCRTRNRRKRAKKLEPQLEIIWPNVLDRTNHTGFWRRQWKKHGTCGYPTIQNENDYFETVIKMYITEKQNVSRILSNAKIEPDGQSRPLVDIENAIRNGTHNKKPKFKCQKNNGVTELVEITLCSDKNRAHFIDCPNPFLPGSPYLCPNISIQY

SEQ ID NO: 5806 - protein, 491 aa, Bacillus thuringiensis serovar konkukian str. 97-27
MKNQDQALIFEVSKEGRIGYSLPKLDVEEVKLEDVFESDYIRVEDAELPEVSELDIMRHYTALSNRNHGVDSGFYPLGSCTMKYNPKINESVARFAGFANIHPLQDEKTVQGAMELMYDLQEHLIEITGMDTVTLQPAAGAHGEWTGLMLIRAYHEANGDFNRTKVIVPDSAHGTNPASATVAGFETITVKSNEHGLVDLEDLKRVVNEETAALMLTNPNTLGLFEENILEMAEIVHNAGGKLYYDGANLNAVLSQARPGDMGFDVVHLNLHKTFTGPHGGGGPGSGPVGVKADLIPYLPKPILEKTENGYHFNYDRPEAIGRVKPFYGNFGINVRAYTYIRSMGPDGLRAVTEYAVLNANYMMRRLAPFYDLPFDRHCKHEFVLSGRRQKKLGVRTLDIAKRLLDFGYHPPTIYFPLNVEECIMIEPTETESKETLDGFIDKMIQIAKEVEENPEVVQEAPHTTVIKRLDETMAARKPVLRYAKPAPVQV

SEQ ID NO: 5807 - protein, 255 aa, Euglena intermedia
MPRKFFVGGNWKCNGTRESIASLLKDFNGAVGEPDLDVQIVVAPPFVHCDFTKEKLPKGWELSVQNCWIGKGGAFTGEVSAEMIKDAGIPWVILGHSERRHLPQLKESDETVAVKVAYALANGLKVMACIGELLEEREAGQTQAVNERQLKAIAAKLKEEDWKNVVIAYEPVWAIGTGKVATPEQAQEVHEHVRAWVASNVSPSVAAEVRILYGGSVTAKNCVELAGKPDVDGFLVGGASLKPEFLDIIAAHKHK

SEQ ID NO: 5808 - protein, 277 aa, Yersinia pestis biovar Medievalis str. 91001
MTMQPLIKLYDGRLMPQLGLGVWQASIQETELAVSKALEVGYRSIDTAAIYKNEEGVGKALKAAAVARDELFITTKLWNDDQHNPQQALETSLQKLQLDYVDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 5809 - protein, 647 aa, Oryza sativa (japonica cultivar-group)
MHGGGARALAAAFVLALLAAAPAASEVVCSGRRYAANSSFDASLQQVARTLPGNASSSPLLFATLAVAGEAYALALCQGGTSAGSCNYCVAQTMRDGEHACAGDADVAMYDDICTVRFSDRDFLAATTNSPEKLVVAGSQSQKLVPSAAGRFYRLVGELLDATADYAVANSTARFATGDVGVGGYFDGEPFSKIYALAQCTPDLTPAQCRACLASAMEEMTRQVFAASSPGGKVIGERCGLRFEVFSFYTVDAMVHLQVAMEGKKKSTPVLAIVLPIVFAGLLTIIIVSFYIWRKKRLPTKTPLIENTEDLEDFESIFIDLSTLQSATSNFDESNRLGEGGFGVVFKGVFPDGQEVAVKRLSNCSNQGLGQLKNELSLVAKLQHKNLVRLIGVCLEEGEKVLVYEYMPNKSLDTVLFDPEKSKQLDWGKRYNILYGIARGLQYLHEHSQLKIIHRDLKASNILLDSDMKPKIADFGMAKIFGDDQTRNATSRVVGTLGYMSPEYAMRGQYSTKLDVFSFGVLVLEIVTGRRNSYAVVSEHCEDLFSLVWRHWNEGTVTEIVDPSLGNHYSRGDILKCINIGLLCVQQNPVDRPPMSAIILMLSSGTVTLQAPYRPAYIFGRNRSYTETMDVPLPSGPHSSITELEPR

SEQ ID NO: 5810 - protein, 252 aa, Prunus fruticosa
VDYKSEADVGNAIAEAIQSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 5811 - protein, 299 aa, Ustilago maydis 521
MAEEQDVKGNNARNGRGDGRWKLEVGIVDAADGLTGCRNVRGPTFTIPDYGERCSRFATKISQRQPPRKSESGSSSTGVETGMVIMTSIASTWTRTASSLSLFCSSRAITTLSSTQLYALRPSKTRASSTVACSEVQLTLALIKPSVCSYQPDVSSILKLIKCSRLSIARTRRLFWTSLDAHSFYAEHRGRFYYDRLILGMISGPSLALALYGPNAIKEWRAMLGPTKAYIGKHTMPASLRAKYGLGDTRNGFHGSDSPESARRELGLVFDGWDTEWWMQREQGKLPVDQEAKLNPLGF

SEQ ID NO: 5812 - protein, 281 aa, Bradyrhizobium sp. BTAi1
MPRYERAPLLKKFRDMVRRGVPIIGGGAGTGLSAKCEEAGGIDLIVIYNSGRYRMAGRGSLAGLMAYGDANAIVVEMAAEVLPVVKSTPVLAGVNGTDPFRDMDVFLDELKTLGFSGVQNFPTVGLIDGTFRANLEETGISYALEIDMIGRAHDKDLLTTPYVFNEAQATGMAIAGADIIVCHLGLTTGGSIGAQTAPKLEDCPGLIDSWASAALSVNPEILILAHGGPIAEPADADFIMKHTKNCHGFYGASSMERLPVERALTQQVRHFKAISSRPRRV

SEQ ID NO: 5813 - protein, 626 aa, Haemophilus ducreyi 35000HP
MSVDIVHLADSELGKIVALLATSITIVPLFKRLGLGSVLGYLVAGCLIGPSVLGLFQNPQSIVHMAELGVVMFLFIIGLEMHPELLWSMRKAIFGRGFLQVLTCGTLLTFAGIHLIGLTTAVAFVVGAGFTLSSTAIVMQVLEDKGISSAPKGQRIVSTLLFEDLAIVPLLASMTFLAPSTEGATTGINSAAISIAVIGIIILVASSKWIMNPLFRMISKAKVREMMTAAALLVVLGAALLMELSGLSMAMGAFVAGVMLSESSFRHQLEADIEPFRGLLLGLFFMGVGMSLDLKFVFDDLFLLLSLVVILVLGKAISVYVIGLLTLLSHREALMRMSIMSHGGEFAFVLFSAAAAVGILDEDQQATFTAAVIISMLLSPLVVLMVQRIMTRKAKPEAPSMAGIEVAEDLENSVIVIGFGRFSQIVCQILLARGITVTVIDANTDRIRAAARFGFKVYYGDGTRLDVLRASGLAKADCVVLGINDPTRSASIVEQIKHEFPLMPIFARTYDRYSAIQLTKLHVDFQIRETFESALVLSKATMMKLGIDEVEALEVIESVRVLDKERFKEELIYGTSAELIRKYFTPKPLVKPQQPAEALNEYAAEILAETDESQHCQDNLNKKADV

SEQ ID NO: 5814 - protein, 337 aa, Phaeosphaeria nodorum
MVVKVGINGFGRIGRIVFRNAIEHNDVEIVAVNDPFIEPHYAAYMLKYDSQHGQFKGDIKVEGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAVKAAADGPLNGILGYTEDEIVSTDLNGDTRSSIFDAKAGISLNKNFVKLVSWYDNEWGYSRRVLDLLVYIAKVDGNA

SEQ ID NO: 5815 - protein, 739 aa, Bradyrhizobium sp. BTAi1
MNDRSRSVPALDVRGLDVYYGHSHALQGVDLRLESGVFSLVGRNGMGKTTLCKAIMGLLRPSGGSVRLRGEDITGLNPARIARLGVGYVPQGRRLWRSLSVDEHLRLAAGLRRGAWTVDRVYETFPRLAERRNNGGGQLSGGEQQMLAISRALLTNPQLLIMDEPTEGLAPVIVTQVEEMLIRLGQDSDIAVLVIEQNIGVATAVSPRVAIMVNGRINRIIDSARLAADRELQQRLLGVGQHAGDETDLGTEQVRGEPVAGVVPPATPKAGPVKIYLSNPVLPTRWSQPVPIAQIEAKARTVSTSVTRLAEATSSSGERAGPITSGPPAVIVVGTLDTKGDELRFIRDIIAGHGLRTRLVDVSTSGKQGSCDVSAQEIALNHPRGGSAVFGSDRGASVTAMADAFARWLRRQDNVAGIISAGGSGGTSLVAPGMRELAIGVPKLIISSVASGDVGAYVGPADIAMMYSVTDVQGLNSISRAVLSNGAHALAGMVMARQQQAATVDRAKPQMPAIGITMFGVTTPAVQRITAELDDEYECLVFHATGVGGRAMEKLVDSGMLAGVIDLTTTEVCDLLMGGVFPATEDRLGAIIRTRVPYVGSVGALDMVNFGAPDTIPERYRGRKFHVHNPQVTLMRTTPAENTQMGRWIGERLNRMDGPVRFFLPEKGVSALDAQGQPFFDRDADEALFRSLEQTVRQTSNRRLIRVPHHINDHEFVATIVGAIRPMLGRLPARRRQVR

SEQ ID NO: 5816 - protein, 137 aa, Physcomitrella patens
MRWIVGGGVQRTIASPGRGILAIDESNATCGKRLASIGLENNEVNRQAYRQLLCTTPGLGEYISGAIMFEETLYQSTSDGKKMVDCLVEGGIVPGIKVDKGLVPLAGSNEESWCQGLDGLASRTAAYYKQGARFAKW

SEQ ID NO: 5817 - protein, 315 aa, Oryza sativa (japonica cultivar-group)
MSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRFAYREGIRFAKINDESEYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 5818 - protein, 367 aa, Arabidopsis thaliana
MEAVRSTTTLSNFHLLNILVLRSLKPLHRLSFSFSASAMESDASCSLVLCGKSSVETEVAKGLKNKNSLKLPDNTKVSLILESEAKNLVKDDDNSFNLSLFMNSIITHRFGRFLIWSPRLSSTHDVVSHNFSELPVGSVCVTDIQFKGRGRTKNVWESPKGCLMYSFTLEMEDGRVVPLIQYVVSLAVTEAVKDVCDKKGLPYIDVKIKWPNDLYVNGLKVGGILCTSTYRSKKFNVSVGVGLNVDNGQPTTCLNAVLKGMAPESNLLKREEILGAFFHKFEKFFDLFMDQGFKSLEELYYRTWLHSEQRVIVEDKVEDQVVQNVVTIQGLTSSGYLLAVGDDNQMYELHPDGNSFDFFKGLVRRKI

SEQ ID NO: 5819 - protein, 145 aa, Bacillus anthracis
ESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 5820 - protein, 454 aa, Sinorhizobium meliloti
MSYSFEELKEDVAAGRIDTVLACQVDMQGRLMGKRFHAEYFVESAWKETHSCNYLLATDMEMETVPGYKATSWEKGYGDYTMKPDLSTLRRIPWLEGTALVLCDMLDHDTHAEVPHSPRAILKKQVARLEAMGFKAYMASELEFFLFDQSYDDARLSGYRDLQLASGYNEDYHIFQTTKEEDVMRAIRNGLQGAGIPVENSKGEASAGQEEINVRYADALTMADRHAIIKNGCKEIAWQRGKAITFLAKWNYSAAGSSSHIHQSLWSKDGETPLFFDKNGQYGMSELMRHYVAGQLAHASEVTYFLAPYINSYKRFMAGTFAPTKAIWSKDNRTAGYRLCGEGSKAIRIECRVGGSDLNPYLAFAALIAAGIAGIENKMELEAPFVGDAYQGKEVREIPHTLREAGEALSGSKMLRAAFGEEVVDHYVHAAEWEQQEYDRRVTDWEVARGFERA

SEQ ID NO: 5821 - protein, 343 aa, Mycobacterium sp. MCS
MRAAIYHGREDVRIEELPDPSPRAGEVVIEVARAGICGTDLHEYIAGPMHAAPGVVIGHEYSGTVVGVGSGVREFTEGDRVCGVGVFGCGECGFCKQGAEALCGAVGFIGFAVNGALARYASLPTKALFRIPDEISLAEAAVVEPIASAYHAVRRSGLAAGGTVFIAGAGPIGLALVQFSLAQGATQVIVSEVSATRRVAAHRVGATRVIDPLAEDAVEVVRTLTNGNGVDISFDAAGVQPALDAALGVLRPRGRLMVVAIWEAPAGIDINRSVMREANIGFSFCYEAQRQVPAILDLLATGAINLGELITDEIPLDAVVSQGLEELRVNRDAHVKILIDPSA

SEQ ID NO: 5822 - protein, 145 aa, Bacillus cereus
ESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLGAVK

SEQ ID NO: 5823 - protein, 409 aa, Actinobacillus pleuropneumoniae serovar 1 str. 4074
MTVQIDKSKIKFLLLEGVHQNALDVLQAAGYTNIEYHKKALDGEELINAIKDAHFVGLRSRTYLTKEVLSHAKNLVSIGCFCIGTNQVDLKEAKRLGIPVFNAPFSNTRSVAELVLAEIILLMRQVPKANAEVHRGVWNKSAAGSNEVRGKKLGIVGYGHIGSQLSVMAESIGMQVYFYDIENKLPLGNAQQIASLNELLAGCDAISLHVPENASTKNLMNADRIAQLKEDSVLINAARGTVVDIDALAARLAQGTLRGAAIDVFPEEPASINDPFESPLRQFDNVILTPHIGGSTAEAQANIGTEVANKFVKYADNGSTLSAVNFPEVSLPILHSDAKRLLHIHENRPGILNKINQVFVDGNVNIAGQYLQTDPNIGYVVIDVELDDASEALERLQQIDGTIKARVIS

SEQ ID NO: 5824 - protein, 219 aa, Actinobacillus pleuropneumoniae serovar 1 str. 4074
MTQQEMKKIAAQAALQFVKPDTIVGVGSGSTVNCFIDALASMKDQIKGAVAASKASEERLRAIGIEVFNANEVSELDVYIDGADEITPQGAMIKGGGAALTREKIVSSLAKKFVCIVDGSKQVDVLGTTFPLPVEVIPMARSYVARQLVALGGSPEYREGVVTDNGNVILDVHNFHIIEPLKMEHTINNIAGVVTNGIFAQRYANVTIVGTPEGAKIIE

SEQ ID NO: 5825 - protein, 145 aa, Bacillus thuringiensis serovar sotto
ESVNKKTLAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 5826 - protein, 181 aa, Brassica napus
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 5827 - protein, 168 aa, Triticum aestivum
MFASRPAVHPVEAPPPTDPVEQPTGVLMKDLPGMPGTAGGLALRLAQFAFAGVALGIMASTNDFPSVSAFCYLVAATILQCLWSFSLAIVDIYALLVKRCLRNRRAVCLFAIGDGITAALIFGAACSSAGITVLIDNDLNICAENHCGSFETATAMAFMSWALTPSFC

SEQ ID NO: 5828 - protein, 334 aa, Pasteurella multocida subsp. multocida str. Pm70
MAIKIGINGFGRIGRIVFRAAQHRDDIEVVGINDLIDVEYMAYMLKYDSTHGRFDGTVEVKDGNLVVNGKTIRVTAERDPANLKWNEIGVEIAVEATGLFLDDATARKHITAGAKKVVLTGPSKDATPMFVSGVNFDTYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCALTSVFDAAAGIALTDTFVKLVSWYDNETGYSNKVLDLVAHVYNYKG

SEQ ID NO: 5829 - protein, 461 aa, Pyrobaculum aerophilum str. IM2
MSAPRGDHAILRARNLTKRVATLGPSTDVLRPDELIKFLDLVDGVRINLAHASPNEVKFRIEAVRSYEKAKNRPLAVIVDLKGPSIRVGSTSPINVQEGEVVKFKLSDKSDGTYIPVPNKAFFSAVEQNDVILMLDGRLRLKVTNTGSDWIEAVAESSGVITGGKAIVVEGKDYDISTPAEEDVEALKAISPIRDNIDYVAISLAKSCKDVDSVRSLLTELGFQSQVAVKIETKGAVNNLEELVQCSDYVVVARGDLGLHYGLDALPIVQRRIVHTSLKYGKPIAVATQLLDSMQSSPIPTRAEINDVFTTASMGVDSLWLTNETASGKYPLAAVSWLSRILMNVEYQIPQSPLLQNSRDRFAKGLVELAQDLGANILVFSMSGTLARRIAKFRPRGVVYVGTPNVRVARSLSIVWALEPLYIPAENYEEGLEKLISLKGTTPFVATYGIRGGVHSVKVKL

SEQ ID NO: 5830 - protein, 634 aa, Pyrobaculum aerophilum str. IM2
MSFVEIENKVKAILSGIEIVKVNYEGPNLCIYVKRPTEDVIDMIGEVAKTLKKRVILRVDPSNRASEKTASKVIREVLSDVEDVVFENNGDVYIYLAKPLREKEIKSATREIFVKTGWRAVIESGVPKDRVKLPTHEIVGVRHIFHSAYAQRMELMESLARYIHQEPVVKEGPITVTFLGAAMEVGRSAILVSTTESNVLLDCGLKPAQNDEEFPLLDLIDIDRLDAVVLTHAHMDHVGCLPFLFKYGYKGPVYMTDPTKYQAFILLSDYVELKEREGLQPSYSKADIETVIYHTITLDYEEVTDIAPDIKLTFYDAGHEIGSAMAHLHIGNGRYNILYTGDFKYGKTRLLNRAANKFKRVEMLIMESTYGGRDDVQPPRVEAENALAKHVSDAVTRGGKVLIPAFSTGRGQEILYILNKMMEGGLIPRVPVYVDGMIVETLNVYLMYPHYLNPEVAEEIYGGVNPFTTSGSVVIVDRAKRVEDRINQVAKIAQSEEPAVIIAPHGMLNGGPVVDYFAQLAHDERNKLIFVSYQAEGTLGRRILNGEREFVIKSLVGGESKINMRMEVVSIPGFSGHSDRRELMKYVEHMEPKPKKIVLIHGEPSKIISLATSIELKYKITTIIPKVGERIRAL

SEQ ID NO: 5831 - protein, 229 aa, Thermococcus kodakarensis KOD1
MNVEEMKKAVAKEALKFIEDEMVVGLGTGSTTAYFINYLGKLLMEGELEDVYGVPTSHQARLLALEAGIPVVSLDEVDAIDIAVDGADEVDPHMNLIKGRGAALTMEKIIEYRAGMFIVLVDESKLVEYLGQKMPVPIEVIPAAWRAIAEELEVFNATAELRMAVKKDGPVVTDNGNFILDAKFARIEDPLDLEIELNTIPGVVENGIFADIADIILVGTPEGVKRMER

SEQ ID NO: 5832 - protein, 648 aa, Thermococcus kodakarensis KOD1
MIRRETFVDDILKEIREIIVQMVPREAGITDVEFEGPELVIYVKNPEAMMKDGELIKNLAKVLKKRISVRPDPDILLPPEKAEELIKQLVPPEAEITNISFDPSVGEVLIEARKPGLVIGKNGETLRLITQKVHWAPRVVRTPPIQSQTIYSIRSILQTESKDRRKFLRQVGRNIYRKSEYKSRWIRITGLGGFREVGRSALLVQTDESYVLVDFGVNIAALKDPTKAYPHFDAPEFRYVLDEGLLDAIIITHAHLDHSGMLPYLFRYKLFDGPIYTTPPTRDLMTLLQQDFIEIQHMNGVEPLYRPKDIKEVIKHTITLDYGEVRDIAPDIRLTLHNAGHILGSSIVHLHIGNGLHNIAITGDFKFIPTRLFEPAVSRFPRLETLVMESTYGGSNDYQMPREEAEKRLIEVIHQTLKRGGKVLIPAMAVGRAQEIMMVLEEYARVGGIEVPIYLDGMIWEATAIHTAYPEYLSKHIREQIFHEGYNPFLNPIFKSVANSRERQDIIDSGEPAIIIATSGMLVGGPSVEYFKQLAPDPKNSIIFVSYQAEGTLGRQVQRGLREIPIVGEDGRTEVINVNMEVHTIDGFSGHADRRELMSYVARVRPRPERIITVHGEAHKCLDLSSSIHKKFGISTRAPNNLDAIRLK

SEQ ID NO: 5833 - protein, 272 aa, Yersinia pestis biovar Medievalis str. 91001
MNNRVHQGHFARKRFGQNFLNDQFVIDSIVSAIHPVPGEAVVEIGPGLGALTEPVAARMDHMTVIELDRDLAARLASHPQLKDKLTIHQQDAMKVNFSELSEQAGQPLRVFGNLPYNISTPLMFHLFSYTDAIRDMHFMLQKEVVNRLVAGPNSKTYGRLTVMAQYYCNVIPVLEVPPTAFTPAPKVDSAVVRLIPHVQMPHPVGDVRMLSRITTQAFNQRRKTVRNSLGDLFTSEQLIELGIDPILRAENISVAQYCKLANWLSAQSTPQK

SEQ ID NO: 5834 - protein, 223 aa, Zea mays
  misc_feature (211)..(211): Xaa can be any naturally occurring amino acid
  unsure (1)..(223): unsure at all Xaa locations
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMAWEGAGVVASARKLIGATNPLQAEPGTIRGDLAVQTGRNVVHGSDSPDNGKREIELWFKEGELCXKWESVQAPWLIE

SEQ ID NO: 5835 - protein, 1224 aa, Ustilago maydis 521
MAVVDVGFSGYFWLAIKSFAARVICLLSDSGLRSAVSDRMPTKSRKSAPSKFAFFLDQQETFSLHISIFEPLGAVGVAPFQTDNRISLHRVFDRLPDTALQGGHGRATRSQRNFLSTDKSTKSFGSPIDIRFGPLRIDWAERAQDKEMSQASQYRNASSSSTSVGPATVTASASELTKASRRRNVFHAKQPQVALPVASFEKTDSFQGDVSGSKEAESRLASCTEMFQGMTIGATEVAFGIVHLFRDKQDATSNATPTRRAASTTGQTALENQIPEQDIGAVVAVLAVPAYLTASHFLSYIEPAVEAITHLRMLRDMHPNRCMVLIRFRDAKDAEDFHKMYNGQPFNAMDPQEICQVVYITSLTVSKHSSLPFSYPTLTNSDPWPLRPPANAVNQPAYELPTCPVCLERMDSSVTGLMTISCQHTFHCSCLSKWGESRCPVCRYSQTGQPSMHQRRRTPRSSMDPSTPVRQANQVGGSDADESDAESDLDEPSCCAVCETQQDLWVCLVCASVGCGRYKHGHAHRHFSETGHLYSLELETQRVWDYAGDGYVHRLIQNKADGKLVELPSASSATATPEHSSTLPASASYASAMSMSGTKHSGPPAIHSRGDNTRPPYDAQERRRQQQQQQRDQNYAIRDQDSCRSADDQLEAIGMEYSYLLTSQLESQRHFYEDKLDQFQAQLASLTGDLEMLSRKSQLIDELSARTAELERTNEQLRRDKDKSDKKADKAIELARTLERDLHSERSMNKGLMDRLEKTKESEVGLKAQVTDLQEQVSDLMFFVQARDKLDQEGSEAQGGDVEKLDSTFGNAFVISGRNARCGTGGSSTHPPITSLKLESKLIWPVLEKKTLRVMQHGGGKSTKHNPQSTKHEAIVNLCNVLYSYHLPARQTKPREYYIMSLNKTFTLNDGNKIPLIGLGTWLSKPGEVENAVEIAVKAGYRHLDLAKIYQNQDEVGAALKKVIPSVVKREELFITSKLWNTSHQPDKVEAAYNETLKELGLDYLDLYLIHWPVAFQPGSDLVPKTEDGKFTALDLETSLVDTWKALIALQKAGKVKSIGVSNFTIAHLDAIINATGVVPAVNQIEAHPLLPQDDLVAYAQQKNIHLTAYSPLGNNLTGKTKIVDYPQVSEVAKKYNADPAQVLIAWGVKRGYSVIPKSVTETRIKSNFEQLELKDDDYETVTSLYKQLGKVRFNVPFTYSPQWDINVFGEDAEKEAKNEVKTE

SEQ ID NO: 5836 - protein, 360 aa, Zea mays
MHILNFSTAYTFYRALATPDKHRQTRKRQAMSSPAARSITCYSKIPEFLLGTNGQPMPAVGLGTASHPFVAEDVRTSVLTALELGYRHIDTAGLYASEWVVGEAMAEAVSRGLVASRDELFVTSKVWCTQCHPELVLPSLKESLKNLQMEYVDLYLIHWPMAVKPSKPHFPMKREDIVPMDLSGVWQAMEECHRLGLAKMIGVSNFTTKKLQELLAIAKIPPVVNQVELNPTWQQKKLIEFCNDKGIHVTAYSPLGGQRISKLNPVRQSDILEEIGKARGKSVAQISLRWIYEQGASMVAKSLKRERLKENIEIFDWELSDEDRFKIDHIAQRKLVTVQNLLCPEGISSVDILDVDVIEI

SEQ ID NO: 5837 - protein, 304 aa, Thermococcus kodakarensis KOD1
MKVLVAAPLHEKAIEVLKNAGFEVVYEEYPDEDRLVELVKDVDAIIVRSKPKVTRKVIEAAPKLKVIGRAGVGLDNIDLKAAEERGIKVVNSPGASSRSVAELAIGLIFAVARKIAFADRKMREGVWAKKQCMGIELEGKTIGVVGFGRIGYQVAKIANALGMKVLFYDPYPNEERAKEVGGKFADLETLLKESDVVTLHVPLVDATYHLINEERLKLMKPTAILINAARGAVVDTDALVKALQEGWIAGAGLDVFEEEPLPADHPLTKLDNVVLTPHIGASTVEAQMRAGVEVAEKIVEALKG

SEQ ID NO: 5838 - protein, 484 aa, Neurospora crassa
MATNGNAPKEITAAQLPDLLANDNSVKLAGIDVDGQLRGKLVSKKKFLSIAESGFGFCSVIFGWDMHDQTYIKELKVSNKENGYRDIIAIPDLNSFRRIPWENNVPFFLISFHDPDTMEPVSACPRGLLRKQLAKLSEKGYGAMAGAEYEFFQFRAPSENASDSTASYLKENPPHSLPSLTEGMFGYSLTRPVHNKDYYYDIFNTCEQFQCNIEGWHTESGPGVFEAALEFGEVKQMADRASLFKYVVKSVATKYGITPCFMAKPKQGLPGNSGHMHISLVDKDGKNLLAREEVDPNAPYPDVAYLSDLGRHFLAGILEGLPDVMPMVAPTINSYKRLVENFWAPVTVSWGLEHRAASIRLIGPPGSKAGATRFEIRVPGADANPFYVLSAVLALGWRGVEKKLEIPCPPLGKGEQVGGVTDAGARLAKSLKEATDRFMSKNSIAREVFGDEFVDHYGGTREHEIRLWDEAVTDWEMKRYIETV

SEQ ID NO: 5839 - protein, 129 aa, Zea mays
MKKTSSPLLIVLFLTAAAMAAEPEKQAAPAAQETAVHIVYVDRPEDADPEEFHISTLTPVLGSEQKARDAVLYHYKNAASGFSAKLTPQQVKDLKEQPGVLQVVPSQTYQLHGPGSGTHQGTTHTLGLM

SEQ ID NO: 5840 - protein, 136 aa, Glycine max
HASDHAYGCELRRRSKWLPSMISSPAVTTVNRAGAGMVAPFTGLKSMAGFPTTKTNNDITSIASNSGRVPCMQVWPPACTKNFETLSYLPYLDDAQLAKAVVYLPKKAWISCWAFELEHVYLYREHIMSPGYYYGR

SEQ ID NO: 5841 - protein, 377 aa, Methanocaldococcus jannaschii DSM 2661
MLFMKYEGEIAIGPVHPTMLEPHRLRLFIEDEIIKEAELVIGVNYRGIELIMEGLPPEKISILSEKICGICSHIHVWCNVTVTERGCDIEVPERAEYIRAIVEELERLHSHMLLFGHAFEVLGFETMAFRAFMIREPIMQILGEITGGRAQYSCPIIGGIRPRCNIKESKIPALLERLEKFEENLKKLLERTVNDPMIMSRIKDVGVLDKKTAKKLHALGPTARGSGIHSDMRKMGQVPVYDNFEFEEIVFDDGDVFSRLAVRFYECFESVKIIRQGLKDLPNLDKRIYNPNYELKEFKPIDVYNEAQRGQVYYSYGLDENGRVRQVKIRTPTATNLACMEAILPGHHVSDAELIIASCDPCFTCTDRMIVVKENKI

SEQ ID NO: 5842 - protein, 407 aa, Shewanella sp. MR-7
LGAFMAGMLLGESQYRRQLEADIRPFRDLLMGLFFISIGMMLDFALVIQFWWQILLILLAVVVGKALIIHGLLRLVGEPFRIAISTALSLAQVGEFSFVVLALAVSYGLLSNETSTMLVMVAVLSMSIAPWLVRHSVDIAKWLLGIRQSGHVDEVVPIVTDDHDLVLILGYGRVGQTIARFLKTEAVPYLVLDLDPTRVSEARRAGEPIYFGDVCKRAILKQVGIKHAKMIVITFCETRSLEEALPLCKQLAPDAKILVRTRDDSELDMLQKAGANQVIPESLEGSLMLVSQVLHQCGVPLARILKRLESERRNHYQFLHGFFSGTETDFTLESLHAVLLHRGADAVGKQVADIDWELLRVELRAIRRSGQEIEHPASDWIFRAGDILLIVGKPRRLEKAEAKLLHG

SEQ ID NO: 5843 - protein, 183 aa, Arabidopsis thaliana
  misc_feature (96)..(96): Xaa can be any naturally occurring amino acid
  misc_feature (117)..(120): Xaa can be any naturally occurring amino acid
  misc_feature (125)..(125): Xaa can be any naturally occurring amino acid
  misc_feature (134)..(134): Xaa can be any naturally occurring amino acid
  misc_feature (136)..(136): Xaa can be any naturally occurring amino acid
  misc_feature (139)..(140): Xaa can be any naturally occurring amino acid
  misc_feature (150)..(151): Xaa can be any naturally occurring amino acid
  misc_feature (155)..(155): Xaa can be any naturally occurring amino acid
  misc_feature (162)..(162): Xaa can be any naturally occurring amino acid
  misc_feature (166)..(166): Xaa can be any naturally occurring amino acid
  misc_feature (176)..(176): Xaa can be any naturally occurring amino acid
  unsure (1)..(183): unsure at all Xaa locations
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPXCVEFELEHRICVPVSPGTLPXXXXGRDWXMGKLSLVGXPXFPXXVKGSGKCQKXXPGPXIKDIGFXNTPXVPWLKFIGYXPQALPEA

SEQ ID NO: 5844 - protein, 1100 aa, Neurospora crassa
MTAPGRVGRLGHIVGPSTMAFRGAMPARLPLRASTTISCPQPLVAASCLRLASSESSQRGKLMKIIPSTAWVQYPELFPVREDFASRHIGPDNSSIQEMLGVLDPPVESLDQFVQEVIPADILSKRELFPQTRVRFHATKKYPTRQGHQEWEIMKIAESMASSNRHSVKAQIGAGYYGTLTPEVIKRNVLESPAWYTSYTPYQPEISQGRLESLLNFQTMVTDLTGLPIANASLLDEGTAAAEAMTMSLNALPASRAKRPAKTYVLSNRLHPQTRAVLRGRAEGFGVNIITLDFHDPEFPSKLEELGDDLVGVMVQYPDTTGQVLDHRQLADLVHKQGALLSVATDLLALTMLTPPGEWGADIAFGNSQRFGVPLGFGGPHAAFFAVQEKHKRKMPGRLIGVSKDRLGGRALRLSLQTREQHIRREKATSNVCTAQALLANISSFYAVYHGPEGLRAIAERCNLGARVLESAAKFCGLQLYSPNNSCSAVPFDTLVINQDHIGKVLVYAARERGINIRFISTDSAGISVDETTTENDLISLIGAFQDAARSLKVTGRDEALDANPQVIFEHFLKHHAEQIKQSGPLGHLPEPLRRTSSYLTHPVFNTHHSETELLRYIHHLQSKDLSLVHSMIPLGSCTMKLNASAEMALITLPGFSNLHPFVPPDQSEGYSRLTKVLESQLIDITGMDACSLQPNSGAQGEFAGLRVIRKYLQSRAQSQRDICLIPVSAHGTNPASASMAGMRVVPIKCDTKTGNLDLADLEAKCKQYENELAAMMITYPSTFGVFEPAIKKVCQIVHAHGGQVYMDGANMNAQVGLCSPGEIGADVCHLNLHKTFCIPHGGGGPGVGPICVKEHLAGFLPTTKTMSNTELNLPVSSASYGSASILPISWAYNALMGGAGLKKATQVTLLNANYLLSRLKEHYPILYTNEHGRCAHEFIIDARPFEKTSGIQAIDIAKRLQDYGFHAPTMSWPVANTLMIEPTESESKEELDRFVDALIAIREEIREVEEGKQPREGNVLKMSPHPISDIIGGDGEAGNKWDRPYSREKAAYPLPWLREKKFWPSVARVNDTYGDLNLFCTCPPVEDTTGGNQSSIQEQ

SEQ ID NO: 5845 - protein, 488 aa, Halothermothrix orenii
FEKHGTYYEIFVRSFYDSDGDGIGDLKGIIEKLDYLNDGDPETIADLGVNGIWLMPIFKSPSYHGYDVTDYYKINPDYGTLEDFHKLVEAAHQRGIKVIIDLPINHTSERHPWFLKASRDKNSEYRDYYVWAGPDTDTKETKLDGGRVWHYSPTGMYYGYFWSGMPDLNYNNPEVQEKVIGIAKYWLKQGVDGFRLDGAMHIFPPAQYDKNFTWWEKFRQEIEEVKPVYLVGEVWDISETVAPYFKYGFDSTFNFKLAEAVIATAKAGFPFGFNKKAKHIYGVYDREVGFGNYIDAPFLTNHDQNRILDQLGQDRNKARVAASIYLTLPGNPFIYYGEEIGMRGQGPHEVIREPFQWYNGSGEGETYWEPAMYNDGFTSVEQEEKNLDSLLNHYRRLIHFRNENPVFYTGKIEIINGGLNVVAFRRYNDKRDLYVYHNLVNRPVKIKVASGNWTLLFNSGDKEITPVEDNNKLMYTIPAYTTIVLEKE

SEQ ID NO: 5846 - protein, 145 aa, Bacillus thuringiensis serovar kurstaki
ESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 5847 - protein, 389 aa, Thermotoga maritima
MGSDKIHHHHHHMVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 5848 - protein, 249 aa, Xylella fastidiosa Temecula1
MTRKLVLLRHGQSQWNSMNRFTGWVDIGLTEQGHQEATMAGHLMKKEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVRESLKNTLERVLPYWNDAIAPQLNDNKTVLISAHGNSLRALYKYLNKESDEKILNVNIPTGIPLLFELSDTLQVVSYRYLGDPDAAQRAAEMVANQGKAK

SEQ ID NO: 5849 - protein, 390 aa, Wolinella succinogenes
MYSHRIESLSESMTIAISTLARELQSKGKDVISLSAGEPDFETPQVIKDEAIKAIEDGFTKYTSVAGIPELLKAIQAKLARDNHLEYETKEILVSNGAKHSLFNIFQAIVEEGDEVIIPSPYWVTYPEVVTYCGGKNIFIETCDASGFKMSAAQLKAALTPKTKALVLTTPSNPTGSVYSRQELEAIAEVLKGTNVWVVSDEMYEKLVYGVEFTSVASISEDMLKRTITVNGLSKSAAMTGWRMGYLATKDKKLIKLMDNLQSQCTSNICSITQKASIPGLDGRIDPEVEKMRQEFERRRNFAVDALNAIKGLSVIKPEGAFYLFVNTKALELDSMQFCKDLLEEEGVAVVPGIGFGMEGYFRLSFATSMEKIEEGIKRIARFCEKRERA

SEQ ID NO: 5850 - protein, 145 aa, Bacillus weihenstephanensis
ESVNKKTLAAFEHGLTPIVCCGETLEERESGKTFDLVAGQVTKALAGLTEEQVKVTVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 5851 - protein, 145 aa, Bacillus pseudomycoides
ETVNKKTLAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLGAVK

SEQ ID NO: 5852 - protein, 334 aa, Glycine max
MSSGSVRRVSRQDIQLVQNLIERCLQLYMSQKEVVETLLAQAKIEPGFTELVWQKLEEENEEFFKAYYARLVLKQQIMQFNKLLDQQVQLMQLHSSAVASLPMSNGSHIPAVTSLPNSNGSHIPAIPENPACYTSDRTQTSLKPENMQHAVDSRLSNVFNNGGSSLHTSMPAAVDMSVHGNRINGPASVLSAQSANMGLIQGINGGGMIKSEPGYSGCSPYMFSTDGNVLETRPTIGGASVTSFTNVESNSHSLNEAVLDPDTSSFGFLGQIPRNFSLSDLTADFSQSSDILETYSRSPFLATDNENFLDRGEQDNNRLDSISEGLSYEDFGSE

SEQ ID NO: 5853 - protein, 255 aa, Sinorhizobium meliloti
MSKSGLWVGTSWKMNKTLAEAMVFADGLAAADDARDQRIQRFVIPPFTAARQVKERLKATSVKVGAQNMHWDDAGAWTGEISPVMLSDCDLDIVELGHSERREHFGETDRTVGLKTAAAVKHGLVPLICIGETLAQREAGEADTVLKRQVEGAFAFLEGAARKAPVLLAYEPVWAIGVNGIPATADYADARHRLIGEVAERALGVKVPVLYGGSVNPQNCEELILQPHIDGLFIGRSAWDVGGYLDILQRVARAI

SEQ ID NO: 5854 - protein, 369 aa, Cicer arietinum
DFNLAIDLAGENLWYDCDTHYNSSSYIPIECGSKKCPDVACIGCNGPFKPGCTNNTCAANTINTLANFIFGGGLGQDFIFISQQKVSGLLSSCIDTDGFPSFTGNDSPLNGLPKITKGIIGLARSNLSLPTQLALKNELPPKFSLCLPSSNKQGFTNLLVGSIGKDPFQELYKFVQTTPLIVNPVSTGAVSVQGVPSIEYFIDVKAIKIDGKVVNLKPSLWSIDNKGNGGTKISTMSPFTELQRSVYKPFIRDFLKKASDRKLKKVESVAPFEACFESTNIENSLPRIDLVLQGGVQWSIYGNNLMVNVKKNVACLGFVDGGTEPRMSFAKASIVIGGHQLEDNLLVFDLNSSKLSFSSSLLVHNASCS

SEQ ID NO: 5855 - protein, 333 aa, Pasteurella multocida subsp. multocida str. Pm70
MKTLGQFIVEKQAEYPNAKGELSGILSSIRLVAKVIHRDINKAGLTNNIIGTSGAENVQGETQMKLDLFAHNTMKQALISREEVAGFASEEEENFVAFDTERGRNAKYVILTDPLDGSSNIDVNVAVGTIFSIYRRVSPIGTPVTLADFMQPGNRQVAAGYIVYGSSTMLVYTTGNGVNGFTYDPSLGVFCLSHENIQIPANGKIYSINEGQYLKFPQGVKKYIKYCQEEDKATHRPYTSRYIGSLVSDFHRNMLKGGIYIYPSATNYPNGKLRLLYEGNPMAFLAEQAGGMASDGYQRILDIQPTELHQRVPLFLGSKEMVEKAQDFMKTFG

SEQ ID NO: 5856 - protein, 468 aa, Chromobacterium violaceum ATCC 12472
MKTPPQSSCPFHAVGRPPTPPRSSAGRWPPGPESGLTGWGLLKLMSRDLMGTLAGWQREFGDLVHVRTWPEHQVIVSDPQLARELLVNQADALQRWERALTVYRRVHGHSVLIAEGQVWREKRQALQPDFTRKSVQAFSPSIVEAARRAFEQWPARHAAWPIESELTSVTMEVILRMMFSSGVGSEAQQAEEAVHTLMVASTEELWRPASLPDWVPWQRKRRRARLLMNGLIERHLQARLAMPQDAWPEDLLSRLLRLHLQQPQSWPLQAVRDECKTAFLAGHETVATSLTWWAWCMASHPEIQERAREEALAALSGGGQADPAALQYVSQTLLETMRLYPAVPLLMSRRALKPVTLGDWTFPAKTVFMVPMQLMQHDERWFPEPRSYRPERFGPDAARPQQGAYLPFGGGPRVCLGQHLAMAEMALVAAQLLLRYRLSAPEGAEPPRPVFHVSQRPSQPLTLGIARI

SEQ ID NO: 5857 - protein, 254 aa, Oryza sativa (japonica cultivar-group)
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFHRHHQLRHREVRL

SEQ ID NO: 5858 - protein, 476 aa, Aspergillus oryzae
MAASFTRLAGSAPKRLCLRPSTFTKYNAIPRSRSIATTLPRRQAEPTSYQATRLIPTDPTFTSLANKEGPQEADVAAGLESESEGVGRKIRHYTVNFGPQHPAAHGVLRLILEINGEEIVRADPHVGLLHRGTEKLIEYKTYMQALPYFDRLDYVSMMTNEQCYSLAVEKLLNIEIPDRAKYIRTMFGEMTRILNHLMSVLSHAMDVGALTPFLWGFEEREKLMEFYERVSGARLHAAYVRPGGVSQDIPLGLLDDIYQWATQFGDRIDETEELLTDNRIWKARTQGVGVVSAADALNMSFTGVMLRGSGVPWDIRKSQPYDAYDKVEFDVPVGVNGDCYDRYLCRMEEFRQSLRIIHQCLNQMPAGPVKVEDYKLSPPPRAAMKENMEALIHHFLLFSKGYAVPPGETYSAIEAPKGEMGVFLVSDGSERPYRCKIRAPGFAHLGGFDQISRGHLLADAVAIIGTMDLVFGEVDR

SEQ ID NO: 5859 - protein, 152 aa, Zea mays
MTTEQTFIAVKPDGVQRGLIGPIITRFENRGFKLAGIKMVTPSKEHLEKHYADLSDKPFFPGLIAYMGSGPVCAMVWEGRDAVKTGRSILGATNPLASAPGTIRGDYALDVGRNVCHGSDSVENGKKEIALWFKDGEVQSWKSAQHDWVYEK

SEQ ID NO: 5860 - protein, 305 aa, Pyrobaculum aerophilum str. IM2
MIVASIGNLNFDIYLKVSELPGPDENVEALDLYTGGGGSAANFAVAIAKMGLSARFIGAVGEDPLGEISLRELRAEGVDVSFVKRVRGVRSGVVVVLVHPDGVKRMVSYRGANLGLTPADLTVDKFAGVKHIHLATGRTELILKAKEIAREIGASISVDGGTALARKGLEIVRAAVEGVDVVFMNHVEAQLVANAGDHKSAVEKLARELKVGELVVTLGPIGAVAFKNGRLLHVDAFKVNAVDTTGAGDCFAAAYITMYLRGRDLYERLLFANAAAAIKVTRPSARASPRYDEVVAFLESLGYKI

SEQ ID NO: 5861 - protein, 313 aa, Ralstonia eutropha JMP134
MSEARKPVLLVTGNDLAPQALALLNDFEVCFAGKQCSEETVVALAKEKDPVAIIVRYGKIGAAVMDAAPSLKVISKHGSGIDVIDQNAAAARGIAVKAAVGANAAAVAEHAWALILACAKAVPHLNERMRASHWDKAVHKSIELEGRTLGIVGLGEIGRRAAAVGIAMRMRVIAFDPFAKTAPQGVTLAELPRIFSESDVVSLHCPLTDENRGMLNRETLATFKDGAILVNTARGGLIDEPALVEALNSGKLYAAGLDSFAVEPMPVPHPFQSVPNLILSPHIGGVSDAAYVNMGVGAAKNVLAVLEAGVVPA

SEQ ID NO: 5862 - protein, 466 aa, Thermotoga maritima MSB8
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEEKTYYRLSLVRKVIPVLAEKCSQELEFIEKGLKKVEEMGLAEKGDLVVLTSGVPGKVGTTNTIRVLKVD

SEQ ID NO: 5863 - protein, 460 aa, Xanthomonas axonopodis pv. citri str. 306
MPMSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 5864 - protein, 817 aa, Vibrio vulnificus CMCP6
MKPTQQKQFDKVSFQESVKKHLSATYAHTLENADSRAWYLAMGRALAELTTFDLLATETDKKIVEAKSVNYLSLEFLIGRLTGNNLISMGLYEQITEAMAELGQNLTDLLEEERDPSLGNGGLGRLAACFMDSLAAQEFPTVGYGLHYEYGLFKQSFEAGRQKEAPDAWRGVEGYPWEVARPELAQEIGFYGHVEVINEGGKERRQWVPGMHVKAMPWDLPIVGYESDTVYPLRLWECQAIAPFSLESFNNGNYFEAQHALIDAGNITKVLYPNDNHEKGKTLRLMQQYFHSAASVRDILRRHEAAGHTLASLPNFETIQLNDTHPTIAIPELMRILIDEKGLNWDEAWAISSKTFAYTNHTLLPEALETWSESLIQHLLPRHMEIIYEINHRFLQEVRAKWPGDVAKQQKLSIIQEGFHRMVRMANLCVIGSYAVNGVAALHSELVKRDLFPEFDELYPTRLQNVTNGVTPRRWLKFCNPGLSALISEKIGTDWPAHLEQLEGVAKFADDAKFQKEYMAVKKANKERLANWVKENMNIELDTNAIFDVQIKRLHEYKRQHLNMLHILSLYHRLLNDANFDMAPRVVFFAAKAAPGYHLAKEIIFALNKIAEKINNDPRIGNKLKVVFIPDYRVSMAEIIIPAADVSEQISTAGKEASGTGNMKMALNGALTIGTMDGANVEIREEVGDDNIYIFGLEVDGVEALKAKGYNPFDYYNADPLLKASMDLLLGEEFTPGQPGLLRATFDSLLDGGDPYLCLADFASYVKAHEAMDKQYRDQAGWAKKAILNTALVGKFSSDRSIRDYVNNIWKLEAVHR

SEQ ID NO: 5865 - protein, 529 aa, Pseudoalteromonas tunicata D2
MELIFFATAFVCGFIVLQLKLPPLIGFLAAGFLLNLAGYHSTPLLETIAALGVTLLLFSIGLKLKVDHLTKLQVWAPASLHIILSSALFCGFLLLLGFFGLPLFTDLSAESALLLGFALSFSSTVFAVKVLEERGEMASLHGKIAIGILVMQDVFAVLFLAVSTGKVPNYWAIALVISLFFIRPVFFWILGRSKHGEVLPLFGFFFALVVGYNAFEFAGLKGDLGALIIGMLLASHRKAGELAKSLLSFKDLLLVGFFLSIGLNAQLTVQALVVALLIISILPIKVALYYVFTNMFHLRARTSLLGAFTLANFSEFGLIVCALAASSGWLTPEWLAVVAISVAITFIIASPLNNRANDIYVKLENWLFKFESKVRLAEEMPVNLNRTKILIFGMGRIGTGAYEAIAHTYPDMVGGVDINPECIERHLKRGRFAILADATDPDFWQRINHSEVEMVMLAMPKHVQNLLALEQIKLSGYGGQVTAIANYPDQQKELELLGVDSTYNFYLEAGTGFAEHVKEHLFEPDKATP

SEQ ID NO: 5866 - protein, 977 aa, Xanthomonas axonopodis pv. citri str. 306
MSQTPSSLRDLEHHSAFVERHIGPNDAEIAQMLDVVGHASLDALTDAIVPGNIKSPAPLALPEAITEEEALAKIRAIASKNQVQRNFIGQGYYGTHTPKVILRNILENPAWYTAYTPYQAEISQGRMEALINFQTLCADLTGMQIANASLLDEATAAAEAMTLAKRSAKSKSNTFFVHDAVHPQTLELLRTRAEPLDIVLRVGTPEEALQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLVRIARRTHRLAAILAAALRSAGVSVGDRFFDTLHVKAIDADAIHARARAAGINLRAIDSEAVGISLDETTTRADVVALAQLFGATADVDALDAATADALPQGLLRTTPFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGQAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPYLPRAGIHAGEGQTAAIHGGGFNSESGNGHSSRIGGMVSAAAYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKEDAEA

SEQ ID NO: 5867 - protein, 335 aa, Brucella suis 1330
MAVRVAINGFGRIGRNILRAIVESGRTDIQVVAINDLGPVETNAHLLRYDSVHGRFPKEVKVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAIREAANGRLKGILGYTDEKLVSHDFNHDSHSSVFHTDQTKVMDGTMVRILSWYDNEWGFSSRMSDTAVALGKLI

SEQ ID NO: 5868 - protein, 315 aa, Manihot esculenta
  misc_feature (303)..(303): Xaa can be any naturally occurring amino acid
  unsure (1)..(315): unsure at all Xaa locations
MASASLLKSSPVLDKSEFVKGQSLRQPSASIIRCHPTAPSALTIRAGSYADELVKTAKTIASPGRGILAMDESNATCGKRLASIGLENTEANRQAYRTLLVTAPGLGQYISGSILFEETLYQSTTDGKKMVDVLVEQNIVPGIKVDKGLVPLPGSNNESWCQGLDGLASRTAAYYQQGARFAKWRTVVSIPNGPSALAVKEAAWGLARYAAVSQDNGLVPIVEPEILLDGEHGIDRTFEVAQKVWAEVFFYLAENNVMFEGILLKPSMVTPGAECKDRATPQQVADYTLNLLKRRIPPAVPGXMFLSGGQSEVEA

SEQ ID NO: 5869 - protein, 175 aa, Triticum aestivum
  misc_feature (134)..(134): Xaa can be any naturally occurring amino acid
  unsure (1)..(175): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNLPMSGCTDATQVINEVXEVNKEYPDAYVRIIGFDNMRQVQCVSFIAFKPPGCEESGKA

SEQ ID NO: 5870 - protein, 258 aa, Zea mays
ALLGQDALALHDDVDVVAAYTFGCLRVVTGGSVPPQGLVGFGCGPLSFPSQNKDVYGFVFSYCLPSYKSSNFSSTLRLGPAGQPKRIKMTPLLSNPHRPSLYYVNMVGIHVGGRPMLVPASALAFDPASGRGTIVDAGTMFTRLSAPVYAAVRDVFRSRVRAPVTGPLGGFDTCYNVTISVPTVTFSFDGRVSVTLPEENVVIRSSSDGIACLAMAAGPSDGVDAVLNVLASMQQQNHRVLFDVANGRVGFSRELCTA

SEQ ID NO: 5871 - protein, 230 aa, Streptococcus suis 89/1591
MVKLVFARHGESEWNKANLFTGWADVDLSEKGTQQAIDAGKLIKEAGIEFDLAFTSVLKRAIKTTNLALEAADQLWVPVEKSWRLNERHYGGLTGLNKAEAAAEFGDEQVHIWRRSYDTLPPEMAKDHEHSAHTDRRYAHLDDSVIPDAENLKVTLERALPFWEDKIAPALKDGKNVFVGAHGNSIRALVKHIKQLSDDEIMDVEIPNFPPLVFELDENLNIVKEYYLEA

SEQ ID NO: 5872 - protein, 438 aa, Sulfolobus tokodaii str. 7
MFRKTKIIATLGPSSENHIDELVKYVDVIRLNFAHGDKEQHEKYFNLVKNRVPILVDLPGPKLRIGDLGKNMILLKPGDTIEFGTQIPVDDILFFKLIRKGSEVLISDGRIRVKIIEAGNNYAKGLVEEGGILTSRKGINIPDSEIPVGLTDRDLELLKYALEMGATFIGLSFVTSPEEIRKAKEIVKDQAWIIAKIEKKSALKKLKEIIREADGVMVARGDLGVEVGLANLPQTQRRIVRLTRLYGKPVILATQVLESMVTSPIPTRAEVIDVANSIIQGVDAIMLSDETAMGQYPIDAVRTLHELILSVERSFKPRPPPPLKNIDDAIAYSAVSASNLASSSGIVVYTRTGASALRISRLRPVVPIIVLTQNQRVYERLKLCYGIYSFISEELNSLDNIVEKSKNIARQVGLKNTIIIIAGGIEEGSTRFLKVEEI

SEQ ID NO: 5873 - protein, 484 aa, Propionibacterium acnes KPA171202
MSTRLGGSSPAAGCPAVPSRFGAAGSGAPSGTEQEQGLQRGLKNRHIQFIALGGAIGTGLFYGAAESIEQAGPAIMVCYLIGGAVIFLIMRALGEMSVEHPTSGAFSYYAYRNWSPRAGFVSGYNYWFNYIAVSMAELTVVGKYVNFWFPQIPEWLSAGAFLVLITIINLTAVRAYGEFEFWFAVIKVVAILAMIVLGVLIIATGLGGGPPTGIGNLWRHGGFFPTGISGMLCGFVVVMFSFGGVELIGITAGEADDPRRSIPRAINQVVYRILIFYIGAISVMLCLFPWNQIGKAGSPFVTIFDKIGVAGAANILNVVVLTASMSAYNSGLYSNGRMLYSLAAQHNAPGIFWKTNRLGAPWVGVLASSVVTATAVLLTYLIPGKVFLYIISIALISGVINWTMIIITNLKFRRRIGPEGVAALEFRMPGNPVTSYVVLVFLALVVVIMAMMPSYRVALVVGPVWLALLWVGYDVSCLVRRRHA

SEQ ID NO: 5874 - protein, 515 aa, Acinetobacter sp. ADP1
MTDATVAKIPHVLVIMDGIGHREAIKDNAFLAAKTPSLSMMKQKHPHSLISGSGEDVGLPDGQMGNSEVGHMNLGAGRVLYQDFTRITKDIRDGVFFEHEVLVDAVEKAKAVHGAVHIMGLLSEGGVHSHEDHIVAMCELALKRGATVYLHAFLDGRDTPPKSAQPSLEKLDALFAQYPEQGRIVSMIGRYFAMDRDNRWDRVEQAYRLLTESEAVRTAQSAVQGLELAYAAGESDEFVKATRIGDAVAVQDGDSIVFMNFRADRARELTRAFVEHDFSGFTRQRIPHLSKFVMLTRYQATIDAPVAYMPEALHNSIGEYLSNLGKTQLRIAETEKYAHVTFFFSGGREDEYPGEKRILIPSPNVATYDLKPEMSAYEVTDQLVNAIDSGEFDLLVVNYANGDMVGHTGIFDAAVKAVEAVDTCLGRVYQAVMAKHGHMIITADHGNVEQMQDYQSGQVHTQHTTELVPFIYVGPTQAVIAEGGVLADVAPTLLNLMQLPVPAEMQGRNLITLSS

SEQ ID NO: 5875 - protein, 179 aa, Glycine max
  misc_feature (122)..(122): Xaa can be any naturally occurring amino acid
  misc_feature (125)..(125): Xaa can be any naturally occurring amino acid
  misc_feature (162)..(162): Xaa can be any naturally occurring amino acid
  unsure (1)..(179): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLKKGWIPCLEFELKHSFIYHKHNKSPEYYDRHYXPYXKLPIFNYTNTSHILKELQEAKTTYPNHFIHIIKFNNXVRQVQYIIFITYKPPSF

SEQ ID NO: 5876 - protein, 802 aa, Bacillus thuringiensis serovar konkukian str. 97-27
MFTHVESFKSAFLEKLETMYGKSFKDSTTRDQYNTLGYMVREYMNSQWIATNESYRSGERKQMYYLSIEFLLGRLLGSNILNLGIKDVCEQGLSELGISLQQLEEVEADAGLGNGGLGRLAACFLDSLASLNLPGHGCGIRYKHGLFDQKIVDGYQVEFPEQWLLHENVWEVRRHDQAVEVSYFGNVEPLYIDGRLEFRHTNAEVIMAVPYDVPVVGYETSTVNTLRLWNAEPVPFPQNCKDILKYKRETEAVSEFLYPDDTHDEGKILRLKQQYFLVSASLQNIVRMHRERYGDLRQLHEKIAIHINDTHPVLAIPELMRILLDEEKLAWEEAWHITTQTISYTNHTTLSEALEKWPIHIFKPLLPRIYMIIEEINERFCHELWERYPYEWHRIEEMAIIAHDLVKMAHLAIVGSHSVNGVAKIHTEILKQREMRLFYEFYPDKFNNKTNGIAHRRWLMKANPQLTNLISEAIGTEWKKEPIKLQELQLVQYDASFQEKFAEVKQERKEILAERIHNTMGITIDPNSIFDVQVKRLHAYKRQLLNVLHILYLYNRLKEDASFTFYPRTFIFGAKASPGYYYAKKIIKLINELARKVNNDPYVSQYMKVIFLENYRVSLAEDIFPAADVSEQISTASKEASGTGNMKFMMNGAITLGTLDGANIEIKDRVGDDNCFIFGLTAEEVLHYYQNGGYRASDYYHHNGHIKKVVDQLTNGFFAQSGAEFEAIYDSLVIQNDEYFVLRDFGPYAERQEAVGRAYENRTKWLEMSILNIAQSGHFASDRTILQYSNEIWGIGNTVTQI

SEQ ID NO: 5877 - protein, 403 aa, Pseudomonas fluorescens PfO-1
MQFSKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSLQALLNNGDEVLVPAPDYPLWTAAVSLAGGNAVHYLCDEGADWFPDLADIKAKITPNTKAMVIINPNNPTGAVYSKEVLLGMLELARQHNLVVFSDEIYDKILYDDAVHICTASLAPDLLCLTFNGLSKSYRVAGFRSGWIAISGPKHNAHSYIEGIDMLANMRLCANVPSQHAIQTALGGYQSINDLVLPQGRLLEQRNRTWELLNDIPGVSCVKPMGALYAFPKIDPKVCPIHNDEKFVLDLLLSEKLLVVQGTAFNWPWPDHFRVVTLPRVDDLDMAIGRIGNFLKSYRQ

SEQ ID NO: 5878 - protein, 521 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKSGIPNDIPGRENVREAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 5879 - protein, 508 aa, Burkholderia xenovorans LB400
MSHTSVGEAEVACGESEVVRTEKSTAALATRLVPVVLAGGAGSRLWPMSREHYPKQLIDVLGSDSLLQATVQRMEGFRADGSMVSAPIIVCGDEHRFVTSEQLRARGIDARIVVEPARRDTAPALTIAAADLCSEGDDAIIVAMPADHAIENLVAFHSAIAVAVQHAQRGAIVTLGVPPTRPDTGFGYIRLGSELGRGAHRIASFVEKPAAELAEQYLASGRYWWNSGIFAVRASVWLAMLRIMQPVMHDACVLAHAQGTHDGAYFRPGADAFKSSPADSIDYAVMERLGSDERFADGVVVPLDAGWSDLGSWDAVWEALDKDADGNAARGRVVFEGTTSSFAHSQGRLIACVGLTNVVVVETDDAVLVADRSRVQEVKSVVSRMRALQAPEVDAHRKVRRPWGYYDSIDHGERFQVKRIVVNPGGRLSLQLHHHRAEHWIVVSGTALVTRGNEEFMLSENQSTFIPLGVTHRLENPGKLPLELIEVQSGPYLGEDDIVRFDDTYGRA

SEQ ID NO: 5880 - protein, 514 aa, Yarrowia lipolytica CLIB122
MSSNTGQGPGIASPAPLTNGHTSQPSNTHQDAPVRPTLENGRSYINLDNLSKEKHLRTGSSSTIQEEEPSTRARRSASTSKPPLLVNQNQIQNHQHQQSQYNPQYQPPRVATPKRTPLFDSGQSYSQRFHNRSSSFSVRSARARSLSASSQEALKHLAPPVSVPLVVCCLMWYLSSAMSNTLGKAILTKFGYPVTLSQIQFLVAVCCGATTIQLSQMSPKFRQALPPGMVGPQGLIFPPTRDMLKTTAPMGCFQLSGHILSHMATGMIPVSLVHTIKALSPLFTVAAYRLLFNVQYSPSTYLSLIPLVTGVILTCSTSFRAQFMGIIYALLAALVFVSQNMFSKKLLTSGTTAGPGGPASATHTRKLDKLNILCYCTALAFLFTSPLWFFSEGWTLLKLFFRGEALVKDDSSLFVLMIQLLLNGVVHFAQNLLAFQVLSMVSPVTYSVASLLKRIVVIVWAIIWFGQSVSGIQGFGIFLTFTGLYLYDRCGGDKKKGGQGSSVDGTEKDAQLPK

SEQ ID NO: 5881 - protein, 270 aa, Clostridium tetani E88
MEKSIGFIGCGNMAQAMITGIVTSKIVKGKNVFVSDRDEEKLKYIKDNFNVNTSKSNEEVAEKSDIIILAVKPNKYGEVIEGIKDYVKKDVIIVVIGAGITIDYVEESFKKKLKVIRTMPNTPALVGEGMSAICYNELVEEYDLKVVVDIFKSFGKVEIIEENLMDAIPAISGSSPAYVYMFIEALADGAVLDGVPRDKAYKMAAQSVLGAAKMVLETGEHPGELKDRVCSPAGTTIEAVYSLEKNNFRGTVMEAMRKCTDKTREMSKRN

SEQ ID NO: 5882 - protein, 260 aa, Oryza sativa (japonica cultivar-group)
MAMKRTMKVVFSLALLLLPLASVAEEFDFMYLAQQWPDSYCSTHKCLVKPPPPSHFTIHGLWPSYNKLIDGKMWLEDCNKEDPLDPTQIQDLEKQLDQKWPSLKQTNLEFWSLEWKKHGTCSNLGQHAYFEAALALERLTNLTKILADGGVGPSDVKTYTFREISDALARGTGFRTYFKCSKNKAGDTLLSEVRQCVDRYGEKLINCTALSFDYCDNADKIKMPQSGYMISSSTSYNLAATRSIYIIMHLYLLGVMHVYY

SEQ ID NO: 5883 - protein, 450 aa, Zea mays
MRRVGTGVRMLCGAALSVLLLLAGGAAASHSRSSCPATPPDAGNTLQVSHAFGPCSPLGPGTAAPSWAGFLADQASRDASRLLYLDSLAVRGRARAYAPIASGRQLLQTPTYVVRASLGTPPQQLLLAVDTSNDASWIPCAGCAGCPTSSAAPFDPAASASYRTVPCGSPLCAQAPNAACPPGGKACGFSLTYADSSLQAALSQDSLAVAGNAVKAYTFGCLQRATGTAAPPQGLLGLGRGPLSFLSQTKDMYEATFSYCLPSFKSLNFSGTLRLGRNGQPQRIKTTPLLANPHRSSLYYVNMTGVRVGRKVVPIPAFDPATGAGTVLDSGTMFTRLVAPAYVAVRDEVRRRVGAPVSSLGGFDTCFNTTAVAWPPMTLLFDGMQVTLPEENVVIHSTYGTISCLAMAAAPDGVNTVLNVIASMQQQNHRVLFDVPNGRVGFARERCTAA

SEQ ID NO: 5884 - protein, 417 aa, Coxiella burnetii RSA 493
MAEVRNYTFNFGPQHPAAHGVLRLIVEVDGEVIQRIDPHIGLLHRATEKLAESKPYNQTIGYMDRLDYVSMMANEHGYVLAIEKLLGIEPPIRAKYIRTMFDEITRILNHLLWLGAHALDVGAMTVFLYCFREREDLMDCYEAVSGARMHATYYRPGGVYRDLPDSMPKYKPSRWHNEKAVKKMNEAREGSLLDFIWDFTARFPNLIDEYESLLTDNRIWKQRTVGIGVVSAERALQLGFTGPMLRASGVEWDLRKKQPYAAYDRVDFDIPIGREGDCYDRYLVRIEEMRQSNRIIRQCVEWLRKNPGSVMIDDYKIVPPQREVMKRDMEALIHHFKLFTEGYIVPEGEAYAAVEQPKGEFGVYIVSDGANKPYRVKVRAASYPHLAAMNEMCRGHMIADLVAIISSIDIVFGEIDR

SEQ ID NO: 5885 - protein, 786 aa, Alkaliphilus metalliredigenes QYMF
MLNKRKFKESVERNIRVNFLKTIKTASGQERYHAVVKTLMEEVVTHWQETNERHHNKKKACYFSAEFLMGRAFGNNLLNLGIYEEVKEVLNELEIDIDEVEKAEADAGLGNGGLGRLAACFLESCATMNLPVTGYGIRYHDGIFKQRFVDGFQVEEGDPWLAHGEPWSFRRSEDAVTVVFGDESVKAVPYDTPIIGYGNQTINTLRLWQGEPLINFDFNLFNEQRYDESVKEKNRAEDISRVLYPNDSKEEGKILRLKQQYFFVSASLQDLVKKYKETNGNEFEKFHQYHAIQLNDTHPVVAIPELMRILTDEEGLCWEKAWGITTKTFSYTNHTILTEALEKWDVKLYQKMLPRVYEIVKGIDEQFIEFLNEKSYEKKKIDQMKIISNGRINKAWLAIYGSHTINGVAEIHTNILKHKELKDWYELYPQKFQNKTNGITPRRWLALCNQELSALITALLNTEDWITDLSQLKKLEKHQYDDEVLKRFMAIKRTKKKQLAAYIFKKEGIQIDPNSIYNIQIKRLHEYKRQLLNAFHILDLYYELKENPDIQRTLRTFIFGAKAAPGYVRAKGIIKYINEVAKLVNNDPQMKDQMKVAFVENYNVSYGEKLFPAADLSEQISTVGKEASGTGNMKFMLNGSPTIGTNDGANIEIVQEAGEENNFIFGMKIEELQAMEDTYEPRAYYESVPGLKRVVDTLIDGTFDDGDTGMFQELYDSLLEGASWHKPDNYYLLKDFDDYREAQRKAEIAYADEIAWARKCWMNIANAGKFSSDRTITEYAKQIWHI

SEQ ID NO: 5886 - protein, 569 aa, Thiobacillus denitrificans ATCC 25259
MHGTDLITTIAAALGMALVFGFLAVRVKLPALAGYLLAGIVIGPFTPGFVADTALASELAEIGVILLMFGVGLHFSLDDLLSVKKIALPGAIVQIAAATAMGAALAAWWGWNLTAGIVFGLSLSTASTVVLLKALESRGILATPNGRIAVGWLVVEDLAMVLVLVLLPPVAEIASGNSAASPGSLAGTLALTVGKVAMFIALMLVVGRRFFPWLLWQVARTGSRELFTLCVVGAALGIAYGSSALFGVSFALGAFFAGMVLRESALSYRAAEESLPLRDAFAVLFFVSVGMLFDPRVLVEQPLQVLAVVAIIVFGKSLAAFLLVLAFRYPLNTALTVSASLAQIGEFAFILVGLGVALGMLPVQGQSLILAGALISIALNPLVFRAVEPVQAWLRRHSARARRLESPDDPLAELPADVAADTLTDHIVLAGYGRVGRRIADALDAEGLPYIVAEQQREAVEKLRGRGHKAVVGDASDPGVLIQAHVARARLLVIATPDSFRARKMIEIARTLNPAIRVVVRSHSVDEAALLRREHAADVLVGEEELAQSMVLRVRAHARQAGADVFAQP

SEQ ID NO: 5887 - protein, 255 aa, Coxiella burnetii RSA 493
MQRRPLVAGNWKMHGSRESVGQLLRALKHGCERLETAELAVFPPFVFLQQCEEALMRTQISWGAQDVSEFERGAYTGEVSAAMLRDFHCRYVIVGHSERRQRHGETNEQVAAKVRAALRCGIRPIICVGETEKQRNANQTLSVIKEQLAVVLQMNDNLASLEGMVVAYEPIWAIGTGKNATPSQAEEVHAALRDQLHRQDATLAESTRLLYGGSVKPDNAAALFEMPNIDGALVGGASLEAEQFLKIGQQCNQSF

SEQ ID NO: 5888 - protein, 273 aa, Nocardia farcinica IFM 10152
MQSPSSDASRRPPLDVTRLRRGVESPELSLFSRVAVVEATGSTNADLIARASDPGAAGTVLLAETQQAGRGRHARSWTSPPRAQIAMSMLVRPRGLEPAVLGWLPLLTGVAVVDALRAAAGVPAELKWPNDVLIGGRKVAGILAEVAASGGTPAVVVGVGVNVSLSAAELPVPHAISLELAGAAQVDRTAVVLAILAEFSRRFDAWRQAGWDTTELAAAYRERCATIGAQVMAELPGGRTLTGIATGIDDAGRLLIGDDAVSAGDVTHLRGQY

SEQ ID NO: 5889 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 5890 - protein, 621 aa, Actinobacillus pleuropneumoniae serovar 1 str. 4074
MAIDISHLDNPELAKIVALLATSITIVPLFKRIGLGSVLGYLVAGCLIGPSVLGLIQDPQAVVHLAELGVVMFLFIIGLEMHPELLWSMRKAIFGRGFLQVATCGVLLTLAGIYILGLTKEVAFIAGAGFTLSSTAIVMQVLEDKGIASTQKGQRIVSTLLFEDLAIVPLLATIAFLAPEQANEEKTFSLTSIGIAIVGIIILVVGSKWVMNPLFRMISKAKVREMMTAAALLVVLGAALLMEMSGLSMAMGAFVAGVVLSESSFRHQLEADIEPFRGLLLGLFFMGVGMSLDLNFVFNDLIWLLSIVAVCVLGKAFGVYIIALITRLPHREALMRTSIMSHGGEFAFVLFSAAAAAGLLDQDQQATFTAAVIVSMLISPLVMLLMQRMVARKASVEAPNMMGIEIAEDLENSVIVIGFGRFSQIVCQALLARGITVTVIDSSTDRIRAAATFGFKVYYGDGTRLDVLRASGLEKADCVVLGINNPARSALIVEQIKNEYPLTPIFARTYDRHSAIELTKLHVDFQIRETLESALVLSKAAMMKLGVDEVEATEIVENVRLLDRERFKEELIYGTSAELIRKYFTPKPFFKPQQEAEALNEDAAEILAEEAVESNAESKEK

SEQ ID NO: 5891 - protein, 404 aa, Haemophilus influenzae Rd KW20
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 5892 - protein, 133 aa, Medicago truncatula
MILDKKNIEETHYEVLNVKEDANYEEIRASYRSAALNLHPDKLLKTSDASRSNQTTSERFLKVHKAWEILSNSTSRLIYDKELKSSRREDFLASEVAEELRLQDMTVEDAGETLELFYQCRCGDYFSVDSLEL

SEQ ID NO: 5893 - protein, 628 aa, Neisseria polysaccharea
SPNSQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQDLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 5894 - protein, 468 aa, Agrobacterium tumefaciens str. C58
MLQQNCKWRAQIACLPPGQGFYGSMLSSSNTPLTGPNDRQTSIAFFERASTVFPGGVTRATIELDPHPIFVAYGEGAFVTDVDGHRMLDLNNNFTTLIHGHAYPPITEAIAGLLRTGSCFANPMNHEIDLAELLVGRIPAVEQVRFVASGTEAVMFAIKAARATTGRVAIARVEGAYHGAYDWAEAGQHASSNTPCAAYPGMPASVIDDVVLLQFNCPAELEQQIAMNAGRLAAILIDPMPSRAGLIEPTEEFIATINKVAKQHGIVIIADEVLNLRQGFAGASARYGLKPDLVTMGKIIGGGFPIGAVGGRREIMSAFGKQGSKAPLTQGGTFAANPVSMVAGRLAMEALTQDAFQRLEHMGNLVREGLRSRIERHGANLSVTGAASLFRIHAKKVAPVSYQDSIPTASEDVVLKLLRRHFANNGILMPYGAAASLSTPMTDNDMGDIVSVFDDFLVNLDRHAWEAA

SEQ ID NO: 5895 - protein, 251 aa, Triticum aestivum
  misc_feature (170)..(170): Xaa can be any naturally occurring amino acid
  unsure (1)..(251): unsure at all Xaa locations
MHKLGRGSRDKVQQFMAITGASEKVALQALKASDWHLEGSFDYFYSQPQISVTNSRHLEDLYSRYKERDADMIMVEGTSQLCNDLLVDPQDVVMLVISWHMKAATMCEFTRQEFIDGLQSIGVDSIEKLREKLPSLRAEIKDDNKFREIYNFAFAWAREKGQKSLPRETXPIGMWRLLFAERHWPLIDHWCQFLQVRHNKAISRDTWSQLLEFVKTIDPQLSNYDEEGAWPYLIDEFVEYLTENGCVQRNK

SEQ ID NO: 5896 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLASETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 5897 - protein, 345 aa, Bacillus thuringiensis serovar konkukian str. 97-27
MKAVVVNKNSKANIEVVEKELRPLHSGEALVDVEYCGVCHTDLHVANHDFGNTDGRILGHEGVGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGSADKIIQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKQHNCDCK

SEQ ID NO: 5898 - protein, 300 aa, Mycobacterium sp. JLS
MTKWTTADIPSQSGRTAVVTGANTGLGLETAKALAARGAHVVLAVRDTEKGKRAADEIAAAHPEAAVSVQSLDLGSLRSVRAAAEALKADFPRIDLLINNAGVMYPPKQTTEDGFELTFGTNHLGHFALTGLLLENVLAAPNSRVVTVSSQGHRIRAAIHFDDLQWERSYSRVGAYGQSKLSNLLFTYELQRRLDTRDAIAVAAHPGVSNTELMRHLHLPSVFNPLVGVLTQSPTMGALPTLRAATDPTVRGGQYFGPSGLGEIRGYPELVTSSAQSRDVDLARRLWTVSEELTGVAFPL

SEQ ID NO: 5899 - protein, 785 aa, Oryza sativa
MEASSWLCYQARGFGSSRVWLWLLLALVLLNCSLVLSASPYLVGMGSFDITGPAADVNMMGYANTEQIASGIHFRLKSRAFIVAEPNGKRVVFVNIDACMASQIVTIKVLERLKARYGDLYNENNVAISGIHTHAGPGGYLQYVVYIVTSLGFVRQSFDVIVDGIEQSIVEAHNNLRPGKIFVNKGDLLDAGVNRSPSAYLNNPAEERSKYEYNVDKEMTLIKFVDDELGPVGSFNWFATHGTSMSRTNSLISGDNKGAAARFMEDWAEQMGLPKQSAHANSDDLRSLHKTSVLPRRVSTIIPEPNEITDDLIQLASSYEASGGRRLAGSSITRRIRSTQQNKPKFVSAFCQSNCGDVSPNVLGTFCIDTNLPCDFNHSTCNGKNELCYGRGPGYPDEFESTRVIGNRQFLKARDLFDSASEEIQGKIDYRHTYLDFSKLEVKVSTSAGGQQTVKTCPAAMGFAFAAGTTDGPGAFDFRQGDVKGNPFWKLVRNLLKTPGKDQVECHSPKPILLDTGEMKEPYDWAPAILPVQMIRIGQLVILCVPGEFTTMAGRRLRDAVKTVLTSGNSEFDKNIHVVLAGLTNSYSQYITTFEEYQIQRYEGASTLYGPHTLSAYIQEFQKLAMAMIANKEVPTNFQPPDMLDKQIGLLPGVVFDSTPLGVKFGDVNSDVPGNSTFNKGSTVNATFYSACPRNDLLTDGTFALVEKLDGNNNWVPVYDDDDWSLRFKWSRPARLSSRSFATLEWTVPEDAAAGVYRLRHFGASKPMFGSVRHFTGTSRAFAVR

SEQ ID NO: 5900 - protein, 231 aa, Thermotoga maritima MSB8
MIGEKIISFESIDSTNRFLKENYRFYPDGTVVVALEQTSGYGRSGRHWHSPKGGLWFSVLFKPRKPLELSFYTRVFSVAVVKTLENMKIHANIKWPNDVYINGRKLAGVLSEGIFEGAKPLAVVVGVGMNVNNEIPAELKTRAISLKEIMGKEISIVKLMESMLKNARVIFRKYSRKKEALTRIWKRYLLQKEGDLISLEGKKGKIVKINPDSLLIDFDGEIKKVYSLSPH

SEQ ID NO: 5901 - protein, 454 aa, Vibrio vulnificus CMCP6
MTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYSEFCQKLVAKVSALKVGNGFDQGVHIGPLINDAAVAKVVQHVEDAQSKGAQIECGQLPTAGSRLVQPLVLSGVTDEMLVAQEETFGPMAPLFVFDSEEEVLARANNTDFGLAAYFYTQSLSRAWRMSEALEAGIVGINEGLISTTVAPFGGVKESGLGREGSFLGMDDYMESKYILMGL

SEQ ID NO: 5902 - protein, 162 aa, Pyrococcus abyssi GE5
MVSMCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 5903 - protein, 430 aa, Pyrobaculum aerophilum str. IM2
MAALGVLAHAVWRGAAEIYRLKMDNLSLFMRTEEYGLILKEERLEGGRRVLDIFWGPQHPSSGHTRFIIEVDGDVVVNVTPDPGYVHRTMEKLGETRHWIQNIPLFERLSLPDAINVTWAYALAIERLAKYDVSPRAQYLRVIMGELSRISTHLYDLGLHAIMIGSSTGFMWAYGLRELLVQLWAMASGSRTTPTWVLPGGVRTAPPDAFYEQTRGFLDYLEKKVDEFMRVVVKNPVGYYRLKDVGYLSKEDAARLMATGPGARGSGIEWDARRAYKYGVYDEFEWEVCVEDGGDALARTMVRICEIRQSARIIRQALDRVPRDGPLVGEALLHRIPPKQREKANELIRLGALFTTMLPQGEGVGVTEGGRGRYYFQVFGDGTEKPYRVRISTPSWQNLRAMIRAFIGARLMDLPAIYGSFGYFPPEQDR

SEQ ID NO: 5904 - protein, 489 aa, Neurospora crassa
MMSAGPAHHQLPITQAQIQQESHRREAVNHLAKLRSRKPTDKTLPDGVEETLVGEGDVAVAYKKLRDFERRLDATMSRKRLDIVDSVSRNAKRYKTLRVWITNSVEDQYWQNNNFNVDSFDFPSNLESTYRVKIEGRLLDDEDETTKDEEDGDKMDTTDDSTKTATKSGAKPVPAKPGQRYRFSHFFKALTVDFDQPTASGRLPVDTTAIEWKKPERTPAGSNLPASADFDELTFKRHGDENVNITINLYRHEDPERYELSPELSDVIDMTEATRQEAVAGLFEYIKLMKLQEDDEKRNFRCDDLLQKLIGRESGHIPQLNEYVTPHLRPLPPIKLPYTIRVDQEFHSAPDAPKPTIYDIRVSVDDPLRSKHLVPFIHNPSYAQTLREIHQLDESLAVLIQAVGDSKAKHTFLTSMANDPVGFVKNWLSSQKRDLEVIMGEATRAGAAAEDPVGDEWRRGGKGSVWDTSNARESVNVLLSKQGFTAGHR

SEQ ID NO: 5905 - protein, 258 aa, Brassica napus
VDPRVRHVFHLVTDKLNFAAMNMWFLLNPPGKATIHVENVDEFKWLNSSYCPVLRQLESAAMKEYYFKADHPSSGSSNLKYRNPKYLSMLNHLRFYLPEVYPKLNKILFLDDDIIVQKDLTPLWEVNLNGKVNGAVETCGESFHRFDKYLNFSNPHIARNFNPNACGWAYGMNMFDLKEWKKRDITGIYHKWQNMNENRTLWKLGTLPPGLITFYGLTHPLDKSWHVLGLGYNPSIAKKDIQNAAVVHYNGNMKPCWS

SEQ ID NO: 5906 - protein, 623 aa, Oryza sativa (japonica cultivar-group)
MLEKKATRSTRVDGVSGEAVIEEFERVTRDAANVQRETLRRILAENGGVEYLRGLGLAGATDPATFRARVPLATHADLEPYIDRIADGDASPVLTAKPATSISLRSVSPPAAACCSLTSIENVADHGGDHLTAGACSSGTTQGKRKYLLFNEELVKSTMQIYRISYAFRNREFPVENGKALQFIYSSRETRTKGGLTATTATTNVYRSEEFKATMRDIQSQCCSPDEVIFGPDFAQSLYCHLLAGLLAAGDVQIVSATFAHSVVLAFQTFERAWEDLCADIRRGEVSPSRVTSPAVRRAMAALLAAPNPGLADEVARKCAALSNWYGVIPALWPNARYVYGIMTGSMEHYVKKLRHYAGGLPLVAAEYGASEGWVGANVEPGTPPERATFTVLPDIAYFEFIPLKPVAGDGGYAEAEPVGLTEVAAGELYEVVMTTFAGLYRYRLGDVVKVAGFYNATPKLKFVCRRNLMLSINIDKNSEQDLQLAVDAAARAVLAGEKLEVVDYTSHADVSSDPGHYVVFLELNAADPAAVDGDVMQACCDELDRAFADAGYVGSRKSGAIAPLELRVLQRGTFQKVLRHYLSLGAPVSQFKSPRCVSRSNSGVLQILAGCTVNVFFSSAYD

SEQ ID NO: 5907 - protein, 532 aa, Prochlorococcus marinus str. MIT 9313
MRRLMTKVLVSDPIDQAGIDILAQVAQVDQRVGLSEDDLKAMIGDYDALMIRSGTQVTADVIKAGARLRIIGRAGVGVDNVDVPTATQQGVLVVNSPEGNTIAAAEQALALMLSLSRHVPQAHASTMAGGWDRKKYVGNELYKKVLGVVGLGKIGSHVARVCNAMGMEVIAYDPFISADRAQQMQVRLSSLENLFEQADYITLHLPRTPDTENLVNAELLGKMKSTARLVNCARGGIIDESALADALTAGVIGGAALDVYAQEPLATDSPLRSVQERLILTPHLGASTTEAQENVAVDVAEQIRDVLLGLPARSAVNIPGLSAEIMERLKPHLQLAETLGLLVSQLSGGQLQELEVRLQGEFAQHPSQPLVIAALKGVLSSALGDRINYVNASLEAKGRGIRVLEVKDETSKDFAGGSLQLTTRGDQGGHSVTGAVFANGDLRITTIDEFPVNVSPSRHMLLTRHRDMPGIIGQLGSVLGEHNVNIASMQVGRRIVRGDAVMVLSIDDPIPPSLLVTIHAINGIKEAHPVTL

SEQ ID NO: 5908 - protein, 310 aa, Xanthomonas campestris pv. campestris str. ATCC 33913
MASATRHRPPDTSAVSFLLLDGAAMTQPSSSTAVAAHGDVPVVAFVGGGNMARSLIAGLLRQGAPASAIRVAEPVAELRQALSADFGVQVFDDARSAVEGAALWVLAVKPQVMSTVCTQLADLAQQQHPLLLSIAAGITATQLERWCGGTAAVVRAMPNTPALLGAGVTGLYANARVSAAQRTQATRLLESAGVTVWLDDEAQMDAVTAVSGSGPAYVFLLAEAMEAAARAQGLPAETARTLVLHTLLGAARMLTESGEAPEVLRRRVTSPNGTTQAAIEEFQAGGFEALTATAIAAATERGRSLSAAND

SEQ ID NO: 5909 - protein, 298 aa, Neurospora crassa
MDDRELAARIKALSKAVTSEPPATVIKLLEELKRDAKPTEEQLRSTKAGVTVGKLRANPNKDIARIASEIVNKWRKLVEAAKEAKKKSQAAAASGASSPAPNASPAPASSAYNKPYTGDVEKRHFKTDKVDINRTSSQTRNNTIGVLYNGLAYRRTESIEEVVKRAVEVENALFKACKGENQEYRSKGRTLFTSLKRKDNAALGRRVMSGELPVERLVVLSDKELASEEQRARDEELEKENMKKAQVPMAEKSISDALKCGKCGQRKVSYSQAQTRSADEPMTTFCECTVCGNRWKFS

SEQ ID NO: 5910 - protein, 252 aa, Synechococcus sp. WH 5701
MIGRIQAARLHPGAQLVPAPPAPRLPWRLLWWPCCGSTEQRLEQDLVSGGQPPLALLAGHQRFGHGQRGRPWISPPGGVWLSAALPWPAEPSTSAALGLAVAVGLALQLEALGLTVQLKWPNDLLVDGHKLAGLLPRLSLRGGVIRLARVGVGLNGHNRVPPGAISLREALGRRTTASEVPSLAARVLTALEWAVFRSTSPELVLRLAQHRLLVPEGGVAFRQERWQVEGLSVDGGLVLSRAGERIVSRRSF

SEQ ID NO: 5911 - protein, 325 aa, Bacillus halodurans C-125
MKLVDSIYGTYTVEPVISELIDSAPVQRLKGIHQGGACYIVKPSWNVTRFEHSIGVMLLIRKLGGSLEEQIAGLLHDVSHTAFSHVIDYVLAEEEEDYHEQIYEQVIRASEIPHILDKYGFDLERIVLNHSCWTLLEQPSPSLCADRIDYTLRDLYTYGHINKQEVDDFIANLIVVDGIISTSSVAGAEWFVRAYYKEVIDFFLDPLNVYGSSVLTSVLKSAVERKALGLDDFLKTDEELMEQLQRLNDDSIQKQLATLHPHVNVRENENHYHIHKTNKLRLIDPHVYLDGTFQRISSLSKQVKKWNEEAQRRADRGAYVEVLSS

SEQ ID NO: 5912 - protein, 333 aa, Wolinella succinogenes
MSPLRIAINGFGRIGRSVARVIAQRSDVELVAINDLASPETLAYLLRHDSVHGAFPHEVSWEGNRFYIGKKEVLLYQERDPQKLDFSAASPEVVIESTGLFLTQELVKHHLQKGVKRVIFSAPAKDSTPTYVLGVNHERYQGEPIISNASCTTNCLAPLAMLLDEAFGIEKGIMTTIHAYTNDQNILDTAHRSDFRRSRAAAINMIPTTTGAAKALGLVLPSLQGKLHGHSVRVPTPDVSMVDLNVKLAQKSSAQAINELFMEASQGRLKGILGMDKDFGVSLDFQGDPRSSIVASDLTFVIEGDMAKVMAWYDNEWGYSNRLVDMARFITSL

SEQ ID NO: 5913 - protein, 489 aa, Agrobacterium tumefaciens str. C58
MRERSMIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQEAVAKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 5914 - protein, 339 aa, Cryptococcus neoformans var. neoformans
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGSAKKVVISAPSADAPMFVCGVNLDAYKPEYQIVSNASCTTNCLTPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 5915 - protein, 371 aa, Kluyveromyces lactis NRRL Y-1140
MSESNELRKRQAEFTKELHGNNVTKSGFSALVSKNKSAQTEAVAKYLKHWDGKTDADAERRRLEDYNESTHSYYNVVTDFYEYGWGSSFHFSRFFKGESFSASVARHEHYLAYKAGIKENDLILDVGCGVGGPARTISRFTGCNIIGLNNNDYQIQKANYYAKRDHLDSKLSFVKGDFMKMEFDENTFDSVYAIEATCHAPTFEGVYGEIYKVLKPGGTFAVYEWVMTDKYDETNPEHRKIAYEIELGDGIPKMYSVDAARDALSKVGFEILEENDLADNDDEIPWYAPLTGEWKYVNSVADLATFFRTSRLGRAFTTSMVTVFEKLGLAPKGSVSVTNALEEAAVGLVAGGEKKLFTPMMLFVAKKPEQK

SEQ ID NO: 5916 - protein, 306 aa, Mycobacterium sp. JLS
MSANTKWTAADVPDQEGRVAVITGANTGIGYEAAAVLAAKGAHVVLAVRNTDKGGAAAERIRSALPHADVTVRELDLTSLDSIRAAADGLRADYPRIDLLINNAGVMMTQKGTTKDGFELQLGTNHLGHFALTGQLLDNLLPVEGSRVVTVSSNAHRWGRVNFDDLQSERSYNRVTAYGQSKLANLLFTYELNRRLSAKGAPTIAVAAHPGTSSTELTRNLWPVARRPVELVWGLVSQTPEMGALPTLRAATDPDVRGGQYYGPDGIGEQRGHPKLVQSNARSYDEAAQRGLWSVSEELTGVTFPV

SEQ ID NO: 5917 - protein, 482 aa, Salmonella enterica subsp. enterica serovar Typhi
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGILAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 5918 - protein, 466 aa, Salmonella enterica subsp. enterica serovar Typhi
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALSKVIAILAFIALGAAAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 5919 - protein, 780 aa, Mycobacterium sp. JLS
MTNRGSAARSAAPPVARSGAPNRTAVRWPGWVCANRAGDMTEAGLSEREPNLSHLRLTARLNTAALDSRRGVVRLHPEVIAALGIREWDAVSLTGARTTAAVVGIAPPGTPTGTALLDDVTLSNAGLPENSSVIVAPVTVYGARSVTVSGSRLATNSISPATLRQALLGKVMTVGDTVSLLPRDLGPGTSTSSATTALASSVGITWTSELLTVTSVDPPGTVSIQPNSSVTWGDGPAPKAASARPTDGAAVGEATVTTPSVDRPAVSFDDLKGSHAQAGRLTEWLKLSLDEPSLLETLGATAHLGVLVSGPAGVGKATLVRTVCAQRRLVELDGPEVGALHAEDRLNRVSSAVSTVRDGGGVLLITDIDALLPATPEPVGTLILTELRTAVATPGVAFVATSARPDGVDARLRDPDLCDRELGLSLPDAATRKELLEVLLRSVPAQELHLDEIAGRTPGFVIADLCALVREAALRAAARASADGAPPQLTQADLTGALTVIRPLSRSATEEVSVGSVTLADVGDMTETKQALTEAVLWPLQHPDTFERLGIEPPRGVLLYGPPGCGKTFVVRALASSGRLSVHAVKGAELMDKWVGASEKAVRELFRRARDSAPSLVFLDEIDALAPRRGQSFDSGVTDRVVASLLTELDGIEPMRNVVVLGATNRPDLIDPALLRPGRLERLVFVEPPDAEARREILRTAGKSVPLADDVDLDTLAAGLDGYSAADCVALLREAAMTAMRRSIDAADVTAADVEAARQTVRPSLDPLQVDTLRAFAENR

SEQ ID NO: 5920 - protein, 147 aa, Oryza sativa (indica cultivar-group)
MASKRIQKELKDLQKDPPTSCSAGPVGEDMFHWQATIMGPSDSPYRGGVFLVTIHFPPDYPFKPPKVAFRTKVFHPNINSNGSICLDILKDQWSPALTISKVLLSICSLLTDPNPDDPLVPEIAHMYKTDRHKYENTARTWTQRYAM

SEQ ID NO: 5921 - protein, 562 aa, Zea mays
  misc_feature (246)..(246): Xaa can be any naturally occurring amino acid
  misc_feature (308)..(308): Xaa can be any naturally occurring amino acid
  unsure (1)..(562): unsure at all Xaa locations
MPSIAPPSSSVAALTRQPVQFFKGCSVSKETKGPVRSFFTANSKSTKVKSAGLKVASSFKNDGGYPAGGVSWKDDTLLPKSTTIRGQDHPVADPVLPMDSMITPEILSANVERVIDMFADDDTDTELDLDSPTEGFASIAEAIEDIQQGKLVIVVDDESRENEGDLIMAASLVTPEAMAFIVRHGTGIVCVSMKEDDLERLSLPLMVTTKENEEKLCTAFTVTVDAKEGTTTGVSAKDRAKTVMTXLKRAGHTEASVDLAMLAGLPPVAVLCEIVDDADGSMARLPKLHVFAEKENLKIISIADLIRXELNYQNFSFWYRRKRDRLIERASVARLPLKWGNVHAYCYKSVIDGIEHIGMVKGDIGDGQDILVRVHSECLTGDIFGSARCDCGDQLAMAMEMIEKAGRGVLVYLRGHEGRGIGLGHKLRAYNLQDDGRDTVEANEELGLPVDSREYGIGAQILRDLGVRSMKLMTNNPAKYSGLKGYGLSIAGRVPLITPITSENRRYLETKRTKMGHVYGLANAQANQANKWQPEHRRESLGPQACFHYYSSNPAWCGGTKE

SEQ ID NO: 5922 - protein, 337 aa, Photobacterium sp. SKA34
MTDIRTLGEFIVEKQSDFPHASGELSSLLGSIKLAAKIVNREINKAGLVDITGTVGENNIQGEEQQKLDVYANDKFKAALEARDQVCGIASEEEDEAVGFDKPLNLNAKYVVLMDPLDGSSNIDVNVSVGTIFSIYRRVSPVGSPPTKEDFLQTGNQQVAAGYVIYGSSTMLVYTTGNGVHGFTYDPSLGSFCLSHENMTIPQDGVIYSINEGNYIRFPTGVKQYIKYCQEAVPEEKRPYTSRYIGSLVADFHRNLLKGGIYLYPSTASYPNGKLRLLYECNPMAFIIEQAGGKATDGFQRILDIEPTELHQRVPFFVGSTNMVEKVESLLRDYPEN

SEQ ID NO: 5923 - protein, 146 aa, Yarrowia lipolytica CLIB122
MWFLNLTVHYTTTSDVTTTGDECLVYATNKAPIGLTGIYQHPNPRPALIALYEATLKELQDKHPKDSVYRQSIENLTAHRKQIVEDNEVSEVIENKIGAGLIEEVVIQAHEELELAKKMSEWKPWEELEEKPLEDQWVYFNKKGVE

SEQ ID NO: 5924 - protein, 279 aa, Glycine max
MRLVLRRNQQSAIRSERDMEGIEGNSSRYSLKPSRICNEDVLICVDVDPQCLVEMKGATGPNGRPLTRLDSIKQAIVLFVNAKLTINPEHRFAFATLSNTLVSWVRKEFSSEIESTLAAMRVLSASSSSSTTAGQPDLTHLFRLAAHEAKKSRLQGRILRVILFYCRSSERPKHQWPVNQKLFTLDVMYLHDKPGPDNCPQEVYDTLVEALEHVSEYEGYILESGQGLARVLFRHVLILLSHPQQRCIQEYVDIPKSIAKKPPQVEPMATEDSAPISSQ

SEQ ID NO: 5925 - protein, 840 aa, Pyrococcus abyssi GE5
MILGRSEPQKDEIKLRVAEALKRDVGRGIVRFDRKYQRMIGVEPGDIVEIEGERITAAIVANPHPDDRGLDIIRMDGYIRKNAGVTIGDFVTIRRAEVKEAKKVVLAPAQKGVIVQIPGDIVKNNLLGRPVVKGDIIVASGRSEMYYSSGTPFDEIFRGFFEAMSVGFGELKFMVVNTIPKGIVQITYNTEVEVLPQAVEVREEKIPEVTYEDIGGLKEAIEKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKSRGKVIVIAATNRPDALDPALRRPGRFDREIEVGVPDKQGRKEILQIHTRGMPIEPDFEKETVIKALKELEKDDRFDKEKIKKIIEKVSKAKSEEEIKDILREDRNLYIEVRTKLIDKLLDELAEVTHGFVGADLAALAREAAMVVLRRLIKEGKINPEAETIPREVLEELKVTKADFYEALKMVEPSALREVLIEVPNVHWDDIGGLEDVKQELREAVEWPLKYPKAFKRLGITPPKGVLLYGPPGTGKTLLAKAVATESQANFIAIRGPEVLSKWVGESEKRIREIFRKARQASPAIIFIDEIDAIAPARGTAEGEKVTDRIINQLLTEMDGLVENSGVVVIAATNRPDILDPALLRPGRFDRLILVPAPDEKARFEIFKVHTRGMPLADDVDLKELARRTEGYTGADIAAVCREAAMNALRRAVAKLSPEELEEESEKFLKSLIVTRKDFEVALKKVKPSVTKYMMEYYRQFEESRKRMVGESTGREPDYFTG

SEQ ID NO: 5926 - protein, 322 aa, Oryza sativa
MAMATIPEVPASALLPTMPRIGMGTAAFPFTSSEETTAALLRAIELGYRHFDTARLYATEGCVSEAVAEAVRRGLVASRADVFVTSKLWCSDLHAGRVVPAARETLRNLGMDYVDLLLVHWPATVAPGSYDFPFPKEEMAPAFDMEGVWRGMEECHRLGLARAIGVSNFSAKKLEQLLSFAVVRPAANQVEMNPMWQQRTLREVCRREGVQLCGYSPLGAKGTPWGSAAVMDSGVLHDIAQTKGKTLAQICLRWMYEQGDVLLVKTYNENRMKENLDIFDWELTEEERDKISKLPQQRGLTGMQFVCDNGPYKCVEDLWDGA

SEQ ID NO: 5927 - protein, 394 aa, Xanthomonas axonopodis pv. citri str. 306
MDSLLQYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGRHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIALFEARRAEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 5928 - protein, 737 aa, Neurospora crassa
MSGAGQPSIPSSSMTTSTLTPASAASSTNTYIMPNSPFKNRGDGYRPKVTRTLGQRPACLVNASVTYCGNNQIYAFGGFDQYTDEVYNHVLRLDLVSHQWSLVDNYGDIPGVRMGHTATLYKGDKLLVFGGENEHRTYLSDLIIFDLKTAHWTQPQVTGPIPKGRARHAAVLHQDKLFIIGGITGHDNYVLDDICYLDLKTFTWSRSWRFVGRFDHSAYIWGERVWVFGGLSEEMDKVSDIWWLDLKGSPAFDSPPQIGSMDRSGMARSAISPRPSYPAAQSPIVGSSGYAANSRTAQVNPPSFHLKTYAPPAPGAVSALKFVNGPNVPSQGQGIHFHVYSSGTLLDFVTPAATISSKECSLSALDLGSLRWQKLADGREIFKPGYRWHYCTMNEDGTKAWLLGCPTEPNVLDHGGTGLEEYLSDIMEIDLRRYGFLGNNFAPEPRADFTRPSSRARHIEQPSKGLGCDLAKLFDQPPETGSGTDFIVTALSREYDEDEIIGSALVHTSDSMDGDQTWLSPDAPTSPPIHVHRLILQARWPHFARLWSSQMAEFHTKKMHIPEPYSVVKAFLYYLYTDRIDPGSEEDESITADLSDVAGLLVMSNIYNIPHLRLLCVNRLAKELDVDHACIIWYCAGMANEEWLRKRAATFCMTHWGRVVRTLGFQRLPRAALVELSQEVDMEGRVVGGDELDLMVGIDGRYHDGGSGSSRRKGSISSNHTQVLESELDEDEGMEMS

SEQ ID NO: 5929 - protein, 421 aa, Neurospora crassa
MSNAAVGTVYEHIINEVINAVRVDFEENGVDDSVLEELKKGWQHKLSQLNIAQFPWDPKPEAPPPAQATQNTSSAVNAQAAATQQPTANYTQSTLSPQTAAQSPSLPGGQPNGNGVAIKSEPGMANEPTIKQEPGTMQPMMHPAYPGNNAARGGMAAQRAAQAIANRYGSQAQASINAIHQQTQQPQIPGQAPPPPLQQQQQQQQQQQQQQQQQQQQQQQFSPQQQYQQTVAAQLQQRIPQQPGQPGQPQPPNQQNGLGGAQVDGSSDGFDGVMMRRDADGNPVEMGRVEIDNLLHAQLLERAKQREGGGLMLPLKEATKQRSNATKSRRAAAAGGPNQLDGNDEDDDEFDEDAINSDLDDPEDERDDDDEEDEASGWIMLCLYDKVQRVKNKWKCTLKDGVLTVNGKEYVFHKANGEYEW

SEQ ID NO: 5930 - protein, 284 aa, Bacillus halodurans C-125
MTIQWFPGHMAKARREVTEKLKLIDVVIELLDARVPLSSRNPMMDEIVAHKPRLVLLNKDDLADPSKTKEWTRFFEEGGATVLPINAQTGQGVSRISPACQTLAQALIEKQRAKGMKPRAIRAMILGIPNVGKSTLINRLASKRIAKVGDRPGITKQQQWIKVGKELELLDTPGILWPKFDDQATGFRLAATGAIKDELLDFQDVALFVLRYMREMYPDRLMDRYKLNELPEDGVTLFDAIGKKRGHLLSGGYIDYDKTAEMILRELRAGTLGRITLEVPGKTV

SEQ ID NO: 5931 - protein, 474 aa, Mycobacterium sp. MCS
MRRSHSPGSRADGSARDDGWVVTDLDLDLQALPLAPKNPLPYRQLLPLVRHFHTGQEVLRQAAGPVIRLKLGPKWMIPEIVVVTSPAGIRDVLGRNHASAERCRVHDEVRDLGGESLFVLPNDPWIPRRRALQPVFTKPSVRGFGGHMSRAAEMVGERWGQTAQVNLDEECRRLTMRSLGRSILGLDLDAKADLIAGPLPVAAGYAADRALKPVRAPRWLPTPQRRRANAAVATMKAVTNDILQACRADPARDAPLVHALINASDPETGRSLSDDDICNELLVFMLAGHDTTATLLTYALWALGHHPDIQDRVAAEACALGDRLPTPDDVGRLGYTVQVLNESLRLCPPAAGVGRMALRDVEVDGYRVEAGSLVGIGIYAVHRDPELWDRPLEFDPERFSPENVKDRDRWQFIPFAGGPRACIGQHFAMLEATLALATLIRSHEIRSIDDDFPLETPYTTVAAGPIWARVHRRT

SEQ ID NO: 5932 - protein, 1179 aa, Magnaporthe grisea 70-15
MPSIYSSIYQTFIRQGFSKSFTNGYAQSVVAATHHNVLNPQNRPSFARRNSTTTRIGRLSSTIALQNAFHPSANTSAVGLSKDHRYDTAAGGHGGLDAYYENLQKNEAAKEHGEEVDEEWVQYEFPKRIEWKPSPASILLGGEPRAATAEDASEDVITRSITPEEEAVLAHIDAALELEIEHRRQLEALEEEGSLRSGSPVHSQSYTPISRTRTPASIARTATPPVDPQSLAYAEHLTKLAEAGRYAEIPAVFEAMVVTSIRPTATAYNALLMAAIQLPSEKIEVVSKALDVYADMLRRRVSPDSDTYNILVGLLAARSLEVAAEKSGLEEKRARFGGMDEPGKFMLASHEFEHAILCEDDRLDLAIKLFDNSVMANKAMYSSETYHQLISACAQAGRLSDMVQLFEHMEFSQATPFAATFPAMITAFANSGDLVSAVECYTEYKTLAIANDNGQHTLLDRLDSQVYAAVINAYVISDKLDGAMSFYKKIIQEYDAKAVDIKDAIISAGFVKGLLHRGIYQEAFMWAQAVEDETRGQTMSEVASLSADNGDHHTAAAAFAQLSEPTLHTSSAMALLALSVRLGDVAAASRYWSVLSSPGVSVTPNFIEPTAMYAVAMIGSGEVAEGLTQSEMMFDRIRALADIRPAILDEVEEGAEFVAKFMADRGILDPRESASVVSYPPQTVLSASPYPSTATISSFEDTFDPYAHNTDFKGSSLIADDLEGSHGRKGPKLNDALNRFRNMRRAGRHPRYITYAKLISSAAREGKMDLCNDILAMAHTDVPLQPQYATVRYGWSSILDAMVGACLTLGYRNLAEQFHRQLLEIGAAPSANTFGLYITTLKESTKTFDEATEAVKIFQRSKVEGVEPSSFLYNALIGKLGKARRIDDCLFYFAEMRALGIRPTSVTYGTIVNALCRVSDEKFAEELFDEMEAMPNYKARPAPYNSMMQFFLTTKRDKTKVLAYYDRMLAKGIRPTAHTYKLLVDTHATLEPVDMEAAEAVLEAIRASGQKPEAVHYASLIHARGCVLHDLPGAQSIFETVMADAAIPASACLFQALFEAMVANHDVAATQPHLAEMRRRRVEMTPYIANTLIHGWAAVNNIAMAEEIYESVGRERREPSTYEAMTRAYLAVEMREGAKGVVSEMLGRGYPSAVVNKVLELLGGGGGSGGEAEEAVTMP

SEQ ID NO: 5933 - protein, 343 aa, Photobacterium profundum
MKIKALSKLKPEEGIWMNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 5934 - protein, 237 aa, Arabidopsis thaliana
  misc_feature (133)..(133): Xaa can be any naturally occurring amino acid
  unsure (1)..(237): unsure at all Xaa locations
MASLSFVSSSHLTLRTPSIALRSTGSSPRTSVSFSVKAQSVALSQDDLKKLAAEKAVEAIKPGMVLGLGTGSTAAFAVDQIGKLLSSGELYDIVGIPTSKRTEEQARSLGIPLVGLDTHPRIDLAIDGADEVXAGSGLAMPVEVVQFCWNFNLIRLQDLFKEFGCESKLRVDGDGKPYVTDGSNYIIDLYFKTPLKDGFAAAKEIGKFQGVVEHGLFLGMATSVIIAGKNGVEVMTK

SEQ ID NO: 5935 - protein, 271 aa, Haemophilus influenzae Rd KW20
MQHKLIAFIGGGNMAQAIILGLLKQGYPAEQIIVNDPNEEKRAFFANLDVATSENNVGSAIKAEVVLLAVKPQMMAEVCSPLSAVDFSDKLLISIAAGISTERLNALIPSVKSIVRVMPNTPALVGEGMAGLFAPKNTSENYRTFAQDLLGAVGRTVWVNDETQMHAVTAASGSSPAYFFLMLEAMQKALIKMNIDEKTARELVQQSMLGAAKMVTENPQIALSTLRENVTSKGGTTAAALAVFDAQHFNQTIEQAMQACLSRSQEMETLF

SEQ ID NO: 5936 - protein, 206 aa, Bacillus cereus ATCC 14579
MGKEFFLQHDIVIMYSILFVFIIILKMQFFTWFGMLACMFGIVFYTLNEYMTHRFLFHIKPPKNTFLLKMLRRLHYDHHVYPDDLKLLFLPVWFSIPSFTIYLLIAYGITKSVTITLSFGIGMIIMLLVYEWKHYIAHRPIRPVTKFGRWLKKQHILHHYKNEKFWFGVSNPVFDFIFGTLKDGKDVELSETARNLEKEKKTKVVR

SEQ ID NO: 5937 - protein, 579 aa, Schizosaccharomyces pombe
MKVVPSEKIKPNWWRETSVYQIYPASFKDSNGDGFGDLEGIISKVDYLKALNVESIWLCPIYPSPLKDMGYDVSDYKQIDSRYGTLEDLDRLMKALHERDMKLVMDLVLNHTSDQHEWFKESRSSKTNPKRDWYFWKPARYNEKGERLPPNNWRSYFDTSAWEWDEATQEYYLHLWSVGQPDLNWETPKVREAVHDILRFWLDRGVDGFRLDAINMISKDQRFLDAPITDDRYEYQLAYQYYANGPRIHEYLNGIGNILTEYDAFSVGEMPYVLDTNEILHVVGADRRELTMIFQFDFVDLDLDPNQHKYIEGSWELSDLKKSLKKWQSALLSGGGWNASFIENHDQTRTVSRYLSDSPKYRAYSSKLMALFIIFQSGTPLVFQGQELALANIPRDWPIDEYLDVETQNFWKLFMSGNPSQEEIEKTMDIVNKRARDNGRTPMHWDSSPNGGFTKAGVKPWMRVTNDYKEWNAANQVNDPESPYTFWSKALELRKELKDAVVYGSFELISEEDPSIVAFVRESSTYKLIILLNFTGNKVSYDCPLNLTSYEILLDNYKDFICMTSPVTLNPYQAVLLKL

SEQ ID NO: 5938 - protein, 331 aa, Saccharomycetales
VRVAIDGFGRIGRLVMRIALSRPBVZVVASBBPFIBLDYAAYMFKYDSTHGRYAGEVSHDDKHIIVDGKKIATYQERDPANLPWSSGDSVIAIDSTGVFKELDTAQKHIDAGAKKVVITAPSSTAPMFVMGVDSEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVBVSVVBLTVKLDKETTYDEIKKVVKAAAEGKLKGVLGYTZBAVVSSBFLGSBHSSIFBASAGIZLSPKFVKLVSWYBBZYGYSTRVVDLVEHIAKA

SEQ ID NO: 5939 - protein, 273 aa, Triticum aestivum
  misc_feature (41)..(41): Xaa can be any naturally occurring amino acid
  misc_feature (78)..(78): Xaa can be any naturally occurring amino acid
  unsure (1)..(273): unsure at all Xaa locations
LDFFTGRILTTFFRRFRYLKAADCSKITQTVPRTGNPSKVXTQSGRAPQASQLDTLLNLADLKGADGKTTLVHSAVQXIPRSEDEKSDEIPESHIQFGKHGLKVVSGLSSELGNVKKAATMDFDVLHGYVSKLETGVGKITSVILLENQCRKGERFFTAMRGFLKEAEQGIGQVRGEERKAMERVKEITGYFHGNTAREEAHPLRIFMVARDFVAILDRVCREVGQQDRAFLGSARSFRISATTPTPLLGMHGQQGGDGNSDEATLLGVGGGD

SEQ ID NO: 5940 - protein, 281 aa, Leccinum brunneogriseolum
  misc_feature (69)..(71): Xaa can be any naturally occurring amino acid
  misc_feature (133)..(141): Xaa can be any naturally occurring amino acid
  unsure (1)..(281): unsure at all Xaa locations
AVNDPFIDLEYMVYMFKYDSVHGRFKGDVHAKDGKLYINGKAITVYAERDPANIKWGAVGAEYVVESTXXXTTIEKAGAHLKGGAKKVIISAPSADAPMFVCGVNLDKYDPKYTVISNASCTTNCLAPLAKVXXXXXXXXXGLMSTIHGTTATQKTVDGPSAKDWRGGRAVNGNIIPSSTGAAKAVGKVIPTLNGKLTGLAFRVPTNDVSVVDLVVRLEKSASYDEIKAAVKAASESPDLKGIIEYTDEALVSTDFTGHPASSIFDASGSIMLNPNFVKLI

SEQ ID NO: 5941 - protein, 543 aa, Arabidopsis thaliana
MSSINLSSSSPSTISLSRSRLSQSSTTLLHGLHRVTLPSNHPLSTFSIKTNTGKVKAAVISREDDLLSFTNGNTPLSNGSLIDDRTEEPLEADSVSLGTLAADSAPAPANGFVAEDDDFELDLPTPGFSSIPEAIEDIRQGKLVVVVDDEDRENEGDLVMAAQLATPEAMAFIVRHGTGIVCVSMKEDDLERLHLPLMVNQKENEEKLSTAFTVTVDAKHGTTTGVSARDRATTILSLASRDSKPEDFNRPGHIFPLKYREGGVLKRAGHTEASVDLTVLAGLDPVGVLCEIVDDDGSMARLPKLREFAAENNLKVVSIADLIRYRRKRDKLVERASAARIPTMWGPFTAYCYRSILDGIEHIAMVKGEIGDGQDILVRVHSECLTGDIFGSARCDCGNQLALSMQQIEATGRGVLVYLRGHEGRGIGLGHKLRAYNLQDAGRDTVEANEELGLPVDSREYGIGAQIIRDLGVRTMKLMTNNPAKYVGLKGYGLAIVGRVPLLSLITKENKRYLETKRTKMGHMYGLKFKGDVVEKIESESES

SEQ ID NO: 5942 - protein, 254 aa, Brucella suis 1330
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPVWAIGTGLTPTVQDVRAAHAFMREQLIERFGAKGAHLRLLYGGSVKPSNAAELLGVADVDGALVGGASLKAADFLAICETYRNL

SEQ ID NO: 5943 - protein, 274 aa, Photobacterium sp. SKA34
MSSDQVHLGHRARKRFGQNFLKDPYIIDGIVSSINPLPGQNLVEIGPGLGAITEQVGKLVDKFTVIELDRDLAERLENHPDLASKLTIHQGDAMRFDFTQLIKENNKLRIFGNLPYNISTPLMFHIFEFHKDVEDMHFMLQKEVVNRLAAGPGSKAYGRLTVMAQYYCRVMPVLEVPPESFVPAPKVDSAVVRLTPYEVLPFPCTNLKWLDRVCREGFNQRRKTIRNCYKALFTAEQLEALGVNPGHRPENITVEQFVAMANWLDANYQKDAKA

SEQ ID NO: 5944 - protein, 1112 aa, Gibberella zeae PH-1
MADIMIPNVRSPLSEASNRINSNHPPQEAHRYKPRHDRPPASTNNPPRASYGHPAAYFSGRPPPTQPQSTGPKPQGNPTLKPPTDMDDDRRHSGASYDSSGSGHSKKNYKTHIGPWQLGKTLGKGSSARVRLCRHNVTHQLAAVKIVNRRMAYLVQDSSLAALSKWDNNLPEQIDGEIRVPMAIEREVAILKLIEHPHIMKIYDIWENRSEVYLILEYIDQGDLFTFINMKGRLSEEVSVYFFRQIISAISYCHSFNICHRDLKPENILISANLKIKIADFGMAALHQTDTHRLNTACGSPHYAAPELLKNRQYRGDKADLWSMGVILFAMLTATLPFDDPDIRVMMSKTKKGQYEMPDYLSPEAEDLIRRMLQVNPDRRITLKEIWRHPLVKKYAYLDNLDDLNSQPPDIRKGFQYTPVPAQDVDSQLVRQLRSMWHTFSENDLKLKLTCDEPNDQKAFYWLLYQYREQQLEDFKPEIAHSTSDYHHMKPGTWKKHPQAASLSKKTTMALTPGNQKGFEVDQVRAVDVEHQLEPPPQDAYYHREARCRPCTAVDKARRMHATRATNEESTSRMSGSVPPYVTEQGSTYQLEMARPFTPDVSELPSTVLPKTKDRHEAQVNTKRASGQAMRIALGSRYASEIFKEELRHFSSNIAKDCDEAFKSSLIEEDSIAGSLTEPDRTQYESTPISFTIDAPDESAPDILDLTAKSFSNRPLPPLPTPLQGHDERSLAPTPIGSRPTTGDSHLEELRAEQVKVAQPVILTRHAERRVVSAPAYHQKSKMNPALPSINETGAISNDKARIVSAPPHTPTKRGVDRIRGIEYLSQVENSIRVVNSPGDESPVKMPKPLNVRKKFCDSEEEEEDVMVKRASKVESTHGRESVDWQDCNSYLTSSDGKRSDSTTTDAPSKKKTFNFNFWKSNKQRDSIMSITKEPDDKEERPSVELSVVGKTNTSTKVSQSRWHESNSGPVRNIEVKQNWLARLFRVKPATDHICMTISRRRARQEVTILLREWRKYGIRDIQVDKQRNIVFARVADKNFLNLKEVSFAAEVITVIEHGKKQPLSIIRFTQERGAASSFYRVVDTMRMMFETRALVISDKNKQKMMIKTLNS

SEQ ID NO: 5945 - protein, 378 aa, Bacillus halodurans C-125
MKAVTYQGIKDVKVKEVPDPKLEKKDDVLVRITSTAICGSDLHLVHGMIPNFPKGYIIGHEPMGIVEEVGPDVTKVKKGDRVIVPFNIACGKCYYCTHDLESQCDNSNPNGQAGAYFGYSGTFGGYPGGQAELLRVPYGNFTPFVVPEDAEMEDEKLLFLSDIIPTAYWGVEQAEVKKGDTVVVLGCGPVGLLAQKFAWLKGAERVIAVDYVQYRLTHAKQTNQVEVLDFSTIDDVGTHIKEITKGGADSVIDCVGMDGKKSAVEMVETALKLQGGTLGPINIASQAVRKGGTVSIVGVYGTRYNAFPLGDFFARNITLKMGQAPIIHYMPTLYQMIKDEVFDPTDLITHRLPLELAEHGYDIFDAKQDDCIKVVLKP

SEQ ID NO: 5946 - protein, 323 aa, Oryza sativa (japonica cultivar-group)
MSGGEDVRKVSRQDIQLVQNLIERCLQLYMNQKEVVETLSFQAKIEPSFTELVWQKLEEENREFFKAYYVRLMLKNQIMVFNKLLEDQYRLMCKEQPSGVPSMPPTTNGSNMGTLNQNACFLPDTTPSTAMPDSLLPNGSSSGIVNGTPSSDQFIYAGKVIHGLPSSMDASSSLLAAHNSTAGRFNGDNGTTIKTEASYSGNSDFGFCNESAFLEPCQSIGDASGGSFSSSELNGQPLGDPIMDMDSSSFGFLSQIPRNFSFSDLTEDFSQSAEILENYGRSPFIPSEPNNFSESTPGDHAEIGNRRLDTISEGVSYEDFGSD

SEQ ID NO: 5947 - protein, 544 aa, Deinococcus radiodurans R1
MTAPAPTPAQTAAQTPTAPLRVLICDEMNPGNLDHEGFQIDYQGNLEREETLRRLPDYDALITRSRTKVDRELLDAAGPRLKVIGRGGVGVDNIDLEYASRRGLLVLNAPESNNVSAAELAVMHLMAAARGLTRSDRKTRAGEWDRKFLGLELTDKTLGIVGLGRIGSIVADRAQGLHMNVVAYDPYVPENKFERLGVQRAASLDELLGQVDALTVHTPLTDETRGMIGERELALLKRDAIVVNAARGGIIEEQALVNALHAGHLFAAGVDVFVDEPPTAEHIFLGAPNLGITAHLGANTREAQERVGAEIVSRVLDALHGDVSKGAVNAPALDAKTMEQLGGYLDLGEKLGRILAQLLPGAHEVEVTFRGEFPTDPSPVVTAVLMGYLSGSTDEHPNMINARALARERGVTLSVREEEDSPDYQTEVIVRVLNRSGEKERTRKVGGTVFGKSPRLTRLRDYRVELEPEGFILIASNLDKPGAVAKLSNLLGTWGINIAGMALGRSEKGGQALFTLTLDDSLTPEQLQAIRDLDVIESAFLVRV

SEQ ID NO: 5948 - protein, 540 aa, Shewanella sp. MR-7
MSELTWWRGAVIYQIYPRSLLDTNGDGVGDLRGIITKLDYIASLNVDAIWISPFFKSPMADFGYDISDYREVDPLFGSMQDFDELIEKAHQRGIKVIIDQVLSHTSDQHAWFIESRESRTNPKADWYVWADPKEDGTAPNNWLAIFGGCAWEWEPRRQQYYLHNFLRSQPDINFHNPEVRQAVLDNVEFWLKKGVDGFRLDAITFCYHDEQLRDNPAKPKDKRQGRGFSEDNPYAYQYHYYNNDRPQTILFIEELRQLINRYPGAVTLGEVSAEDSLAVMAAYTKGEDRLHMAYSFELLTDDYSAAYIRQTVEALEASIGDGWPCWAIGNHDVQRVASRWGRGKQTHDMVKMLNAMLSSLRGSVCNYQGEELGLTEAPIEYHELQDPFGKTFWPMFKGRDGCRTPMPWEQHADFSGFSQVTPWLPVANAHRALAVDVQEADPASMLQGYRQFLAWRKGYPILIEGEIEFLDAPEPLLVFVRTLGEQKLLVCFNLLDTETQWVLDKLSIQQELTGHGLKTAQRVADTLTFSAYACFYALLN

SEQ ID NO: 5949 - protein, 384 aa, Staphylococcus aureus subsp. aureus MSSA476
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 5950 - protein, 161 aa, Brassica napus
VRSWSWALQAFTGFMSGKAPQTILTDHNMCLKEAIDGEMPATKHALCIWMVVGKFPSWFNAALGERYNDWKAEFYRLYHLESIEEFELGWRDMVNSFGLHTNRHINNLYASRSLWSLPYLRSHFLAGMTLSGRSKAINAFIQRFLSAQTRLAHFVEQVAVA

SEQ ID NO: 5951 - protein, 615 aa, Propionibacterium acnes KPA171202
MGPASLRQALPRSARPYPACAKDHLMTHVPCTPAAEIPETLAPTGALGLTSAQLQARLDEIHPVGSIDRTETEWFRTAVFYEVLVRSFKDSNGDGIGDFKGLTGKLDYLQWLGVDCLWLPPFYDSPLHDGGYDIRDYRWIREELGTIEDFKVFLDAAHDRGLRVIIDFVMNHTSDSHPWFQSSRADPDGPYGNYYVWSDTDEAYSDARIIFCDTEDSNWSWDSQRKQFYWHRFFHHQPDLNFEEPRVMEEMLDAVRFWMDLGIDGFRLDAVPYLIEAEGTNCENLPGTHKILKQLRAMVDEEYPGRILLCEANQWPDDVVEYFGNGDECQMAFHFPVMPRLYMGLRRGSRECISEILAHTPHIPDGCQWGTFLRNHDELTLEMVTEEDRHYMWEEYAPESRWRCNLGIRRRLSPLVDNDDAKIRLLNAMLLSLPGSPVLYYGDEIGMGDDPWLPDRDGVRTPMQWDDSETAGFSTALPEDFHLPLIRTFGHDPEHVNVARQMDDPSSLLVWTRAMLGIRRHHPVFGTGEFTDLGGPDMAVMSFLRHNEHETVLCLANFSDTERMVALHLPQFAGMTGSSLIHGQDAQPVKADGTLSVPLWPYGYRWLQMSREERS

SEQ ID NO: 5952 - protein, 421 aa, Haemophilus somnus 129PT
MNNYLNIWRGNMTTKVSLDKSKIKFLLLEGIHQNALEVLKAAGYTNIEYHRKALEPDELKIAIKDAHFIGIRSRTSLTEDILAEATKLIAIGCFCIGTNQVDLEAAKARGIPVFNAPFANTRSVAELVLGEILLLMRNIPQANADVHRGLWNKSMVGSYEVRGKRLGIIGYGHIGSQLSIIAEALGMNVYFYDIETKLPLGNAQQMNSLEELLSTCDVVSLHLPENSSTKNLMNAERIAQLKANCIFINAARGTVVDIDALAQALESKKIRGAAIDVFPKEPASIEEEFISPLRAFDNVILTPHIGGSTVEAQENIGVEVANKFVKYSDNGSTLSAVNFPEVSLPEHSNAKRLLHIHHNRPGILNKINQIFVEQNINIAAEYLQTEAKIGYVVIDVETEDTAQLLAKLKQIEGTIRARVLF

SEQ ID NO: 5953 - protein, 129 aa, Haemophilus somnus 129PT
MMIKGGGAALTREKIVAALAKKFICIVDSSKQVDVLGSTFALPIEVIPMARSQVARKLVALGGSPEYRENVVTDNGNVILDVYNFKIMNPIEMEKELNNVAGVVTNGIFALRSADIVIVGTPEGTKIIE

SEQ ID NO: 5954 - protein, 148 aa, Zea mays
ESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 5955 - protein, 358 aa, Chromobacterium violaceum ATCC 12472
MSSMKATVFVGPGRIELREKPIPAVGPGDALVKITTTTICGTDVHILKGEYPVASGLTIGHEPVGVIEKLGADVKGYREGQRVIAGAICPSFTSYGCQDGHPAQDGGCECHGYKPMGGWRFGNTIDGTQAEYVLVPDAQANLAPIPDGLSDEQVLMCPDIMSTGFAGAEAANIRIGDVVVVFAQGPIGLCAVAGARLRGASCIIAVDGLDERLGISRRLGADVTLNFKQVDVIAEIMKLTGGRGVDASIEALGTQGTFESALRVLKPGGTLSSLGVYSSDLRIPLDAFNAGLGDKRIVSSLCPGGKERMRRLMNVLESDRLDLSPLVTHRYKLDQIVEAYDLFSHQRDGVLKVAIQPF

SEQ ID NO: 5956 - protein, 145 aa, Triticum aestivum
  misc_feature (90)..(90): Xaa can be any naturally occurring amino acid
  misc_feature (100)..(100): Xaa can be any naturally occurring amino acid
  unsure (1)..(145): unsure at all Xaa locations
MAPAVMASSATTVAPFQGLKSTAGLPVSRRSGSAGLSSVSNGGRIRCMQVWPIEGIKKFETLSYLPPLSTEALLKQVDYLIRSKWVPCLXFNKVGFVFRXEHNNSPRATKNSILDKCGKLPNVRGATERKRKAQTKGWKAKKRYP

SEQ ID NO: 5957 - protein, 173 aa, Prunus armeniaca
YFQFVQQWPPTTCRLSSKPSNQHRPLQIFTIHGLWPSNYSNPRLPSNCIGSQFKGILSPQLRSKLKTSWPDVEGGNDTKFWEGEWNKHGTCSEHTLNQMQYFERSYAMWMSYNITGVLKNASIVPSATQTWTYSDIVSAIKTATQRTPLLRCKRDPARNKSLPNYQLLHEVVF

SEQ ID NO: 5958 - protein, 515 aa, Oceanobacter sp. RED65
MSAQPKPVALIILDGFGERDAAQDNAITTANMPTWNRLVNEYPHVQINTSGAAVGLPDGQMGNSEVGHMNLGAGRIVYQNYTRINKAISDGEFQQNAALTAAMDKAISAGKAVHLMGLLSPGGVHSHQDHIMALASMAKDRGAKQIYVHAILDGRDVAPQSAKPFLETVSEHLAGLDMGDDARIVNLIGRYYAMDRDNRWERVQRAYDMYTQGKAEYQAASAIEGLEASYDRDEHDEFVKDTIIGDAVTINDGDSVIFANFRPDRAREITRAFVEQEFNGFSRTAHPTLSDYVMMTEYAADIETSCAFPPASMKNDLGEYVSNLGKTQLRIAETEKYAHVTFFFSGGQEAVYPGEERILINSPDVATYDLKPEMSAPEVTDKLVDAIENQKYDLIVCNFANGDMVGHTGVMDAAVKACEALDTCLKRVTDAIIKVGGECLITADHGNCEQMTDANGGPMTQHTTGPVPLVHVSKKGKQVSLKQGGALCDIAPTLLTMMGETAPEEMTGQVLVKYE

SEQ ID NO: 5959 - protein, 157 aa, Oryza sativa (japonica cultivar-group)
MAKLYVQAVQPADLNKNTEWFMYPGVWTTYILILFFSWLLVLSVFGCTPGMAWTFVNLAHFAMTYHFFHWKKGTPFADDQGMYNRLTWWEQMDNGKQLTRNRKFLTVVPLVLYLIALHTTDYQHPMLFLNTIAVVVLVVAKLPNMHKVRIFGINAGN

SEQ ID NO: 5960 - protein, 471 aa, Arabidopsis thaliana
MAFSLLSPIPTSASLFFTLSAITASNNASSSSLSRLYSLYHPKGTLRTRTATSFFGASGNLRIVSMAENRQLVCRIGGGAGAELDDMDEGEIQRIGNEDEDDDEFIQVHANNSSAASPERWDVLGLGQAMVDFSGVVDDEFLKKLGLEKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 5961 - protein, 291 aa, Dehalococcoides ethenogenes 195
MEKDAPLAATGTPSLMAQAKEMMEGYTLRARKGLGQHFLISQGVLNKILLAADLKPTDTVIEVGPGLGVLTEELIKRAGQVIAVELDDKLVTALTEKFKAYPNFRIIHSDILKTSPAEILGQNIPYKLVANLPYYITSAVLRQFLEAEAKPELMVVMVQKEVAKNMVAQTGDMGLLTLSVRFYGNPSLVSVVPGGAFYPPPEVDSAIVKVAIPQAAIMQGVSEADFFKLARAGFGTRRKTLLNALAQGLGVSKQSVLALLNRAGIEPARRAETLSMEEWKMLCLVYTENPC

SEQ ID NO: 5962 - protein, 460 aa, Synechococcus sp. WH 7805
MLAAAMPPLLAEISAHDLEMAETLIGVARFALIFVAARLLAEVLVRLQLPTILGELLAGVLIGASGLHLLVPPETQVELSNGVISLVSGLVNVPPEAVPDIYNESFPSLESVAELGLYALLFLTGLESELEELIAVGAQAFTVAVAGVVLPFALGTWGLMAIFHVDAIPAIFAGASMTATSIGITASVFGELGFLKTREGQIVIGAAVLDDILGIVILAVVVALASGGSLEIGPIVKLVVAAAVFVVAAIGLSRTAAPAFDWMIDKLKAPGEVLVGSFVILALSCFTATAIGLEAALGAFAAGLILSSSKHNHAIQQAVLPIVTLFATIFFVLVGAGMDLSVINPSDPSSRTALVVAGFLLVVAIIGKIAAGWAFVSKQPTRRLVVGLGMMPRGEVGLIFLGLGTSAKLLSPSLEAAILLMVIGTTFLAPVLLRLVLGGNKPDDGDSVSDDVAAEPVGLL

SEQ ID NO: 5963 - protein, 162 aa, Zea mays
MGRRGEPYYVEAVPPVDVNKNTEWFMYPGVWTTYILMLFFAWLLVLSVSGCSPGAAWTVVNLAHFAITYHFFHWKKGTPFAADDQGIYSRLTWWEQIDNGQQLTRNRKFLTVVPVVLYLIASHLTDYKQPMFFLNTIAVFVLVVAKLPNMHKVRIFGINADI

SEQ ID NO: 5964 - protein, 840 aa, Synechococcus sp. WH 7805
MSSSQPLDLRLPTPGCYADPERAGLDAESVFDGMTEHLFFTLGKLAPSASRHDLYMALSYAVRDRLMTRFLASKEAIRARPQRTVAYLSAEFLIGPQLANNLLNLGIQKEAEEALKRFGIESLQQILEVEEEPGLGNGGLGRLAACYMESLASLEIPATGYGIRYEFGIFDQLIRDGWQVEVTDKWLKGGWPWELPQPDQACFVGFGGRTESYIDDKGNYRSRWIPSEHAIGVPHDVPVLGYRVNTCDRLRLWRADATESFDFYAFNIGDYYGAVEEKVGSETLSKVLYPNDGTDEGRRLRLKQQHFFVSCSLQDMLRSLDSRGLSVENFPEYWTVQLNDTHPAIAVAELMRLLIDDRHLEWEKAWDITTRSVAYTNHTLLPEALEKWDLNLFSSLLPRHLELIYEINRRFLQQVRLRYPGNDTIQRKLSIIDEDGGKAVRMAHLATIGAHHVNGVAALHSDLVREQLMPEFAALWPEKFTNVTNGVTPRRWVALSNPELSTLLDEHVGPGWITDMEQLRRLEERQHDHGFLEHWGNTKLSVKRKLSGYIHRNTGVLVDPSSLFDVQVKRIHEYKRQHLNALQVITQYLRIKNGQAEGMAPRTVIFGGKAAPGYYMAKLIIRFINGIAETINADPDMDGRLRVVFLPDYNVKLGEQVYPASDLSEQISTAGKEASGTGNMKFAMNGALTIGTLDGANVEIREKVGGENFFLFGKTVEEIAALKQGGYRPWEVVQSIPELAEAVRLVEIGHFSNGDGELFRPLLDNLTGSDPFFVMADFADYLRAQDAVSLAWADRMHWNRMSLLNTARSGFFSSDRSIRDYCRDIWKVQAMPVEITCDVR

SEQ ID NO: 5965 - protein, 125 aa, Glycine max
KTPSVPGRSLYLNLIIVLALFASITMAESTGEASSEAKVHIIYTEKPTDEEPKDYHLRTLSSALGSEEAAKDALIYSYKEAASGFSAKLTPEQVTEISKQPGVIQVVPSQTYHLHKPVGAGFKLT

SEQ ID NO: 5966 - protein, 593 aa, Schizosaccharomyces pombe 972h-
MTSFTESKKLDEIESPVPEIIVPSTTNGNGTIESYKEKSVGTSFLDFFRSYKLRPDNEFAEVHNSEDFLKPRHLQMIAIGSCIGTGLFVSTGKSLKNAGPGSLMINFIILSAMILALILSLGEMCCFLPNQSSITMYTGRLLNNNIGFAQSWLYFWIWLTVLPSEISAACEVVDFWTTQHLNPAIWVTIFLAYVVLVNAFGARSYGECEFVSSFLKVVIVIIFFFVAIIINCGAAPKGGYIGAHYWHHPGSFRNGFKGFCSVFISSAYSLSGTENIGTAAGNTSNPQRAIPSAVKKVFYRMGFFYIITIFLITLVVPYDNPDLGNVSPFIIAIKNGGIHVLPHITNAVILVSVLSVGNAAVFAASRNAMALVKQGWAPRFLGRVDQKGRPVISYLCSLAMACIAYVNAAPDGSVVFDWLMSVSGGGAFVIWGLSFIDHIRLRYAMKAQKIPDTVLPYKFPGSVYLSYYGVLINFLALCALVYISIFPVTHEKPSAYGFFVSFLGPSVFIAYLLISPIFVKPTFQSLKDVDLTTGRYDLVNSQMYVAESSTSELSEKDLTKPNLQSNDNKNSEDLESNTPPQKKSALQKVADFL

SEQ ID NO: 5967 - protein, 294 aa, Thermococcus kodakarensis KOD1
MKLDVIGIGNLNYDIIFTLERFPEFHEKINARGAHFGLGGAAANTISWLAHFGLKTGYIGAVGNDDVGEMHIKYFQGIGVDTGGIDVVEEPSGVAVAMVAGDDKRIVKYPGANLRRRFKPEYASRAKFLHLSSNPPELIEEAVNFASQRGIKVSLDIGEAPLPRELESKVDYLMMNEDEYRRKYGSLDPSLCRAKNLVVTLNGGGALVREGDNVFEVRGLSAKVVDSTGAGDSFDAGVIYGVLNGWSLLDSAKLGMLLAYLTVQKVGARSAIVPLEEVKRIAREVGLDLPFNRT

SEQ ID NO: 5968 - protein, 334 aa, Haemophilus ducreyi 35000HP
MKTLGEFIIEKQAEYPEAKGELSGILASIRLAAKIIHREINRAGLSQDILGFAGSENVQGETQMKLDIFANETMKKALLAREDVAGFASEEDDNFIAFDSERNRNAKYILMTDPLDGSSNIDVNVSVGTIFSIYKRISPIGSPVTIEDFLQEGRKQVAAGYVTYGSSTMLVYTTGNGVNGFTYDPSLGLFILSHPDMKMPAEGKYYSINEGQYVTFPLGVKKFIKYCQENDEASKRPYSSRYIGSLVSDFHRNLLKGGIYIYPTSTVYPQGKLRLLYEGNPMAFLAEQADGMATDGFQPILDIKPTELHQRVPFFIGSKTMVKQANTFMQTFTE

SEQ ID NO: 5969 - protein, 350 aa, Streptomyces avermitilis MA-4680
MIHRRCVGGRRNHGGRVAQGSSRSRLPQQGTPVTMSSTSSTPPWNVQRLPGADGRVFLVTGGNAGIGYFVAEQLSATGATVVLGSRNPAKAEAATASIRARVPGSRVRAVRLDLADLSSLETAVESLEVERLDAVVHNAGVALDDPPREETGDGHELMFGTNHLGHFALTQWLMPLLSAAPAARVVTMGSFAAKSERLDLDDLQSRKDYQPKRTYGRSKLAQMYFGVELDRRLRAAGSTVASVVVHPGGALDSLTPSRPPVHVRSTGARLSAAPAALLLQGKHAGAWPAVRAVLDPAVRGGQLWGPRVFGLRGEPRREPVWDHLADPSVAARLWDASCDLMGTDLSTISG

SEQ ID NO: 5970 - protein, 547 aa, Shewanella sp. ANA-3
MEPAILIITLICGMLVSRIGLPPLIGYLVAGFVLFVFGIEKESLPLLQELANLGVTLLLFAIGLKLDIRSLFKAEVWAGSSIHLVLSMVLFIPILKIFGFIGLSQLDGLGIAQLSLIAFALSFSSTVFAIKVLEDKGDVQSLYGRVAIGILIMQDIFAVIFLTISKGAVPSVWALALLLLPLAKPLIYKAFDRVGHGELLVLFGLVMALVVGAWLFESVGLKPDLGALIIGILLAGHKKASELAKSLFYFKELFLVAFFLTIGLNGLPTVSDVVLAALLVLLVPLKILLFVYLLTRFKLRSRTSMLASFNLGNFSEFGLIVAAVATSKGWLPPQWLVIIAVALSFSFLFAAPLNTAVGNIYQRFQQRLVRLEKPPLHPEDRPIAIGNPRFLILGMGRIGSGAYDELRARFDGEILGIEHKQELVDLHRANGRNVVQGDASDTDFWEKLDRAPNLELVLLAMPHHAGNLFAVEQLKKLNYQGKLSAIVQYGDDAASLRSSGVHSVYNLYEAAGAGFVDHVVHELLPDSETKADAEAQEETQKQGSALA

SEQ ID NO: 5971 - protein, 248 aa, Mycoplasma mycoides subsp. mycoides SC
MKKKVIFGNWKMNGTNESLTDFLNQVDNKIDSSKIIAGLAVPYVMLQTGLKLAKNVKIAAQNVHYKDKGAYTGEISTTMLKEVGVEYVIIGHSERREMFNETDLDVNKKAKVLLENNITPIICCGETLQTKESGKTIEFVNNQINIMFEGIKKEDAIKAIIAYEPIWAIGTGKTATSSDAEEVCKQIRNNLSKIYDKNTAEQIIIQYGGSVKPSNIQEYLKMPNIDGALVGGASLLASDYLGLVNYNE

SEQ ID NO: 5972 - protein, 289 aa, Streptococcus suis 89/1591
MPKTILITGSTDGIGKHLAMKLASEGHEVILHGRNSEKFRVALSDIQLKTGNKKIHGYLADFSKLADVYRFSQEIKRDFEQIDVLVNNAGAYFGDARVATAENIEMTFMLSVQVPYILTTELLPLLEKAVGRVIHTSSFMHHFAQTRGLDFGLEQSYSAAMAYNNAKLYTIWLAIAQAEALEKQGSSVTVNAYHPGLIATNLGNDGVKRNLRSRILTSLMKPFSKDLDQGIETGYYLSLSPEVAGQSGRYFAEKKVAKVSLKGFDVPKSQALLAYLDKKIQVFKESYRD

SEQ ID NO: 5973 - protein, 531 aa, Mycoplasma mycoides subsp. mycoides SC
MKVKRPVLLAILDGWGISEPDKGNAVDNANMVFVEYLKKTYPWLKAHASGKWVGLPENQMGNSEVGHIHLGAGRINLESLAKLNHETKTNNIAKNDEIVKTFEYVKKNNSALHLMGLFSNGGVHSHFDHMIAIYKAAIDYGITNIKFDLITDGRDTKPKLAYDFIKDLLELIKQNNNIGIISSISGRYYAMDRDKRFDRSRIAYNAIVNRNNVRSFTNILDYIQQEYMINHDDEMIIPAFNQDDLNGNLKANDAIIMTNFRPDRAIQISSILTNKNYIAWQNEAFSDAEFIGDKIRFVSMMKYSDSVTSPHIAYPPKPLTNTLGQYLSQLGLKQLRIAETEKIAHVTFFFDGGNDYFKNGLAKNDEITLANAYIDLIPSAKVATYDLKPQMSAVEITDKLLEEIKKDEFDFIVLNFANCDMVGHTGNNKATEIACKTLDEQLKRIHEEFVLRHNGIMVITADHGNAEIMIDKDGQVNKKHTTSLVPIIITDLNIKLKQNDPEIAKVAPTILDLMNIEIPKEMELESMIDHN

SEQ ID NO: 5974 - protein, 166 aa, Medicago truncatula
MMQRLLGGPGTVSGFLLRLGQCAFGAASISVMVTSFGFSTYTAFCYLTASMGLQVLWSFGLACLDIYALRRKRDLQNPILVSLFVVGDWVTAILSLAAACSSAGVVVLYTRDVDMCATHKIIPCHRVEFWLLSLLKTFDCWFMSANIVEMSVITVVPLNLVNRFSV

SEQ ID NO: 5975 - protein, 524 aa, Aspergillus nidulans FGSC A4
MPSHTYPQRLYTTGYTVPPLKDKSLFIQKAFVNGEWVDAESGKTFEVHAHIDANGWYLDVLTDPATGKLIGTCPEFSASDTEKAIQAASAAFPKFRATLARERARMLRRWYQLMVDNAEDLATLITWENGKPLADAKGEVNYAASFFEWFSEEAPRTYGDTIPASVPGNRVITVKQPVGVCGLITPWNFPAAMITRKIGPALAAGCTVVTKSPGETPFTANALAELANRAGIPKGVVNIVTAMKNTPEVGEMITTHPDIRKVSFTGSTNVGRLLMKQSSSTIKKVSWELGGNAPFIVFDDVEDLDAAVTGAIASKFRSSGQTCVCANRIYVQKGIYDEFVQKFVEKVRNFKVGAGFEDGVTHGPVIHDRAVDKVDQHVQDAISKGAKLIAGGQRRSDLGPNFYDLTVLANMTKDMKIASEETFGPVAGLFPFETEKEVVELANKAEVGLAGYFFSGNIKRIFRVAEALEVGMVGVNTGLISDVASPFGGVKQSGFGREGSKYGIEEFMTIKSVTFGGMGEPLQS

SEQ ID NO: 5976 - protein, 470 aa, Gluconobacter oxydans 621H
MVGIASSSSEGPSTQQPRSTARATTLGILAALAGLMFGLDTGVVAGALPFIATDFHAGDALQGWIVSSMMAGATVGSLFAGRISVRFGRTGAMLGAAILFLLGTLLCALAPGPAIMIVGRLFLGLAVGVAAFAAPLYISEITVESVRGAMISFYQLMVSLGIFLAFVSDSLLASGGHWRWMLGVMALPASFFLGIVLILPHSPRWLMMRGEKERARRVLQSLRSDEEVAEAELVDIQSRLQKSSDAGLGLFRSNPNFRRTVFLGMLLQIMQQLSGINALLYYAPRVFQAAHFGTNASIWATTLVGLTNMALTGVAIACVDRWGRRPLLILSCGIAAFSLAGVGTLLAIGAQSFGLQLLLCGFVLLFVAGFAIGEGPLVWTLCSEVQPTRGRDFGIGCSTVTNWAANWAISNMFPLGMAMMGASSTFLMFAVFNGLFILVTVLFVPETKGVSLERLEANLFAGTRLRDLGR

SEQ ID NO: 5977 - protein, 230 aa, Vibrio harveyi
MSSTSLLDEFGTPVQRVERAIEALKNGLGVLLMDDEDRENEGDLIFSAQHLTEAQMALMIREGSGIVCLCLTEERANWLDLPPMVKDNCSKNQTAFTVSIEAKEGVTTGVSAKDRVTTVKTATYFDAQPEDLARPGHVFPLVAKTNGVLARRGHTEGTIDLMYLANLVPSGILCELTNPDGTMAKLPETIEFARRHGMPVLTIEDIVDYRTGIDLRNEYKSGLVREVSWS

SEQ ID NO: 5978 - protein, 272 aa, Oceanobacter sp. RED65
MTTIAFIGSGNMAGAIMGGLIEDGYQPDNIIASDPSEEKLAELKQRHGIQTTQNNIDAIKRSDVVVLAVKPQVMEQVLEPLKATLEETQPLLISVAAGINQYSLQQWAGDLAIVRCMPNTPSLVGKGASGLLANDKVSDQQKSITEDILGAVGLSVWVNNEQQLDWVTAVSGSGPAYYFLFMECMIQAAKNMGMDEEQAKKLTLQTALGAATMAQKSDVEPDQLRKNVTSPNGTTEQAILSFQNAGLDKIVKDAMEAVVKRSEEMVKELGAK

SEQ ID NO: 5979 - protein, 174 aa, Ustilago maydis 521
MSIVHLQSVEILNAEASFKDPYVFKITFECISPLQDDLEWRLVYVGSAGDEKYDQELDTCMVGPVPVGVNSFEFEAAAPSPSKIPPEDLLGVTVILLTASYRDQEFIRVGYYVNNAYESEELRENPPEKVDLTQVRREVLVSKPRVTRFNIKWDDSATASASTQQQGSAEGLTA

SEQ ID NO: 5980 - protein, 801 aa, Yersinia pseudotuberculosis IP 32953
MSQPMLKKDDFLAALTRQWQRFGLTSAQQMTPYQWWEAVSAALAEQLSAQPAPSKPKNVQRHVNYISMEFLIGRLTANNLINLGWYDTVDALLAEQQVKLSDLLEQETDPALGNGGLGRLAACFLDSMATVEQPATGYGLNYQYGLFRQSFRECKQQEAPDNWQRESYPWFRHNAALAVDVGFGGNLVKQADGRQLWRPAFTLRGEAWDLPVLGFRNGVTQPLRLWQATHQHPFDLTLFNDGKFLLAEQNGVEAEKLTKVLYPNDNHLAGKRLRLMQQYFQCACSVADILRKHHLAGRKLAELPDYEVIQLNDTHPTIAIPEMLRVLLDEHQLSWDAAWAITSKTFAYTNHTLMPEALECWDEKLVRSLLPRHFVIIKQINAQFKKLVNKQWPGNDEVWAKLAVHHNKQVRMANLCVVSGFAVNGVAQLHSDLIIKDLFPEYYQLWPNKFHNVTNGITPRRWLKQCNPALSGLIDDTLKVEWANDLDVLQDLEPYAEDPAFRQRYQQIKYDNKVKLAHYVKRVMGLVINPDAIFDVQIKRLHEYKRQHLNLLHILSLYRQIRDNPALDIAPRVFLFGAKAAPGYYLAKNIIYAINQVADKINNDPIVKDRLKVVFIPDYRVSVAELMIPAADVSEQISTAGKEASGTGNMKMALNGALTVGTLDGANVEIAEQVGDENIFIFGHTVDQVKAILAKGYQPKKYVKADPHLKSILDELASGAFSQGDKQAFDMMLHSLLEGGDPYLVLADFASYCQAQKQIDALYRDKDEWTRRAILNTARVGMFSSDRSIRDYQQRIWQAKR

SEQ ID NO: 5981 - protein, 304 aa, Nostoc sp. PCC 7119
MTQAKAKHADVPVNLYRPNAPFIGKVISNEPLVKEGGIGIVQHIKFDLTGGNLKYIEGQSIGIIPPGVDKNGEPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 5982 - protein, 142 aa, Dehalococcoides ethenogenes 195
MERTLLLVKPDGVNRGLSGEILGRMEKLGLKMIGLRMLQMDAVLADKHYAPHRERPFFKDLVTYITSGPIVAAVFEGENAVEKMRKAMGATDPAKSEKGTVRGDLGINIEQNTVHGSDSAENAKHEISLFFSESELVNYDRR

SEQ ID NO: 5983 - protein, 244 aa, Bacillus sphaericus
MNKVNIKDSQNFITSKYHIEKIMNCISLDEKDNIFEIGAGKGHFTAELVKRCNFVTAIEIDSKLCEVTRNKLLNYPNYQIVNDDILKFTFPSHNPYKIFGSIPYNISTNIIRKIVFESSATISYLIVEYGFAKRLLDTNRSLALLLMAEVDISILAKIPRYYFHPKPKVDSALIVLKRKPAKMAFKERKKYETFVMKWVNKEYEKLFTKNQFNKALKHARIYDINNISFEQFVSLFNSYKIFNG

SEQ ID NO: 5984 - protein, 245 aa, Escherichia coli
MNKNIKYSQNFLTSEKVLNQIIKQLNLKETDTVYEIGTGKGHLTTKLAKISKQVTSIELDSHLFNLSSEKLKSNTRVTLIHQDILQFQFPNKQRYKIVGNIPYHLSTQIIKKVVFESHASDIYLIVEEGFYKRTLDIHRTLGLLLHTQVSIQQLLKLPAECFHPKPRVNSVLIKLTRHTTDVPDKYWKLYTYFVSKWVNREYRQLFTKNQFHQAMKHAKVNNLSTVTYEQVLSIFNSYLLFNGRK

SEQ ID NO: 5985 - protein, 359 aa, Triticum aestivum
  misc_feature (324)..(324): Xaa can be any naturally occurring amino acid
  misc_feature (335)..(335): Xaa can be any naturally occurring amino acid
  unsure (1)..(359): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLXRCKANSEATLXGTYKGDATLGEGASESLHVKDYKY

SEQ ID NO: 5986 - protein, 181 aa, Candida glabrata CBS 138
MRQLTEEETKVVFEKLAGYIGRNIAYLVDNKEVPHVFRLQKDRVYYVPEYIAKLATSVARQNLMSVGICLGKFTKTGKFRLHITALSVLAKHAKYKIWIKPNGEMPFLYGNHVLKAHVGKMTDDIPEHAGLIVFSMNDMPLGFGVSAKSTLESKNLQPTAIVAFRQADIGEYLRDEDTLFT

SEQ ID NO: 5987 - protein, 283 aa, Leptosphaeria maculans 'lepidii' group
HTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTDYLMKILAERGYTFSTTAEREIVRDIKEKLCYVALDFELEIQTASQSSSLEKSYELPDGQVITIGNERLRAPEALFQPSVLGLESGGIHVTTFNSIMKCDVDVRKDLYGNIVMSGGTTMYPGISDRMQKEITALAPSSMKVKIIAPPERKYSVWIGGSILASLSTFQQMWISKQEYDESGPSIV

SEQ ID NO: 5988 - protein, 207 aa, Xanthobacter autotrophicus Py2
MSDRILVLVRHGQSEWNLKNLFTGWRDPDLTEQGVSEAKRAGALLKAEGLKFDVAFTSDLTRAQKTLGLILGEMGQEGVPTTRNVALNERDYGDLAGLNKDDARAKWGDDQVHIWRRSYDIAPPGGESLRDTVARTLPYYVQEILPCVLRGQTTLVAAHGNSLRALIMTLEKLSPEGIMKRELNTGAPIVYKLAADSTVAEKRDLVA

SEQ ID NO: 5989 - protein, 484 aa, Rhodopirellula baltica SH 1
MIATCGGEDVRRLDYISDHRPRTICFPASAGTDSSSEYHLESSRLSGKYGFWTLAFLVIANMIGAGVFTTSGYSLADLGSPQLVLWAWLAGGVIAVAGAISYAMLIRVMPQSGGEYLFLSRAAHPLLGYVAGWVSLIAGFSGAIAFAATALEGYLLPEHLRPEWMPAGIVTIMAIVLAGFFHGLHPRVGATTQNIAVSVKLILLATILLFAVYQWFGGDLIVRNSEVQMTAETTSWSPWVAFAGSLVWISLSYSGFNAAVYVADEVIDATRVVPRALVFGTLATTLLYLCLNAVFVFAPSAASIVGKPDVAAIAAASLGGNGFAHFVRWTIALCLLTSVLSMMMAAPRVYAKMADDGMLPAWMRFRGEAPFAATVVQMMVAITLVLISDLQGLLSYLGLTLSLSAACSVCCLFLPSIRNHPKAAPKHWLIAPAFYVAATIVSAAIMTLNDPKQLIATGITFMVGGTMYVLTTQFKSDNTHEQPS

SEQ ID NO: 5990 - protein, 519 aa, Helicobacter pylori 26695
MLLIVFFKFYFQYSIKKKSFYFIFVIIQAIFIFNLRRCRMDNQKITHQNITQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFADIPIHYWVILCIALVFLLNFFSVKIFAEGEFFFSLIKVLAVIAFIGIGAIGIIYQIYSHGFGSIFDNFHFGDKGFFPNGSAAVFSAMLAVIFAFTGTEVIGVAVGETKNASEVMPKAIKATLWRIVFFFLGSVFVISVFLPMNDSSITQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSVSQYSFRKQYLKAGHSLEDLPYKAPFLPFLQLIGITGCAIGVIGSAMDKDQRIGMILTIVFAVICYIGYYFTQKANENNKKDLI

SEQ ID NO: 5991 - protein, 584 aa, Clostridium tetani E88
MQKTKMVFTIGPASDSEEVLSELIKAGMSASRHNFSHGTHEEHKIRIDLIRKLSDKFNKNIAVILDTKGPEIRTGDFKDKTVQLKEGNKFTIYCGEEILGDETKCSITYNDLHNDVKTGDSILIDDGLVGLEVEEVEGSKVHCVVKNSGAVSNHKGVNVPGVDVSLPSLTEKDKSDLEFGCKVGVDFIAASFIRKGSDVLEIRKVLEENGGTDIQIFSKIENQQGVENIDEIIKFSDGIMVARGDMGVELQMEQVPIIQKMIIEKCNKAGKPVITATQMLDSMIRNPRPTRAEVSDVANAIFDGTDAVMLSGETAGGKYPIEAAKAMAKIARTAEETMDYDEIFNRKREARVLSVANAISIATCTTASELNASAILTATQTGYTARAVSKYRPACPIIAITPSKNVARKLALSWGVFPILTTKFTSTDALIENSVDIALTAEYIRKGDLVVIAAGIPVSYSGTTNMLKVHVVGDILVQGRGAGNSAGYGIAKVVNSTEEAERVIESGDILVVKDADIDYVSILNRVSGVITERGGLTSHLAIECITNEIPFICGAGGATDVLKSGYFITMDVKRGIVYNGRITI

SEQ ID NO: 5992 - protein, 508 aa, Chromobacterium violaceum ATCC 12472
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 5993 - protein, 377 aa, Solanum tuberosum
MSVAELKERHMAATQTVNDLREKLKQKRLQLLDTDVSGYAKTQGKTPVTFGPTDLVCCRILQGHTGKVYSLDWTPEKNRIVSASQDGRLIVWNALTSQKTHAIKLPCAWVMTCAFSPSGQSVACGGLDSACSIFNLNSPIDKDGIHPVSRMLSGHKGYVSSCQYVPDEDTHLITSSGDQTCVLWDITTGLRTSVFGGEFQSGHTADVSSVSISSSNPKLFVSGSCDTTARLWDTRVASRAQRTFHGHESDVTTVKFFPDGNRFGTGSDDGSCRLFDIRTGHQLQVYNQPHGDGDIPHVTSIAFSISGRLLFVGYSNGDCYVWDTLLAKVVLNLGSVQNSHEGRISCLGLSADGSALCTGSWDTNLKIWAFGGHRSVI

SEQ ID NO: 5994 - protein, 815 aa, Yersinia pseudotuberculosis IP 32953
MTSPFSYTSPVVSVDALKHSIAYKLMFIIGKDPTIATQHDWLNATLFAVRDRMVERWLRSNRAQLSQDVRQVYYLSMEFLLGRTLSNALLSMGIYDEIEQALDEMGLSLSELLKEENDPGLGNGGLGRLAACFLDSLATLALPGRGYGIRYEYGMFSQKIVNGQQMESPDNWLEYGNAWEFPRHNTRYKVRFGGRIQQEGSKIRWLETEEILACAYDQIIPGFDTDATNTLRLWSAQASNEINLGKFNQGDYFAAVEDKNHSENVSRVLYPDDSTYSGRELRLRQEYFLVSATVQDILNRHWAMHHTFNNLADKIAIHLNDTHPVLSIPEMMRLLIDEHKFTWMDAWDVVQQVFSYTNHTLMSEALETWPVDMIGKILPRHLQIIFDINEHFLKLVEEQYPDDKELLSRVSVIDENNGRRIRMAWLAVIASHKVNGVSALHSELMVQSLFADFARIFPNRFCNKTNGVTPRRWLGLANRPLAAVLDDSIGQTWRTDLSQLSELEKNLDYPSFLLALQKAKLENKKRLAVYIAEKLNIVVNPAALFDVQIKRIHEYKRQLLNVLHVITRYNRIIDAPDNNWVPRVVIFAGKAASAYYNAKQIIHLINDVAKVINNDPRINNLLKVVFIPNYSVSLAQLIIPAADLSEQISLAGTEASGTSNMKFALNGALTIGTLDGANVEIREHVGEENIFIFGNTTEQVEALRKSGYNPRKYYDEDPELHQVLTQIATGTFSPEEPHRYTNLFDSLVNLGDHYQLLADYRSYVDTQEQVDALYRNRDEWSRKTLLNIANMGYFSSDRTIKEYADEIWHIKPIRL

SEQ ID NO: 5995 - protein, 483 aa, Oceanobacter sp. RED65
MVMIYPIILAGGMGTRLWPLSREEYPKQCLPLNDEHWSLLQQTLLRTQGLQDCAPITVICHEQHRFLVAEQCLQTGVKHFPILLEPEARNTAAAIASAVAFLLAQDSVKADKDAVFCCLPADHAIEQSDAFITSLNQAVQLAREYSQSLLTLGIEPTSAHTGYGYIQAGEPVSTEEYPKAGFKVQHFKEKPDAQTAQSYLEQGNYYWNAGIFMGTACAWQSAFTVYQPELWQHAKNTLQQAQADLDFLRLSSEQYSLLPCMPFDVAIMEQLSNAFMVSLDAGWSDLGEWQALWQQSKKDEWGNHIHGDGLLLNSSNNYVRSERLVAGVGLENLIVVDTDDALLVADRSQSQHIKKLVDKLSEQGRSEHLHHQREYRPWGYFQSMDVGKGFKVKRLFVKPGHGLSLQSHQHRSEHWVVVSGTATVTRGEQSFTLVANESTYIPSTVTHSLRNEQGHPLEVIEVQTGKYLGEDDIKRFSDRYGRA

SEQ ID NO: 5996 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKKMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 5997 - protein, 470 aa, Photobacterium sp. SKA34
MKKTKIVCTIGPKTESVEMLTKLANAGMNVMRLNFSHGDFEEHGQRIRNLREVMVNTGKELAILLDTKGPEIRTIKLEGGQDFSLVAGQDFTFTTDTSVVGNQNCVAVTYPGFAKDLTKGNTILVDDGLIEMEVLETTETEVKCKVLNNGDLGENKGVNLPGVSVKLPALAEKDKADLKFGCEQGVDFVAASFIRKAEDVQEIRALLTANGGENIQIISKIENQEGVDNFDAILDASDGIMVARGDLGVEIPVEEVIFAQKMMIEKCNRARKVVITATQMLDSMIKNPRPTRAEAGDVANAIMDGTDAVMLSGESAKGKYPIEAVTIMAQICARTDYVVKPELGSRLDSPRLRITEAVCKGAVDTAEKLNAPLIIVATEAGKSARSVRKYFPTARILAVTTNTKTAAQLCLSKGVTPVVVDSIESTDAFYLRGKELALETGLGAKGDIVVMVSGALVTSGTTNTASVHVL

SEQ ID NO: 5998 - protein, 404 aa, Acidobacteria bacterium Ellin345
MSTLTKATPIQAADRMVNVRYAIRDLAVLADQVASQGNKILYCNIGDPCKYDFPVPVHIMEAAIKAMRDGYNGYGESLGIKPAVEAIRNEAERDGFKNIQGVFVGLGSGEAIDSCLTALLNPGENFLAPSPEYPLYGAITAKLGAEPNAYFLDESNDWQPDVEDLERRINAKTRALLIINPNNPTGAVYSRETLEKIADVARRHNLLLISDEIYNKLVFDPSAKHISIATLAPDVPCITFNGLSKAYLVPGWRIGWGVGTGPAELIKPFLENIYKLLRARLSAPHPYQYAVKAALEGPQDHLKWVNEKLAARAKVTKDWAASEPRVNLVAPKGAFYAFPSLDIPEDDLTFVSELLIQKHVLLVHGSGFGQKPGTHHCRIVTLPQEAVLTNAYAKVSEFLKERYQ

SEQ ID NO: 5999 - protein, 171 aa, Arabidopsis thaliana
GITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 6000 - protein, 319 aa, Bacillus halodurans C-125
MNRGVICLGEALIDFIPMDSTNEIYQKSPGGAPANVAVGLAKLGAKSTFVGKVGDDLLGRFLKETLTKANVNTEHMLFSKEVRTGATFVTLAANGERSFDFYINPSADRFLEKGEIAPTLFEEHGVLHFGSISLISEPARTATRHAVSLAKKNGLMISYDPNLRLNLWEDEEQARLLITSMLGEADVLKISEEELAFITGEQTIEAGLDQLVAYNIPLVFVTLGEKGSIVSYNGIQRKIPAMAVQTVDTTGAGDAFVSAILFKLQEERKQVAELSIKEVEQMARFASVSGGLAAATKGAMTALPTLEKVNDILRNEQME

SEQ ID NO: 6001 - protein, 336 aa, Oryza sativa (japonica cultivar-group)
MDGGGGGGGGGGVMAGPGVAGGGGGGGGGGVGGDVELVSKTLQFEHKLFYFDLKENPRGRYLKISEKTSSTRSTIIVPVAGVAWFLDLFDYYIRTDERDAFSKELRLDTKVFYFDIGENKRGRFLKVSEASVNRNRSTIIVPAGSSGEEGWEAFRNVLLEINNEASRLYVLPNHPNQVQETIPFFDIFMKSQMTSSLNSCHCIWQQHLEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVESSQR

SEQ ID NO: 6002 - protein, 270 aa, Sorghum bicolor
QLQQQEDDRILGLPGQPNGVAFGMYGGYVTIDDNNGRALYYWFQEADTADPAAAPLVLWLNGGPGCSSIGLGAMQELGAFRVHTNGESLLLNEYAWNKAANILFAESPAGVGFSYSNTSSDLSMGDDKMAQDTYTFLVKWFERFPHYNYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFW

SEQ ID NO: 6003 - protein, 158 aa, Sorghum bicolor
LPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVTVRGAGHLVPVHRPAQAFLLFKQFLKGEPMPAE

SEQ ID NO: 6004 - protein, 454 aa, Haemophilus ducreyi 35000HP
MTITTPIKAVLASNQHFLDRQDKMESNVRSYPRKLPFAYAKAQGCWVTDVEGNEYLDFLAGAGTLALGHNHPILMQSIKDVLDSGLPLHTLDLTTPLKDAFTEELLSFFPKDEYILQFTGPSGADANEAAIKLAKTYTNRGNIIAFSGGFHGMTHGALSLTGNLGAKNAVQNLMPGVQFMPYPHEYRCPFGIGGEAGAKAVERYFENFIEDIESGVVKPAAVILEAIQGEGGMVPAPISFLQKVREVTQKHGILMIVDEVQAGFCRSGKMFAFEHAGIAPDIVVMSKAIGGSLPLAVLAIKKQFDAWQPAGHTGTFRGNQLAMATGYASLKIMRQENLAQNAQARGEYLTNALRELSKTFACIGNVRGKGLMMGIDIVDERQAQDATGAYPQDCELAIAIQKCCFNNKLLLERGGRGGNVVRVLCPVNINQAECEEFIKRFTQSVADAIKAVRG

SEQ ID NO: 6005 - protein, 257 aa, Synechococcus sp. WH 5701
MARALLKPLLDQGVIARDQVQAVVASEDSARRLQAELGVAVGRDPAQAWAAPAVLLAVKPQLLSAVAAAAPPPHSGDEAPLLISVLAGVTLERLERSFPGWRCVRAVPNTPCLVGAGITGLAWGKDLPDEQRQWVLDLFARVGVVKELPESQLDGLLALASSGPALAAVLLEALADGGVASGLPRPLALELALGMMVGSVKVLQEQGLHPAQLKDMVASPAGTTIAALRQLEQAGVRSALIEAVLAAAERSRALNAG

SEQ ID NO: 6006 - protein, 376 aa, Ustilago maydis 521
MSIDGPVEQQDWPLPSSSWIEKVLFLGTGTSGQVPAIHCVTKPDFGDCAACRDATLNPTGKNRRGCRDAEDKLDSAILIDCGKTFYSNAIVHFPRNGIREIRAVLLTHAHADAILGLDDLRAWTMGGVIQRHVPIYLTQECMAVVEGMFPYLVDRSKSTGGGDVPTLQWNIINKDQPFIIPASHGRKEVKVQPLPVLHGFLGRVSPFWCLGFRIDSFSYISDCHEIPAATLQLMRGSQAIVMDALKMDRHLSHFSFAQALSFFASFSPPPALGLLTDFTHRIEHYATQGLVDTWRNGMLAAQIAGKARQVQSTGEGGGLKWWADIWDELGNEHDMTIKLKEVYDPVIDQMARSVSHPIPPIKLSWDGLVVSFAPRR

SEQ ID NO: 6007 - protein, 318 aa, Zea mays
MQYQPIQNYCRCFLTVKKKKKKKKKKKKKKKKKAAKSNLEAPLSLSLSLFAVRSSAPQSNRHLAEMGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 6008 - protein, 121 aa, Zingiber officinale
LSPMASSSATMVVSCARSSSGMVAPFSGLKSLSGVPFPTKRANAHLSHLPSNGCRVRCMQVWPIEGKKKFETLSYLPTLKDEALLKQIEYLLRSNWIPCLEFCKRGFVWRRTTKVLMAENT

SEQ ID NO: 6009 - protein, 430 aa, Cryptococcus neoformans var. neoformans B-3501A
MSTTPNAVIPQAKRMFDGATHKLDVWSIFTPANVPADCINLGQGFMNWAPPDWIRAESHESMDHDIMSNHYSHPRGRPRLLKAISKHYSPQFENIVARGKDLTNEEILVTSGANCGMFAALTAHCEPGDEVICIEPYFDQYFASIHFQGAKPVFVPLHPPTGKGIKHGGDWTLNIDEFAAAFTPKTKAVIINTPHNPVGKVFTKEELEQIAKVCIEKNVLVLADEVYDCMVYDGNKHFRIATLPGMWERTLTVGSGGKSFACTGWRVGWLIGPPQLTAATLAAHSRIVFCTNSPMQEAVAIGLEKAAEHKFFEEQVAAYEERRDILCSYFDQIGLSYTKPEGSYFLLVDISPVKVPEGYPIVETCKGRGKDFEFCWWLCQELKVVGIPPSEFYSEEHVNIGERFARFAFCKDPELLHAAGKRLLKLKEYL

SEQ ID NO: 6010 - protein, 502 aa, Lactococcus lactis
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFTDGADSISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDVKLIVALTESGNTARLISKHRPDADILAITFDEKVERGLMINWGVIPMMTEKPASTDDMFEVAEKVALASGLVEAGDNIIIVAGVPVGTGRTNTMRIRTVK

SEQ ID NO: 6011 - protein, 314 aa, uncultured bacterium 463
MSDFGSGTSTSEVIEGVDLKGKCALVTGASSGLGVETSRSLASAGAAVIMVARDASKLDTAVAQVRAAVPDAQLDTALLDLADLESVRAGAQTILAKCPSIQLLINNAGVMACPLMRTAQGFEMQLGTNHVGHFLLTCMLAPALVAGAPARVVNLSSAGHRFSAMDLDDPNYHRRDYEKWQAYGQSKTANALFSVGLDQRLQGQGVRSFAVHPGMIMTELSRHMDPSDMEIILAGRNIEDIGFKTVEQGSATSVWAATSQDLDGLGGLYLEDCHIAEPATPDNEAGIESYALDPVTADKLWQLSEDMVGENFNF

SEQ ID NO: 6012 - protein, 473 aa, Arabidopsis thaliana
MGAYCDENLSSLPVFSSGAPANELRFSKHVYDNVHGNIYLDPLCLKFIDTEQFQRLRELKQLGVTNMVYPGAVHSRFEHSLGVYWLAGETAQRLKNFQGMELGIDNYDLQTVRLAGLLHDIGHGPFSHMFEREFLPKVISDCQWSHELMSVNMIDHMVDTHHIDIDAQMLKRVKDMILASTEFSQLKGNAEKRFLYDIVANGRNGIDVDKFDYLVRDSRACGLGSNFQFQRLTETMRVLDNEICFRAKEYLSVHKLFATRADLYRTVYTHSKVKAIELMIVDAMVKANNHLEISSMINDPSEYWKLDDTILKTIEIAPDPELAEAKELILRVRRRQLYQFCNEYAVPKDKIDHFKAVTPQDIICSQKHTSLTLKEEDIAVTNVKIDLARGRENPLECINFYKDYDSAEKFVIPEDRVSHLLPTTYQDMIVRVYAKKPELVEAVSEAFENFQMRTYGIKAQVHATPEKKKRRVM

SEQ ID NO: 6013 - protein, 393 aa, Oceanicola granulosus HTCC2516
MRALTYQGKHDVRVETVPDPQIVNPRDAIIEITATAICGSDLHLYDGVIPAVMPGDILGHEFMGRVVETGPGSTLEKGQRVVVPFTISCGQCFHCAQQQFSACDNSNPAEKQDLTEPLYGHPVSGLFGYSHLTGGYPGGQAEYVRVPFSDVGPIVIPDGMDDEEVLFLSDILPTGWMAAENADITEGDTVAVWGCGPVGLFAVQSARVMGAHKVIAIDHYPNRLALARQMGAEVIDYTQTHVLEALMEMTGGIGPDAVIDAVGMESHGFAPDNMLDTIKQTVGMGADAPHALRMAIMACRKGGRISMPGVYGGMADKFPLGALMEKGLQLRTGQTHVQRYTSDLLRRIQEGELDTTFMISHRLPLEEAARGYANFANNQNDWTKVVLKPGMAA

SEQ ID NO: 6014 - protein, 290 aa, Streptococcus pyogenes MGAS8232
MRIADYSVTKAVLDRHGFTFKKSFGQNFLTDTNILQKIVDTAEIDQNVNVIEIGPGIGALTEFLAENAAEVMAFEIDDRLVPILADTLRDFDNVQVVNQDILKADLQTQIKQFKNPDLPIKVVANLPYYITTPILMHLIESKIPFQEFVVMMQREVADRISAEPNTKAYGSLSIAVQYYMTAKVAFIVPRTVFVPAPNVDSAILKMVRRDQPLIEVKDEDFFFRVSRLSFVHRRKTLWNNLTSHFGKSEDIKTKLEKGLALADIKPSIRGEALSIQDFGKLADALKEVGL

SEQ ID NO: 6015 - protein, 246 aa, Brassica napus
  misc_feature (66)..(66): Xaa can be any naturally occurring amino acid
  unsure (1)..(246): unsure at all Xaa locations
EPALCRRGLQGFLRGDGVTRRSLRNAGRQGVTVELAGTNGETTTQGLDGLGERCKKYYEAGARFAXYPIVEPEILVDGSHDIHKCAAVTERVLAACYKALSDHHVLLEGTLLKPNMVTPGSDSAKVAPEVIAEHTVRALQRTVPAAVPAIVFLSGGQSEEEATKNLNAMNQLKTKKPWSLSFSFGRALQQSTLKTWAGKEENVKAAQEALYVRCKANSEATLGTYKGDAKLGDGAAESLHVKDYKY

SEQ ID NO: 6016 - protein, 287 aa, Bacillus licheniformis
MKKKNHKYRGKKLNRGESPNFSGQHLMHNKKLIEEIVDRANISIDDTVLELGAGKGALTTVLSQKAGKVLAVENDSKFVDILTRKTAQHSNTKIIHQDIMKIHLPKEKFVVVSNIPYAITTPIMKMLLNNPASGFQKGIIVMEKGAAKRFTSKFIKNSYVLAWRMWFDIGIVREISKEHFSPPPKVDSAMVRITRKKDAPLSHKHYIAFRGLAEYALKEPNIPLCVALRGIFTPRQMKHLRKSLKINNEKTVGTLTENQWAVIFNTMTQYVMHHKWPRANKRKPGEI

SEQ ID NO: 6017 - protein, 268 aa, Pseudomonas aeruginosa UCBPP-PA14
MSELYQHRARKRFGQNFLHDAGVIHRILRAIHAREGQRLLEIGPGQGALTEGLLGSGARLDVIELDQDLIPLLKLKFGLESRFSLHQGDALKFDFASLVESGEKLRVVGNLPYNISTPLIFHLLEHAPVIEDMHFMLQKEVVERLAATPGGGDWGRLSIMVQYHCRVEHLFNVGPGAFNPPPKVDSAIVRLTPFAEPPHPARDPKLLERVVREAFNQRRKTLRNTLKPLLSVEDIEAAEVDPTLRPEQLDLAAFVRLANRLAELPGNR

SEQ ID NO: 6018 - protein, 287 aa, Bacillus licheniformis
MKKKNHKYRGKKLNRGEYPNFSGQHLMHNKKLIEEIVDRANISIDDTVLELGAGKGALTTMLSQKAGKVLAVENDSKFVAILTRKTAQHPNTKIIHQDIMKIHLPKEKFVVVSNIPYAITTPIMKMLLNNPASGFQKGIIVMEKGAAKRFTSKFIKNSYVLAWRMWFDIGIVREISKEHFSPPPKVDSAMVRITRKKDAPLSHKHYIAFLGLAEYALKEPQAPFCVALRGIFTPRQMKHLRKSLKINNEKTVGTLTENQWAVIFNTMTQYVMHHKWPRANKRKPGEI

SEQ ID NO: 6019 - protein, 175 aa, Oryza sativa
MAPSVMASSATSVAPFQGLKSTAGLPVNRRSSSSSFGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 6020 - protein, 595 aa, Pseudomonas putida KT2440
MPHEGSLLQTAVIFLLAAVLAVPLAKRLQLGAVLGYLLAGVVIGPQALGLIRDTESVAHISELGVVLLLFIIGLELSPKRLWLMRKSVFGVGTAQVVLTGAVIGAIALFGFSQTLPAAIVLGLGLALSSTALGLQSLAESKQLNAPHGRLAFAILLFQDIAAIPLIALVPLLAASGPDTSQGDSLQHGLKVFASIAVVIIGGRYLLRPVFRTVARTGLPEVSTATALLVVIGTAWLMEEAGISMALGAFLAGLLLADSEYRHELESQIEPFKGLLLGLFFISVGMGANLRLLLEMPLVVLGLTLLLVAVKLLLLIGVGRLVGGLNSASALRLGMVLAAGGEFAFVVFKLGKDQGLFDTQTYDLLLMTITLSMAITPLLMLGCARALKRPQPAREVPEQYKQIQTDTPRVVIVGMGRMGQIVARILRAQKIPFIALETSVDTIEMTRMFEQVPVFYGDPLRPEVLHAAKVGEAEYFIITIDDPEAAIHTAARVKRLYPHLKVLARARNRQHVHKLADVGAEPIRETFYSSLEMTRRALVGLGLSDEQAADRIARFTQHDEEVLEAQGQVRDDRAKVMQTAKEARVELERLFDSDAD

SEQ ID NO: 6021 - protein, 253 aa, Triticum aestivum
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGSTMEVVAEQTKAITGKIKDWTNVVVAYEPVWAIGTGKVATPAQAQEVHANLRDWLKTNVSPEVAASTRIIYGGSVTGASCKELAGQPDVDGFLVGGASLKPEFIDIINAATVKSA

SEQ ID NO: 6022 - protein, 902 aa, Saccharomyces cerevisiae
MPPASTSTTNDMITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDDLGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVAQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPVGLFGHLLPRHLEIIYDINWFFLQDVAKKFPKDVDLLSRISIIEENSPERQIRMAFLAIVGSHKVNGVAELHSELIKTTIFKDFVKFYGPSKFVNVTNGITPRRWLKQANPSLAKLISETLNDPTEEYLLDMAKLTQLGKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSVANVGFFSSDRCIEEYSDTIWNVEPVT

SEQ ID NO: 6023 - protein, 380 aa, Clostridium perfringens SM101
MNKNVIGVEISGIRKFYNEVVKFPEAISLTLGQPDFPVPEKVKEAMIRAIEEGKTTYTANAGIVELREEISGLLKNTFDIDFSKDEIIITVGGSEGLYAAMTAILNPGEKVLVPSIAYPAYESISKIIGCEVINYDLNEDFSVNIESLKEGIKQGGKLLVLSYPCNPTGALLSKKSRDELVEIIKENDILVLTDEIYSSLCFEEEYYSVAQCKDIKEKIIYVSGFSKMFSMTGLRIGYVACSKEIYDQIIKVHQYNSSCATSISQWGALEGLKSCMNDVENMKESFKERMNFTYKRLKSMGLEVEKPKGAFYIYPNISKFGLTSEEFCHRLLKEGKVACVPGDAFGKGGEGYIRISYCYSKDELERALDKLEDFIKFLKK

SEQ ID NO: 6024 - protein, 511 aa, Glycine max
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 6025 - protein, 438 aa, Alkalilimnicola ehrlichei MLHE-1
MPQYANHPGRRNHAPEIHLNLNVRGLGQSATLVINERSAALAAQGRHVYRFGLGQSPFPVPGPVEAELKANAHQKDYLPVEGLRNLREAVAEYHRRSQGVELSAEDVLIGPGSKELMFILQLVYYGDLVIPTPSWVSYAPQAHIIGRQIRWVQTRYENDWRLLPEELEKLCAEDPSRPRILILNYPNNPTGESYTADELRGLARVARKYRVVLLSDEIYSELHHRGQHVSVARFYPEGTIISSGLSKWCGAGGWRLGTFAFPRGLHWLLEAMAVVASETYTSTSSPIQYAAVRAFQGGLEIEQYLQQSRRVLQALGRYCWRRLDQAGLSTPRPVGGFYLFPDFSPQRERLVARGIHTAPALCNRLLQETGVALLPGSAFGRPEAELSARLAYVDFDGARVLTAASAEPAGKLSEEFLEHCCPNVVAGMERIVDWVQRA

SEQ ID NO: 6026 - protein, 470 aa, Escherichia coli
MPLNKKDTQGKGVKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 6027 - protein, 584 aa, Bacillus subtilis
MRKTKIVCTIGPASESIEMLTKLMESGMNVARLNFSHGDFQEHGARIKNIREAAEKLGKNVGILLDTKGPEIRTHTMENGSIELNAGSKLVISMTEVIGTPDKISVTYEGLVHDVNKGSTILLDDGLIGLEVLDVDAVKREIKTKVLNNGTLKNKKGVNVPGRKCQSSGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMITSLEKASALITEEGGLTSHAAVVGLSLGIPVIVGLENATSILTDGQDITVDASRGAVYQGRASVL

SEQ ID NO: 6028 - protein, 317 aa, Candida glabrata CBS 138
MMMLNRLKCLGKGPLRFYSVHSDTAGATKTILDLQRKYVERKPLTMCTAYDFITASWVQKADTDILLIGDSMGMTSLGYDSTSSLTLDEFKYHVKSVCRAEGPSFIVSDMPFGSFETSISQGIQTAIDLMRSSSKVKSMKIESGSCHSDHHTYKLIGELCSRGIPVMGHIGLTPQRQHSLGGFKVQANKSVQEIHDLLASAKKLEELGCWGIVLECIPQRVAGFITKALSIPTIGIGAGNQTSGQVLVVSDLLGFLDSTPPKFVKEYDNLGQRAIDSIKAYNSDVTTKAFPETGKHNFKIKEDIWNQFLSEVKVDKT

SEQ ID NO: 6029 - protein, 354 aa, Gibberella zeae PH-1
MSLPSTMKAVVFDGLYKISVQDRPVPQIRDGRDIIIKVHAAGLCGSELHIYRGHQPSGTGFIMGHEFTGTVVQVGSDVKTIHIGDKVVAPFTASCGNCFFCNNGCSARCVESQLFGCEILNGGQAEYVRIPMADGTAVKAPETISDEALLLMADIFPTGFYGVKSAMELVPSQNIQEATMVVVGCGPVGLCAILAATHFKPRHLFAIDSVESRLEQARKLGAEPLNFETDRAGLEARIREVTEGRGADMVVEVVGQAPALRTAFDIVRPFGAISSIGVHNKEIPWTGDDAYTRNIRVQMGRCPVRSVFNEALHLLEQKQDKIGFLFDHKMPLAQAPEGYTLFEQRKTQKVVFTL

SEQ ID NO: 6030 - protein, 357 aa, Cryptococcus neoformans var. neoformans B-3501A
MAISPSTKGQNGILNGVANGHHINGTNGTCGAHVKPRVFALDPLHSEALTLAEKHFDLVLPGHEGENQWQEEAQGLLVRGSYVTAEDLERATSMKGGKLKYISKQGTGVDKIDIVNAKKLGIPVMNTPGVNAQAVAELAFGMMLSLARQTPSIDRKIRKGASVTKLDGWKGQMLYGKTLGVIGGGNIGLLVAKMFAGAFSGKIVLYDPYLKSLDTWHSAIPNASIHKVSEIDELLTTSDIVTIHVPLTPSTENMISAPQFKTMKPTAILINTARGGIINEEDLSQALLNEEIFAAGLDAFTVEPPSLERYPDLCASERVLMLPHIGAACESVQQATCLAMVQNLVNAFEGKVENRVY

SEQ ID NO: 6031 - protein, 222 aa, Prunus avium
  misc_feature (138)..(138): Xaa can be any naturally occurring amino acid
  misc_feature (193)..(193): Xaa can be any naturally occurring amino acid
  unsure (1)..(222): unsure at all Xaa locations
MSMLKSSLAFLVLAFVFFLCFIMSTGSYVYFQFVQQWPPATCIRSNKPCSKHRPLQIFTIHGLWPSNYSNPRMPSNCTGPQFKRILSPQLRSKLQTSWPDVESGNDTKFWESEWNKHGTCSKETLNQMQYFERSYAMXMSYNITEILKNASIVPHPTQTWKYSDIVAPIKAATKRTPLLRCKQDKNTVLLHEXVFCYEYNALKQIDCNRTSGCQNQPAISFQ

SEQ ID NO: 6032 - protein, 407 aa, Arabidopsis thaliana
MALSSLLRSAATSAAAPRVELYPSSSYNHSQVTSSLGFSHSLTSSRFSGAAVSTGKYNAKRVQPIKATATEAPPAVHSFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 6033 - protein, 236 aa, Prunus avium
MGMLKSSVAFLVLAFAFFFCYVMSSGSYDYFQFVQQWPPTNCRVRIKRPCSNPRPLQNFTIHGLWPSNYSNPTMPSNCAGSEFKERKLSPKLRSKLKRSWPDVESGNDPRFWEGEWSKHGKCSEQTLNQMQYFQRSHEMWQSFNITEILRNASIVPHPTQTWTYSDIVSPIKAVTQTTPLLRCKFPPKSQTKSQPKSQATSQLLHEVVLCYDYDALRLIDCNRTAGCGNQQAISFQ

SEQ ID NO: 6034 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTTGFHGAELADIQMGSSVVVIGIGAVGLMGIAGAKLRGAGRIIGVGSRPICVEAAKFYGATDILNYKNGHIVDQVMKLTNGKGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 6035 - protein, 471 aa, Sulfolobus solfataricus
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWTDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 6036 - protein, 468 aa, Dehalococcoides ethenogenes 195
MSIEIQFLGAARNVTGSRYLIKTDHTQLLVDCGLYQERRLQDRNWQPFEIPPQSLSAVIISHAHIDHCGLLPKLVKEGFAGPVFATEATAEIARISLTDAGKLQEEDAAFKKKRHEREGRKTKYPEIPLYTAEDARAVSPLFKTVEYSREIAVTEDITATFHNAGHVFGSASIELKIQENHRQKVIVFSGDLGNWDRPILKNPDLVNQADYVVIESTYGDRTHQDINEASLKLAEIINQTVKLGGNIVIPSFALERTQDLLFFLNRFMSEGKIPSLKVFVDSPMAISITKIFKEHPELYDRETSGWVNNGSSPFEFEGLHFTNKAADSKAILAEKDPCIIIAGSGMCTGGRIKHHLVNNISRPESTILFVGFQATGTLGRLITDGAKEVRILGQHYPVQARIEELRAFSAHADQPTLLRWLKGFKNKPEMVFVTHGEPETSARFTETIKNTLGWQAKAPEYQEKFILD

SEQ ID NO: 6037 - protein, 381 aa, Arabidopsis thaliana
MSHSAVSQAGAVSVSIENQRSLRRSVFKNNSISFNSKSWSSSLALNQKTTSIRDGKRYPSTTICMSVQQTSSSKVTVSPIELEDPKDPPLNLYKPKESYTAKIVSVERVVGPKAPGETCHIVIDHDGNLPYWEGQSYGVIPPGENPKKPGAPHNVRLYSIASTRYGDFFDGKTASLCVRRAVYYDPETGKEDPSKNGVCSNFLCDSKPGDKIQITGPSGKVMLLPESDPNATHIMIATGTGVAPYRGYLRRMFMENVPNKTFSGLAWLFLGVANTDSLLYDEEFTKYLKDHPDNFRFDKALSREEKNKKGGKMYVQDKVEEYSDEIFKLLDNGAHIYFCGLKGMMPGIQDTLKRVAEERGESWDLKLSQLRKNKQWHVEVY

SEQ ID NO: 6038 - protein, 213 aa, Streptomyces griseus
MSAATSPSERRVSARIGAISESATLAVDAKAKALKAAGRPVIGFGAGEPDFPTPDYIVDAAVEACRNPKYHRYTPQRAPELKAAIAEKTLRDSGYEVDAGQILVTNGGKQAIYEAFAAILDPGDEVIVPAPYWTTYPESIRLAGGVPVEVVADETTGYRVSVEQLEAARTEKTKVVLFVSPSNPTGAVYSEADAEAIGRWAVEHGLWVMTDEI

SEQ ID NO: 6039 - protein, 276 aa, Clostridium tetani E88
MAFTREQIYENLKKQIEEGKSLVGAGAGTGISAKCAQAGGVDLIIIYNSGRYRMAGRGSLAGLMPYGDANAIVLEMANEVLPIATETPVLAGVCGTDPFRLMDKYLQSLKDVGFSGVQNFPTVGLIDGVFRQNLEETGMGYDLEVEMIKKAHEIGLFTTPYVFNEEDARKMAKAGADVLVAHMGLTTKGSIGAQTALTLDDCVERIQNIADAGREINPDIMVICHGGPIAEPEDAKYIIEKTKGINGFFGASSIERIPTEKAIKEQVLNFKKIEIK

SEQ ID NO: 6040 - protein, 110 aa, Nostoc punctiforme PCC 73102
MNQISVEELAQRLSSGDGSIQLVDVREPEELAIANIEGFVNLPLSQFAEWGHEIPTLFNPQAETLVLCHHGIRSAQMCQWLIAQGFTNVQNISGGIDAYSILVDHSIPQY

SEQ ID NO: 6041 - protein, 330 aa, Clostridium tetani E88
MEVMMKGSAAIVKRLSKEEGISGIISLGGSGGTSIASYAMRALEVGIPKVMVSTLASGDTRPYVGEKDITMIYSVVDISGINTLSSKILSNAAYALIGMVKGKAPELKGEKPLIGATMFGVTTKGVNIAKEYLENNGYEVLVFHATGAGGRAMEDLIRSGYIKGVLDMTTTEWCDEVVGGVLNAGPNRLEAASDMGIPQVVAPGALDMVNFGPIETVPEEFKKRNLYKHNATVTLMRTTKEENIEIGKVIGEKLNRAKKDTALFIPLKGVSAIDAEGEVFYGYEEDKALFNTLKETVNKDKVQIVEMNNNINDEEFAIAMAKKLINMMEK

SEQ ID NO: 6042 - protein, 222 aa, Leptospirillum ferrooxidans
TQALDIGAMSVFFYTFREREELLDLFEIICGARLTSNYYRVGGVDADLPKEFITRLYKFLDTFEKNIGEYNTLLETNRIWLARTKNIAVITGEDAINFGVSGPSLRGSGVDYDLRKYEPYGVYDQVEWSVPVGTNGDVYDRYWIRIEEMRESSKIIRQCLDRLPAGKILTDDHKITFPDKGKVMHNMETLIHHFLLVSRDSRFLQEILTGTETPRELGFYIV

SEQ ID NO: 6043 - protein, 233 aa, Ashbya gossypii ATCC 10895
MTSVEVRRVLEQLLRDPCNQQCADCKNSAHPRWASWSLGVFVCIRCAGFHRSLGTHVSKVKSVDLDTWKEEHLQQVVRFGNNQQANKVFEGRLGGGSYVPDQSKMGQFIKTKYEVRKWYLEEGACEPALPEAAPAAASPLPVSVPMSPAGVGREASASPALAVSPAPASPPVYSANARPDLKKSILSLYAKPRQQSPGVASSASSLNSAAASAGVSYSAASLEDNELFKNVWT

SEQ ID NO: 6044 - protein, 429 aa, Bacillus subtilis subsp. subtilis str. 168
MHTKSIELHNEALQHIVGGVNSPSRSYKAVGGGSPVAMEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 6045 - protein, 157 aa, Glycine max
MQASRARLFKEYKEVQREKAVDLDIQLVCDDSNIFKWTALIKGPSETPYEGGVFQLAFSVPEQYPLQPPQVRFLTKIFHPNVHFKTGEICLDILKNAWSPAWTLQSVCRAIIALMAHPEPDSPLNYCAGNFLRSGDVKGYPSMARMYTRLAAMPKKG

SEQ ID NO: 6046 - protein, 491 aa, Ralstonia solanacearum
MGTVSVEPGSYRAEPPRNPGEVIDLIRQRAVQVVDLRFTDLPGLWQHFSITLPEVNDELFEAGIGFDGSSIRGFQEIHESDMLVRPDPATAFIDPFCETTTLALICDVIDPVLHQPYSRDPRHIAKKAERHLQHSGIATTCYFGPELEFFIFDSIRFGQDQHSGYYHVESAEGEWTSGRDEGAYGGGNLGYKQRYKEGYFPVPPHDTLQDIRSEIVLALMQAGIRVEVHHHEVATAGQNEIDMRFAPLTRMADNVMMYKFICKNVARRHGKVATFMPKPLFADNASGMHCHQSLWKDGENLFYDAGGWALTSQLCRWYIGGLLKHAPALMAFCAPSTNSYKRLVPGYEAPVNLAMSQRNRSAAARIPMYSDAPAARRVEFRCPDPSANAYLAFAAMLMAGLDGIAHQTDPGEPLDRNIYELPPEEAEKIRQVPGSLEESLEALEADSYFLRKGDVFTDDVIRTWIDYKRTREIDTLKLRPHPWEFYLYFDI

SEQ ID NO: 6047 - protein, 110 aa, Glycine max
  misc_feature (20)..(20): Xaa can be any naturally occurring amino acid
  misc_feature (48)..(48): Xaa can be any naturally occurring amino acid
  unsure (1)..(110): unsure at all Xaa locations
WLWRGCVSLSVKEIRVLFCXQSSSVRDSTREFVQIIYCEIKSCNPSLXFLIIECSGVQHQLWASYIMGAKKCIYSDGMTEALIDKKLEDLALPVESLKTKIVSELESCLV

SEQ ID NO: 6048 - protein, 511 aa, Geobacillus kaustophilus HTA426
MSKQPVALIILDGFALRDETYGNAVAQANKPNFDRYWNEYPHTMLKACGEAVGLPEGQMGNSEVGHLNIGAGRIVYQSLTRVNIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVKGYVAFKPTNLDNTLGEVLSQHGLRQLRIAETEKYPHVTFFMSGGREEKFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 6049 - protein, 253 aa, Geobacillus kaustophilus HTA426
MRKRIIAGNWKMHKTLAEAVQFVENVKGHVPPADEVDSVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQEQIDGALVGGASLEPASFLQLVEAGRHE

SEQ ID NO: 6050 - protein, 335 aa, Geobacillus kaustophilus HTA426
MAVKVGINGFGRIGRNVFRAALKNPDIEVVAVNDLTDANTLAHLLKYDSVHGRLDAEVSVNGNNLVVNGKEIIVKAERDPANLAWGEIGVDIVVESTGRFTKREDAAKHLEAGAKKVIISAPAKDEDITIVMGVNQDKYDPKAHHVISNASCTTNCLAPFAKVLHEKFGIVRGMMTTVHSYTNDQQILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTASSTIDALSTMVIEGKMVKVVSWYDNETGYSHRVVDLAAYIASKGL

SEQ ID NO: 6051 - protein, 224 aa, Prunus avium
MAILNSTLAFLVLAFAFFFCYVMSSGSYDYFQFVQQWPPTNCRVRIKRPCSNPRPLQYFTIHGLWPSNYSNPTMPSNCNGTQFKMQNLFPYLRSRLKMSWPDVESGNDTKFWEGEWNKHGTCSERILNIMQYFQRSQAMWKSHNITEILKNASIVPHPTQTWKYSDIVSPIKSATGRTPLLRCKQDKSTQLLHEVVFCYDYNAIKQIDCNRTAGCGKQRDISFQ

SEQ ID NO: 6052 - protein, 228 aa, Prunus avium
MGMLKSSLAFLVLAFAFFLCFIMSAGDGSYDYFQFVQQWPPTNCRVRIKRPCSNPRPLQYSTIHGLWPSNYSNPTKPSNCNGLKFEAKKLSPEMQTKLKKSWPDVESGNDTKFWEGEWNKHGKCSEQTLNQMQYFERSFAMWKSYNITEILKNASIVPHPTQTWKYSDIASPIKAVTKTTPLLRCKRDHPNKPELLHEVVLCLDYNGLIQIDCNRTAGCRNQQAISFQ

SEQ ID NO: 6053 - protein, 301 aa, Clostridium perfringens SM101
MLRILLNDGLDKKAISNLEMLGCDVDTNHYDIEDLKEKIKEVDCIVIRSATKIRRELIDEAIKGGKLKLIIRGGVGLDNIDVKYAEQNGIKVRNTPNASSSSVAEIILAHMFSLARFLNQSNITMKAGLWKKKEYVGVELEGKTLGIIGMGRIGSELAKKCTALGMKIIYFDLMDIKNIDNNYRKVEFDELLRESDFISINISGTKSIIGSEELKKVKKGAFIINTSRGKALDEDAIITSLNDGTLGGIGLDVFLEEPSKNLELIKHPKVSLTPHIGASTKEAQMKIGEEVINIIKEEMYK

SEQ ID NO: 6054 - protein, 308 aa, Oryza sativa
MDGGGGGGGGGGVMAGPGVAGGGGGGGGGGVGGDVELVSKTLQFEHKLFYFDLKENPRGRYLKISEKTSSTRSTIIVPVAGVAWFLDLFDYYIRTDERDAFSKELRLDTKVFYFDIGENKRGRFLKVSEASVNRNRSTIIVPAGSSGEEGWEAFRNVLLEINNEASRLYVLPNHPNQQHLEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVESSQR

SEQ ID NO: 6055 - protein, 287 aa, Brucella melitensis 16M
MADMPKPQPGRFSNQSLGAEAEMSFALSPVAANEGYRLETFEAVGSTNAVALERAAGGDPGKLWLVTKKQESGRGRRGRAWSTPEGNLASTLLLVESYEMKTAATLGFVAGLSLADALDAVFAATGPAVPPTIGLKWPNDVLVNGAKLTGILLESSILAKNLFAVAIGIGTNVVAFPDDPPYPATSLRALGSKCDAETLFAALSDAWSVNYRVWNEGRCLDDIRKRWLKRAHGLGQHVTMQVEGRVVEGRFETIDEACRFVIREDEGSRVAVTAGDVYFGTAATIRK

SEQ ID NO: 6056 - protein, 205 aa, Glycine max
MAASSTSQVYIQVIDDVMIKVRDEFVNNGGPGDEVLKELQSIWESKMLQAGAIVGPIERSGAPKPTPGGPITPVHDLNMPYEGTEEYETPTAEMLFPPTPLQTPLQTPLPGTVDNSMYNIPTGPSDYPSAGNEPGENNEIKGGRPGPYMQPPPWTSQNQNQRAPLDVNVAYVEGRDAAERGASNQPLTQDFFMSSGKRKRDEIAS

SEQ ID NO: 6057 - protein, 595 aa, Clostridium tetani E88
MDKKVILKTMENSIKNNKPIIGVAIGSGFSANQASKGGADFILVLNAGKFRNSGISSLACLLPFGNSNNMMFEMGEREILTKKLGNPIIFGACASDLTISKDKLIDNIIEAGFHGVNNFPTVGIIDGSYRQALEEDGMGYSEEVELMKKAVQRGLFTIAFVFNEKQSEEMTKVGVDVICAHLGWTLGGDTNVKNRTTLKEDINLVNNIFKASEKYNKNIIKMVYGGKIEDADMAGYFYDNTDAVGYIGGSSFERIPSERIIKSVTHEFKNFNKLNNDKIGFKEMIGQSNSMKELYELIEKVADKNVNIMVTGESGTGKELVVRALHYGGERRDNPFVKVNCAAMPKDILESELFGHEKGAFTGADKKRVGRFELAHKGTLFLDEIGDMDLSIQAKFLRIIQQQEFERVGGNKTIKVDVRIICATNKDLKKEVKEGRFREDLYYRLNTITLYVPPLRERKEDIPFLIHHFLKEKGKKFDKIAPKISPEVFDALMEYDWPGNVRELENAMERAIILCGKDLIRLNNLPISIVKNNKEFDESKHVTPIDIKEITIRNMEREIIIEALEKCDWNRTKTSKSLGISRRTLYNKMKEFNIR

SEQ ID NO: 6058 - protein, 842 aa, Acidobacteria bacterium Ellin345
MDKTDIWSENMSNTPVTAQPSNDAHTLLKQYGCGPIPFSGTDNAFYERHFVFDKVLDKRESTARDQFEAFARSVRDVLSQRWVLTEQIYGRQNAKRIYYVSMEFLIGRSLANNVTNLLLDPLIQDSLKQKKLDWIELIEQEPDAGLGNGGLGRLAACFLDSMATLQLAAMGYGLRYEYGIFKQSINDGWQEETADNWLRHPDPWEVARPNEAVEIKLNCSFELHNGVLRAIPGRPSTMIGIPYDRPVVGYGGKTVNTLRLWAASAADYFDFREFSGGDFVGALAETLTAETLTRVLYPDDSTSFGQALRLVQEYFLAACSVADLIRRFRKHNSDWNLLPEKVAVQLNDTHPALTVPELMRVLLDEANLGWETAWDLTRRTLAYTNHTLLPEAMEKWPVAWFELMLPRHLQIMLEINQRHLDAVRTKFPGENERCTRMSLLEEGSPKKLRMANLAIVGSHSTNGVAALHSQLLRTTTLKDFGEMFPDRFNNKTNGVTPRRWLLLANPALARNITEAIGDGWIRDLDQLIKLKPLAEDCAFLAAIRKSKYQAKSEFANWLLRTSGVKLDPDTIFDSQVKRIHEYKRQLLNALRIVVLYNRLRQNPELAMAPRTFLFAGKAAPAYHFAKLVIKFINNLAGTIEGDPVVRGRLRVVFLPDYSVSMAEHLIPATEVSNQISTAGYEASGTSNMKFMMNGALTIGTRDGATIEMAEAAGEENFFLFGLTADQVSQNRTWYSPRWHYENEPETRAALELIFSNHFSRHEPNVFEPFRQLLLDKGDYYMHLADLGSYLAADQQLTALYKITDAWASKAVLNVAHAGRFSSDRTIAEYAADIWDAKPCPVS

SEQ ID NO: 6059 - protein, 100 aa, Zea mays
RVHRVGFDLHPHSAEGVLIVGVPFPREVSAQKGVKSSFNKMSHHAWKVEKSYPTPKFEKVQFLKKVKNHCEFCFRGGRSFVINRSHSLKFCFLYQKKFVL

SEQ ID NO: 6060 - protein, 466 aa, Mycobacterium sp. JLS
MIDSRTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYRPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 6061 - protein, 391 aa, Streptococcus agalactiae 2603V/R
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 6062 - protein, 272 aa, Vibrio vulnificus CMCP6
MEHKNIAFIGAGNMVRAIVSGLVANGYPADKITATAPSETRRLPLEQQFGIQTTSDNLMAATQADVIVLSVKPQMMEEVCKPLQSVDFSNKLVISIAAGINCARLNDMLATQLNLVRVMPNTPSQLGLGMSGLYAPASVAEQDRHFAEQLMQAVGKTCWVDEESGINHVIAAAGSAPAYFFLFMEAMQAEAMAQGFDKQTARLLVQQSALGAASMVVENPDTELATLRENVTSKGGTTAEALRTFNEHQLSDIVAKAMQAAVARAQEMEKLF

SEQ ID NO: 6063 - protein, 1160 aa, Ralstonia solanacearum
MTRNPTVLLVDDALWYKDAVIYQLHVKSFCDSDNDGVGDFPGLISKLDYIAELGVDAIWLLPFYPSPRRDDGYDIAEYRGVHPDYGTMADARRFIAEAHARGLRVITELVINHTSDQHPWFQRARRAKAGSALRDFYVWSDHDKKYAGTRIIFIDTEPSNWTWDPVADAYYWHRFYSHQPDLNFDNPRVLKAVLGVMKFWLNLGVDGLRLDAVPYLVEREGTANENLPETHAVLRKIRAAMDAEFKNRLLLAEANQWPEDTQEYFGNGDECHMAFHFPLMPRMYMAIAREDRFPITDIMRQTPEVPPTCQWAIFLRNHDELTLEMVTDAERDYLWEVYASDRRARLNLGIRRRLAPLLERDRRRVELMNSLLFSMPGTPVMYYGDEIGMGDNIHLGDRDGVRTPMQWSPDRNGGFSRADPEQLVLPAIMGSLYGYESVNVEAQTRDAHSLLNWTRRLLATRKRHRVFGRGSIQFLQPANRKVLAYARALEGEAPILCVANLSRASQAVELDLAAYAQRVPVELIGGTAFPPIGQLPYLLTLPPYAFYWLELRENEPGPSWAQPAAEQLPEFTTLVLRAGLDALADTRQREAHRQLVEREILPTYLPKRRWFAAKDSVLRGAHFAWGTELPVDAASTNRPLAGATRPEVFINEIAVTLGDADGTERTERYLLPLSIAWESATLPALPIQLALARVRRGRHVGYLTDAFTTETFARVLLANLVRGVTLEASDGRVHFEPEPHLAELAEPPVAAETAAVRPAPLPLAPDAPVQWLAAEQSNSSLVIGESVIVKLIRRVAAGVHPEVEMTRHLTRIGYANTAALIGEIAHEGADGERSTLAVLQSFVPNQGDAWTWALDYLRRTIDELAVLTEAVSAGDGDAAPTAVSEARTDTDEALAGYLAFIGAIGTRLGELHVALAGPSDDPAFGTRAADADDAAFWTARVDEELARALDHLAAWQAANGPRAEVGWLLSQRDALLEAARERAQGGLGAMLARVHGDFHLGQVLVAQGDAYLIDFEGEPSRPVDERRRKTSPLRDVAGLVRSLDYVVGAMRQGPEHVAGPAQERRDQLLERFRNASTERFLEAYAAAILASGSDDGACMLDLDLLDLFLLEKAAYEVNYEAANRPTWLPIPLAGLARVARRLLPADVAPPVARDPLGGPP

SEQ ID NO: 6064 - protein, 243 aa, Leptospirillum ferrooxidans
MISSLPGERVSMSLFLGTGASSGVPVIGCSCPVCISTDKKNRRTRSSVLVRCAGKNLLIDTSPDLRYQSLKNGVVTIDGVIFTHPHADHVLGLDELRIFNYIQKREIPVYADSYTLSRVQMMFPYAFSEANRGGLSRPKLIPHEITGPADILGMSVISFPVYHGPVMNHAVRINDLVYLTDCKGIPDESWEALYGVETLIVGAVKYEPHESHFGIHEALALIERLNPKRAFITHLSHSLEHEE

SEQ ID NO: 6065 - protein, 542 aa, Aspergillus fumigatus
MIEAKMTPFEFNQHVNADRLARKLSARQVQMIAIGGTIGTGLFLGTGKALATGGPASMLISYAICGGIVFVTMLSLGEMAAFIPIAGSFCTFAGRFVDDALGFALTWNYWFNDAVSTAADVIALQLLLQYWTDNFPGWAISLIFLIFVILLNVMSVRIYGEIEYWLSLLKVITIIIFIILGIVVNCGGNKDHKYIGDKYFYVGDAPFVGGIGGFASVFVTASFAYGGTESIAITAGETKDPAKNLPRVVRNVFWRIVLFYIISIILIGLNVPYNYPNLSKKTTATSPFTIVFMEAGSAVAGSFINAVLMTSVISAANHALFAGSRLLYTLAVDGHAPHFFGHLNRFQIPWVAVLATSLVSGLCFGASYIGAGQLWTWLQNETSIVGVSNQISWVCIGIASLRFRAAIRRQNLEHLLPFKNWTYPVGPIIAVGLNIVLILVQGWSCFSPSFQAVDFVSFYIEIPIMIVMFLAWKLVKQTRFVHLDEMDLVTDRYDLNAEHAESDGNADGDSPSRVGRILHIKQLQSEKGVLGKLKRVGMWLFL

SEQ ID NO: 6066 - protein, 373 aa, Oryza sativa (japonica cultivar-group)
MERELLEAFEAARKAADAVGEAAAAAGAGEGESPEAARCVDALRRLRGARVTTAALVSTQIGRRIRYLTKHPHSSIKATASDLLGHWKKVVIEEDKKNGALQNGKSSSTVVKVEKVEPMKVEKASPRATVNNNNMDTRVVNHKGGKVEKFSNAELRTQSIKVEKVQKVVHKVSSVEKPSPVQGGPPRLTSVVKCGDASRDRIRAILGDAFSRVSEETRKDDREEVRNIIEEVKACDPFRIAVMVECALFQKLGNFNGPNKQRYRSLMFNLKDDHNTDFRRRVLLGQVQPERIADLTPTEMASDTRKLENKKIEEKALFECERGGAPKATTDQFKCGRCGQRKTTYYQLQTRSADEPMTTFVTCVNCNNHWKFC

SEQ ID NO: 6067 - protein, 451 aa, Trichodesmium erythraeum IMS101
MSDKKPNLEKDIFKYLKKKGTKFVRILFCDNANIIRSKAFHIDQLPEHFDTGVSITVAQQAFTVMSDVVIPETGLAPVGEAWLVPDWSTLHILPYAPTHASVVSDMFKDGSPWSLCPRRFLKQAIATAEKVGLQIKAAFENEFYLLKSTSDGIAPTDNTVFASTFGMDINRLVIDDIAESLIAQKIQVEKYYPESGPGQQEISIRYTDALQAADRQISFRETVRGVALKYGLTASFLPKIFANKAGSGCHLHLSLWEGEQNIVPDSDEIGKISKTARCFIAGILKHLPALMALTTPSVNSYRRIRPHFWSGAFRTWGLDNREAAVRVPSNFAPPSPTHFELKTVDASANPYLALGSVIVAGLDGINCGLDVGEPVSVDPGNMMQAEREARGIDALPSSLAEAIAHLNNNDVLKNALGSELAQAFIAVRQAEWEEMKNMEIEEEVKILLSRY

SEQ ID NO: 6068 - protein, 118 aa, Brassica napus
QPWKRSLLRHHTISNPLPKTKHLFKPSLLPLVASSQSSCWLCNSPPKLRIPKLRIRDGSSHGLRIHSLLHNEGEGEDNLGESNGFGFFPGDIFSISQVLFFLWILKKLNTLLQFLSWL

SEQ ID NO: 6069 - protein, 797 aa, Escherichia coli CFT073
MSQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRGNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLKKEWANDLDQLINLEKFADDAKFRQQYREIKQANKVRLAEFVKVRTGIEINPQAIFDIQIKRLHEYKRQHLNLLHILALYKEIRENPQSDRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 6070 - protein, 519 aa, Coxiella burnetii RSA 493
MTQADNQNPKPMVLIILDGFGESDETTHNAIKEANTPTLDKLFRHYPHTLLEASGRAVGLPDGQMGNSEVGHLHIGGGRKVPQDLTRIDAAIASGEFYENPALIEALEKAKALNKAVHILGLLSPGGVHSRDNQIAALVELAHRCGIKKIYLHAILDGRDTPPKSALLSIEKITDQFHAYGNGKIASLIGRYYAMDRDKRWDRTEKAYDLLTQGTAQFHALTAKEGLMLAYEQGNTDEFVSPTSIHRHNETPITIEDGDVVVFMNFRADRARQLTYAFLDDHFTAFNRQVRPKLSAFVTLTAYAKDIHAAVAFPPLELHNTLGEYLSARGYRQLRIAETEKYAHVTYFLNGGQEAPFNGEDRLLIPSPKVATYDLQPEMSAVEMTNKLVEIIQNDDYDLIVCNFANPDMVGHTGDETATREAIQVIDDCLKRIITALQSVGGEALITADHGNAEKMFDEKTNQPHTAHTSNLVPLIYVGREAQFCKEVGALDDVAPTLLYLMGLEKPREMTGRNLITLK

SEQ ID NO: 6071 - protein, 411 aa, Leptospira interrogans serovar Lai str. 56601
MVGRMISFPKDKIQVLLLENVHQDAFDMFQKDGFNVRLLPAAFSEKELLDEIENIHVLGIRSKTNVTSAVLEKAKRLLTIGCFCIGTNQVDLVGAEKKGIPVFNAPYSNTRSVAELVISEIIMLARRVPDHIRNTHSGIWNKISKNCFEVRGKTIGIVGYGHIGSQVSVLAEAMGMKVIYYDIQTVLPLGNATPVSSYEELLKNSDFISFHVPETPQTMNLYGKKEIEVTKKGAYMINLSRGKVVDLEALAKAIQSGHIAGAGIDVFPEEPESNNDPFLTPMQNLPNVILTPHIGGSTEEAQRNIGSEVASKLLKFINNGSTTFSVNFPNLEITPLPAGQYRILNVHKNQPGFLKDINSMVSAIGANISSQHLGTSAEIGYLSMVIDKSVGDELKEKIEKHPFSIKTRILY

SEQ ID NO: 6072 - protein, 400 aa, Vibrio sp. Ex25
EIRTIKLEGGNDVDLVAGQEFTFTTDTSVVGNKDKVAVTYAGFAADLNVGNTILVDDGLIEMEVISKTETEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIANRTDSALKAELGSRLDSPRLRITEAVCKGAVDTAEKLAAPLIVVATEGGKSARSVRKYFPTANILALTTNKKTAAQLVLTKGVTPVVVDSIESTDAFYVAGKELALESGLGNKGDIVVMVSGALVASGTTNTASVHVL

SEQ ID NO: 6073 - protein, 632 aa, Ustilago maydis 521
MIRASLLAYLSLLLAVLQQANSTSADLVDDAQLYATENQNVWVPVPKKGYYIESDIPAHAQFKEQQGRTRKIAIIGAGPSGTSAAYFLKHAQDRLASSNDSSIAGDKLDLTIYERETRIGGRAAVTYPYDDNTQDPVELGASIFADVNLNIRRAVKDFDLETGAKVGLSGQMGIWDGQQFLFEGDQSSWWTSAKFFLRYGYSAITTENIVKTQLSYFAGLYRPSFLHARKGKSNTSVSGYPWSRIEDLADAINATSLVQTTGMQFFKDRRVSELFIEEMVEAATRVNYAQDTDKIHGFGALVSLAASGATGVKKGNYRIFEQFASRSGARVLTGVEGQVTGIVRFNSTVPVPRRLGLQEGAEMEEQVQWYIGTKSGEGELYDAVIIATPWHNADITLLNTRERVKSKPFVHLHVTLLTTSRERPRSEYFGLGEQDLVPTTILTSSESVRRASADRRNKPHVPETPSPPDESAHSTTPRFGAKDELKKPKLEFFSLNYLRSVRPPRSTSDSSSAKDYVVKIFSAQPMSDDQLSALFGDTISWIKRHSWDSYPYLTPTDRYPRIQVDHNLYYSNAIESLVSTMETSTVASKNAVALMLRSWYGDDFVNGNHCNSSVPIDPLDNPNWAGWGCDSG

SEQ ID NO: 6074 - protein, 462 aa, Chromobacterium violaceum ATCC 12472
MPAGWEARANTADRGFMDSALIINQWLDEHHITEVECLIPDMTGLARGKIVPRHKYDPAVGLRLPEAVLSMTVTGDYPDRDFTSVADPDMKLLPDLSTLRPVPWNKEPTAQIIHDCYSFAGDAVDLAPRNVLKRILKLYEDQGWKPVIAPEMEFYLVEIQPDEDLPLRPPVGRTRRTEAGMQSFSIDAVNEYDDIFDVMYDWCEAQGLALDTLIHEMGTAQMEINLDHGDPLQLADQVFLFKRTVREVAIRNNMYATFMAKPMQGQPGSAMHMHQSVVDIASGGNIFSLDDGQPSEAFLHFIGGLQRYLPAAMPFFAPYVNSYRRLSRYTSAPINLSWGYDNRTCGLRVPHSDPEARRVENRLAGVDVNPYLAMAASLACGYLGMRDRIDPSEPLSGSAYEQPHQLPRHLDDAIDMLLRCRPLSELFGEHFIETYAAIKEAEYREYFDVISPWERRFLLLHV

SEQ ID NO: 6075 - protein, 429 aa, Xanthobacter autotrophicus Py2
MPLPSPFHLCYPVPPPPSGAQDAGRGAVIPRSPAMLITTAPFDRIGEENAFAVLARATALAGQGRSILNLGIGQPDFRTPDHIVEAAVKALRDGQHGYTPSVGILPLREAVAADLNRRYGVEVDPDLVMIMPGGKVTMYAAIRLFGEPGAEILYPDPGFPIYRSMIEHTGATPVPVPIREENGFAFSAEETLALITPKTRLLIINSPANPTGGVTPAAEIDKLVKGLAAHPHVALMSDEIYDRFLFDGEEHRTLLAYPQIRDRLILLNGWSKTYAMTGWRLGYSIWPKDLYDKVRKLAVNCWSCVNAATQYAGIAALEGPQDAVDAMTAEFDARRRIVVDGLNALPGVRCATPKGAFYAFPNVSGTGWSEAKKLASALLEEAGVAVIGGPDFGVYGEGYLRLSYATSRENIAAALARMGDFLAANRKVA

SEQ ID NO: 6076 - protein, 606 aa, Aspergillus nidulans FGSC A4
MLEDESGRLRLTGSKLQSVQLATGVIIAVLGTENANGDFEAIDIKVPDLARQPRRWERDEAKAPKEAKKGKIAMVSGLGITGTSSDTLALELLTDYLLGYTGSSKGEEGSPPDASRITRLIIAGNSLGASTIEAAPATDGVPAKKIAHQKKYGYDASAYNASPITQLDSFLAELLPSIPITLMPGESDPANFALPQQPIHRAMFPRSRAYCSAPPIGEDKVEPGWFDSVTNPWEGDVEGWRFWGSSGQNVDDVLRYLDFADEDGNVDMNGDTEARIRVMEAMLRWRCGVPTAPDTLWSYPFQTHDPFVMESCPHLFFAGNQPQFKTAVIEGDLPLRPDGEDTEMGGTAQNAAVPTVRLISLPKFRETAISTSKVLLVPYSKWHVPRYHEWMKDEEIQQATASEPLSLSEEYAMQQSWRNDADKLTFIICLPVAPETDNGNLSLTDEDDAPTRMIGDINLFLRVEEDEEDGDEERNSSNPQIIGEIELMIAEKKDQGKGFGKAALLAFLTYVIEREREVLGEFVVGDEEAKKAIGKEVKELKFGALSVKIGQANERSLKLFEGLGFSKIGDSPNYFGEWELRRKELDIESENLTVDGYREVAYKRIA

SEQ ID NO: 6077 - protein, 337 aa, Zymomonas mobilis
MKAAVITKDHTIEVKDTKLRPLKYGEALLEMEYCGVCHTDLHVKNGDFGDETGRITGHEGIGIVKQVGEGVTSLKVGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 6078 - protein, 312 aa, Magnaporthe grisea 70-15
MDTNMEDVGRVPSELAPQPSSEPTTIPTLDGWIESLMACKQLVEADVQRLCEKAREVLQDESNVQPVKCPVTVCGDIHGQFHDLMELFKIGGPNPDTNYLFMGDYVDRGYYSVETVTLLVALKIRYPQRITILRGNHESRQITQVYGFYDECLRKYGNANVWKYFTDLFDYLPLTALIDNQIFCLHGGLSPSIDTLDNIRALDRIQEVPHEGPMCDLLWSDPDDRCGWGISPRGAGYTFGQDISEAFNHNNGLTLIARAHQLVMEGYNWSQDRNVVTIFSAPNYCYRCGNQAAIMEIDEHLKYTFLYQRYPL

SEQ ID NO: 6079 - protein, 821 aa, Haemophilus influenzae 86-028NP
MIMDNFDSPFQYNRPEMTVEAIKKSIVYKLIFLIGRSPREASQRDWLNATLHAVRDLVTEGWITTARQTRAEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHDSLENLADKVAIHLNDTHPALAIPELMRILVDDEGFEWKKAWEMTRNIFSYTCHTLMSEALETWPVEMMAKILPRHLQMIFEINDHFLEYVRTYVTTDNDFIRRVSLIEEGYQRKVRMGWLSVVGSHKINGVAEIHSDLMVTSTFADFARIFPERFTNVTNGITPRRWLAVANPQLAALFDKYIGSEWRCDLSQIEKLKPFTQEKAFKEAVADIKFANKVKLAEYVKRELGVELDPHALFDVQVKRIHEYKRQMLNVLHIIARYNEMLANPEKDWQPRVFILAGKAASAYYAAKQTIHLINDVANVINNDERLKGRLKVVFIPNYSVSLAQLIIPAADISEQISLAGTEASGTSNMKFALNGALTLGTLDGANVEILENVGENHIFIFGNTVEQVEQLRRDGYRSFEYYQNDAQLRTVVDQIIEGKFSPEEPQRYHQLLQGLQYHDYYQAFADFRSYVEIQKAVDEKYKQRDQWIESTIQNIVNMGFFSSDRTIKEYAERIWKVEPVQLGD

SEQ ID NO: 6080 - protein, 415 aa, Glycine max
TSATTMVAMAAATASSQLIFSKPRSPSRLCPFQLCVFDTKQVLSSSSGRRRHVGGSGVRCMAVGEAATTETKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 6081 - protein, 276 aa, Candida glabrata
VCFSPDGKFLATGAEDKLIRIWDIEQKKIVMVLKGHEQDIYSLDYFPSGDKLVSGSGDRTVRIWDLKTGQCTLTLSIEDGVTTVAVSPGDGKFIAAGSLDRAVRVWDSDTGFLVERLDSENELGTGHKDSVYSVVFTRDGNGVVSGSLDRSVKLWNLRNVNHNNADGKPTSGTCEVTYTGHKDFVLSVATTEDDEYILSGSKDRGVLFWDKVSGNPLLMLQGHRNSVISVAVNHGHPLGPNYHIFATGSGDCKARIWKYIKTTTEVNSNGKIQPIS

SEQ ID NO: 6082 - protein, 270 aa, Helicobacter pylori 26695
MSMQTAPIKKITLNHLQAKKNQEKIIAITAYDALFAQIFDPLVDVILVGDSLNMSFFNQNDTLSASVEMMLYHTKAVCAGAKTPFIITDMPFGSYKDEKTALKNAIRVYKETQASAIKLEGGKEKAKLVKTLTNEGVIVVGHIGLMPQFVRLDGGYKIKGKNEEQQKKLLEDALSLEEAGVGLLVLEGITTPIAQKITQKIKIPTIGIGSGKDCDGQILVWSDMLGFFDSFKPKFVREYLKGKELIQNAIKQYADDVKKGNFPNELESYH

SEQ ID NO: 6083 - protein, 539 aa, Triticum aestivum
MGKKKERSVNVSGKPRHSLDVNRPNDKKGAGGGSGAGGSRSAATVRRLKMYKLRPMRDRGGKIVKHDLQSKELPNTRIEPDRRWFGNTRVINQKELEYFRQELQARLTNNYSVLLKSKQLPLSLLQDHQKQARAHLLDTEPFEHAFGPKGKRKRPNLSSLDYESLIKKADDSQDAFEEKHASSKLPKDEEEDGLRDLVRHNMFEKGQSKRIWGELYKVLDSSDVVVQVLDARDPMGTRCYHLEKHLKENAKHKHLVFLLNKCDLIPAWATKGWLRTLSRDYPTLAFHASINKSFGKGSLLSVLRQFARLRSDKQAISVGFVGYPNVGKSSVINTLRSKTVCKVAPIPGETKVWQYITMTKRIFLIDCPGVVYQNNDTETDVVLKGVVRVTNLDDASEHIGEVLRRVKKEHLQRAYKIQDWADDNDFLVQLSKMSGKLLKGGEPDLTTAAKMVLHDWQRGKIPFFVPPPQQNEDGPCKITEPVEGSGEEVVSSDRAAAAMKAIAGIISSQQTMNVPCQKELGRNGEDSELPEQSDLLVKD

SEQ ID NO: 6084 - protein, 271 aa, Zea mays
  misc_feature (32)..(32): Xaa can be any naturally occurring amino acid
  misc_feature (174)..(174): Xaa can be any naturally occurring amino acid
  misc_feature (185)..(185): Xaa can be any naturally occurring amino acid
  misc_feature (198)..(198): Xaa can be any naturally occurring amino acid
  misc_feature (213)..(213): Xaa can be any naturally occurring amino acid
  unsure (1)..(271): unsure at all Xaa locations
SGARSTDVVVDMIHLEEATLHLIFGWNDMANXIYGLCENDHIASLFASRNLWALPYLREHFTAGLIASPSVPKSTNAFIQRFLSAQTHLATFIEQVSFITTYKDQSGEQEMMQQNLQSISLKTASPIEGHDVAVLTPHAFFKLHMQSLHLEGSIFLVRQHTKEADGCSITWKYXNQREELISCCXMFESYGILCRHAXAIRRVLTALNYFQTXYLPVRRHRTQPLPSNSLRGLQSMVSALVSEATKSHERVDLATQEVYGLLTRIKQQQSC

SEQ ID NO: 6085 - protein, 403 aa, Magnaporthe grisea 70-15
MLENLCTLPLSADLFAQALHPEKPLLTVGLSSGHVHTFSLPPAKKDGKGLIKEIWSTRRHKGSCRCLVYGHDGKALYSAGTDCIVKHFDPETGKVKSKINIPKRGNHDDPPAIMHALTPKTLLLGTDSGALYILDLLKDGSLSPEPVRKHMPHDDYVTSITPLPPSAESTSGFSKQWVSTGGSTLAVTDVRSGIMARSEDQEDELLCSAIIPSGLGPKKMRGNAVVAVGTGSGVLTMWDRGSWDDQQERIYVAGGRGKKEPESLDCIVRVPASHGSGTKVAVGVGDGSVCIVDLRRREVELTLRHDEVEGVTAIGFDCYDRMISGGGKVVKVWAEADSPEEAESEDDDEDGSSKKRQRDDDDDSDDSDSDDDSSEDEKPAKSNSKRRKGKGPLPGTIAFPGLD

SEQ ID NO: 6086 - protein, 488 aa, Synechococcus sp. WH 7805
MSTPLIPVILCGGTGTRLWPLSRASYPKQYWPLGGSGDETLLQQTQQRLKGLDNLAPPLLICNDDHRFIVAEQMRQTGVEPGAILLEPMGRNTAPAVAVAALQATARGEDPLLLVLAADHVIRDAAHFRTAIDAGRTEAEAGRLVTFGIVPTTPETGYGYIEAAEPLQPGALTPVPIARFVEKPDRATAEQFLASGRFTWNSGMFLFKASAMLAELERLAPEVVSCCRAALEQDVADLDFLRLEREAFAKCPNVAIDVAVMEKTELGTVLPLAAGWSDVGSWSALWETADRDDDGNVLRGRVISEGSRNCYLRSEHRLVVGLGVENLVVVETDDAVLIADRSQAQNVKTIVKQLEADGSSEGKAHRKIYRPWGHYTGVVEDSRWQVKRISVKPGASLSLQMHHHRAEHWIVVKGTALVERDGDQQLIGENQSTYIPLGCRHRLTNPGRIPVELIEVQSGAYLGEDDIVRFDDVYGRSNAAARGALTPQ

SEQ ID NO: 6087 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAAKVMNLHGFVAPSDYEPTLIEVVE

SEQ ID NO: 6088 - protein, 170 aa, Oryza sativa
  misc_feature (53)..(53): Xaa can be any naturally occurring amino acid
  misc_feature (90)..(90): Xaa can be any naturally occurring amino acid
  misc_feature (134)..(134): Xaa can be any naturally occurring amino acid
  unsure (1)..(170): unsure at all Xaa locations
MRTPGKGFLAADESTGTIGKRLASIGVENVEENRRALRELLFTVPGALDCLSXGVILFEETLYLSTRDGTPVVYVLAAAGASGRGSRATXGTVELAGSVRETTTQGHDGLRERCTRYYAYGARFAKGSAVLRIXGSASSTPWQLAVDGHAHGLARYAFICLENWLVPIVK

SEQ ID NO: 6089 - protein, 274 aa, Synechocystis sp. PCC 6803
MAEISDPGNGDWLDQAWQEDHGQPISLARPDILSGLKVIAPACTDSTNQILWDLRHQGYHPPLVAIAREQTAGRGQWGRTWQSPPGGLYLSLWLATDLPISYGPHLVLWSAWGIAHALIQHGIPVQVKWPNDLLLKGKKLAGIKTESKINGNRITAAIIGVGINWTNPVPATGIALGPFCEAESIQSINSLTDLAEITLAGLTLGWHRYQREGIAGILVDYLQLFAHRGREISLTQGVGIIESVTAQGELVVLIGQRREIILPGTVSLDYDHAG

SEQ ID NO: 6090 - protein, 339 aa, Brassica napus
MDHEADAFRDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 6091 - protein, 497 aa, Magnaporthe grisea 70-15
MVKLEDVSSSLLQKPSNSNDSEIPLERRQSSYKSLKTFALDKEKQYQQQYGDMYFLRLTKIKPAVEEIASTAFGDLVIGGEPARQVPRVLDVRQGELCWVAGTVYMDMPLKPSILEDVAKDRWISAPTSVQKYFSKDGRDSILLEDDSGRVRLVGDILKSVVLVTGCIIAVMGTENASGEFEVIDLKFPDLAPQPERWSLSKPADDDVEMGNGGYSSNRGKTAILSGLNFSSTDTSYAMELNLLLEYLLGDALDPIAQKDISQISRLIVAGDSISPDTGKPAAEEEVAGKKVHKKYGYDASSYNPIPSQLLDEFLSELLPTIPVTFLPGAHDPANASYPQQPIHPAMFTKSRTYSALPGPTAEPGWFDTVTNPWEGEVEGWRVLGTSGQNVDDVFKYVDSDDRLGMMEAMCRWRCSAPTAPDTLWSYPFQDDDPFVMNQCPHLYFVGNQPEFGTKTITGTEGQEVRLITVPTFSASRELVLVDNETLEVTRVKISAT

SEQ ID NO: 6092 - protein, 251 aa, Magnetospirillum magnetotacticum MS-1
MTNRRKLIAGNWKMNGLKADGLALAKGLADKLASASPNCDMLVCPPFTLIAPVADALAGSKLAVGGQDCHAKTSGAHTGDTSPAMLADLGCKYAIVGHSERRTDHAETDNVVKAKAAAALSAGLVAIVCIGETLAQRDAGQTIEVNRSQLNGSLPEGANAANTVIAYEPVWAIGTGRVATPAQAQEVHAAIRAELVKLVGAAEAGKMRILYGGSMKPDNAKELLALPDVDGGLIGGAALKVADFWAIAESC

SEQ ID NO: 6093 - protein, 142 aa, Coffea canephora
RRHNSATPEEQIKMVENCGFPSLDSLIDATVPKSIRLDGMTFSKFDEGLTEAQMIDHMEKLASKNKVFKSYIGMGYYNTFVPPVILRNLLENPAWYTQYTPYQAEISQGRLESLLNYQTMIADLTGLPMSNASLLDEGTAAA

SEQ ID NO: 6094 - protein, 396 aa, Brucella melitensis 16M
MAETQVRNFNINFGPQHPAAHGVLRLVLELDGEVVERVDPHIGLLHRGTEKLMEAKTYLQAVPYLDRLDYVAPMNQEHAYALAVERLLDIEVPKRGQLIRVLYSEIGRILNHLLNVTTQAMDVGALTPPLWGFEEREKLMVFYERACGARMHAAYFRPGGVHQDLPDQLIEDIGKWIDPFFTTLKNLDDLITPNRIFKQRNVDIGVVKLEDAWAWGFSGVMVRGSGAAWDLRKSQPYECYSEMEFDIPVGKNGDCYDRYLIRMEEMRQSVRIMRQCVDLLLGKERVGPVSNTDHKIVPPKRGEMKRSMEALIHHFKLYTEGYHVPAGEVYAAVEAPKGEFGVYLVSDGSNKPYRCKLRAPGFAHLQAMDFLCRGHMLADVSAILGSLDIVFGEVDR

SEQ ID NO: 6095 - protein, 468 aa, Burkholderia mallei ATCC 23344
MQKGHSETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIAFGIGNHGVPMGISNLWAHGGFFPNGAQGVLMSMQMVMFAYLGVEMIGLTAGEAANPQKTIPGTINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVTQMKFRASLAPAEERALRFRMPFWPYASWVALAFLVLVIGLMAYFPDTRIALYVGPAWLVLLVVLYFVLKLEPEGGKATGLERRYGRG

SEQ ID NO: 6096 - protein, 895 aa, Bradyrhizobium sp. BTAi1
MRLSAQRTCSISNHVHCGNPAQTLHHFPSPCCADQPFPGFRSARNHRMLLPVPRSITGFKVTDQPSQRSFVSTGQPVDELAVAEIKSDILAKLRLAIGKEASQATPQDWYHAAALTLRDRIVHRWLTADKESYDAGRKRVYYLSLEFLIGRLFTDALNNMGLMKVFETALGDLGVGLMDLRKCEPDAALGNGGLGRLAACFMESMATVQIPAIGYGIRYDFGLFRQVIIDGWQHEFPDVWLSFGNPWEFQRPEVVYHVHFGGGVEHVDDKGRDRAIWHPGETVQAVAYDTPIVGWRGQHVNALRLWSARSPDPLKLDVFNSGDYLGASAEEARAEAICKFLYPNDESPAGRELRLRQEYFFVSASLQDLVKRHLGSDGQLRSLAQKAAVQLNDTHPSLAVAELMRILVDLHNFRWDEAWKITVATLSYTNHTLLPEALETWPVELFERLLPRHLEIIYRINAQHLALAEQRAPGDIEYRASVSLIDEKSGRRVRMGQLAFVGSHRINGVSAMHSDLMKETVFHDLNHLYPGRITNKTNGITFRRWLTLANPKLTSLLCEACGDAIVDDPTLLSSLESYVADSGFQQKFRAVKRHNKLQLARLIGERMNVRIDPGALFDVQIKRIHEYKRQLLNILEAIALYQDIKDNPQADWVPRVKIFAGKAAASYRYAKLIIKLINDVAELVNNDPAIDGRLKVVFLADYNVSLAEAIIPAADLSEQISTAGMEASGTGNMKLALNGAITIGTLDGANIEIRDNVGADNIAIFGMEADDVMLRRKQGLDATDVIRRSPRLARAIDAIASGLFSPGEPGRFEPIAHALRHLDHYMVSADFDSYYEAQRGVDARWRTAPAWTRASILNVARMAWFSSDRTIREYADDIWNVPVGPIQAPAHARRA

SEQ ID NO: 6097 - protein, 256 aa, Moritella marina
MRHPVVMGNWKLNGSKEMVVDLLNGLNAELEGVTGVDVAVAPPALFVDLAERTLTEAGSAIILGAQNTDLNNSGAFTGDMSPAMLKEFGATHIIIGHSERREYHAESDEFVAKKFAFLKENGLTPVLCIGESDAQNEAGETMAVCARQLDAVINTQGVEALEGAIIAYEPIWAIGTGKAATAEDAQRIHAQIRAHIAEKSEAVAKNVVIQYGGSVKPENAAAYFAQPDIDGALVGGAALDAKSFAAIAKAAAEAKA

SEQ ID NO: 6098 - protein, 484 aa, Oceanobacillus iheyensis HTE831
MAELKAITTYQMYINGEFVNASNNETLEVTNPATEEIVSTVPKASLEDTRRAIDGSAKAQKDWANLPSSKRASYLFAISKEIRSNIDEYAKIISEEMGKPLDQAVVEVSVTADYFEYIAGWARKYEGEIVPSDREKENILVFKQPIGVVAGILPWNFPFFLIARKAAPAILTGNTIVLKPSSVSPNNALAFAKILDKVGLPKGVINIVTGAGSIVGEELSKNEKIGMISLTGSTEAGSRVMEKASKNITKVSLELGGKAPSIVMEDADIDLAVKSVLDSRIINTGQVCNCTERVYVHEDVADEFIEKITKAMSNVSYGNPLGNEQIDMGPLSNEAGLKNVEDMVKRAVENGATVLTGGNRVNTEAGYYYEPTVLSNVDNSFEIMKEEVFGPVLPIATFTSLDEAIELANDCQYGLTSAIFTNNVNYMMRASNELEFGETYVNRESFEAIQGFHAGWKKSGIGGADGKHGLGEFLQTHVVYIQYK

SEQ ID NO: 6099 - protein, 252 aa, Oryza sativa
MAEHKAAKSKSKSKSGGHGHDAAAASKKSKSGKAKANNAAAAAPATSLDALFRPCGDVKGLRFGAQLVTRALTVRRAAPLELPHLLRVADERQREAPLAFAPTTTAYIPTNFAILAHHAWHTLTLGLGTRNSKAAVFVFESAAMKAAADAAWPQVVPLGDAGRRLIRAAPGAPEMARFKFRKGCVTFYVYAARTAGARGFARADELRAVVEAVAKLKDFLDHTAMLALPGQRSIDVAAAADAAAAAPVGVVH

SEQ ID NO: 6100 - protein, 272 aa, Triticum aestivum
  misc_feature (145)..(145): Xaa can be any naturally occurring amino acid
  misc_feature (197)..(197): Xaa can be any naturally occurring amino acid
  misc_feature (202)..(202): Xaa can be any naturally occurring amino acid
  misc_feature (253)..(253): Xaa can be any naturally occurring amino acid
  unsure (1)..(272): unsure at all Xaa locations
MDHAPRHGVPPSSSSSAAAPATSPEFSLPPSRLPLEDILFCVDVDAEARSEMKVAAASASASPASSGSTGSPGPGALMDPAAPPRSARPAVRRMDAVKQALMLFLHSKLTMCPDHRFAFASLRDTVSLISKEFTSDAASSIETIXSLAATDTRYAGADLTHLFKIAYEEGKRAETPGRLLRVVLIYCRSSTKPHHQXWPVKXKNFTMGIVYLHDKPTADNCPQNVYDSLVDALEHVSQYEGYILESGKGLPGXLFRQICIILSHPCTCIRMT

SEQ ID NO: 6101 - protein, 1070 aa, Arabidopsis thaliana
MDLEEQERDILIQTDDDDCHVDVSYVNDDDDSNASFSLSQNDSAFWPQSYRHSVDLLTGVTPPMVSFIQGRSTETSFSSSIASLYKRRPTSIANSFVSSTSKQPLLSEKDDVSFLSSQVGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKALDLANLPVAIGIFGFGFSGHAVLPSIYSSMKEPSKFPLVLLISFGFCVFFYIAVAICGYSMFGEAIQSQFTLNMPQQYTASKIAVWTAVVVPMTKYALALTPIVLGLEELMPPSEKMRSYGVSIFIKTILVLSTLVVALTFPFFAIMGALMGSFLATLVDFIFPCLCYLSILKGRLSKTQIGICVFIIISGIVSGCCGTYSAIGRLVGELNWMYSFRSFVALIRLCFETETTTMELEEQERDILFPTDDEECQVDVSCDDEDDDSSSYSSLSQNDSAPWPRSYRQSVDILTGVTPPTISFIHRRSSQTSFTSSVASLYKRRPTSIANSFASSTSKQPLLSEKDDVLFLSSQIGLSNTDLSYGEPNFCSFPQSVLNGINVLCGISLLTMPYAVKEGGWLGLCILLSFAIITCYTGILLKRCLESSSDLRTYPDIGQAAFGFTGRLIISILLYMELYVCCVEYIIMMSDNLSRVFPNITLNIVGVSLDSPQIFAISATLIVLPTVWLKDLSLLSYLSAGGVFVSILLALCLFWVGSVDGVGFHTGGKSLDLANLPVAIGIFGFGFSGHAVLPSIYSSMKEPSKFPLVLLISFGFCVFFYIVVAICGYSMFGEAIQSQFTLNMPQQYTASKIAVWTAVVVPMTKYALALTPIVLGLEELMLPSEKMRSYGVSIFIKTILVLSTLVVALTFPFFAIMGALMGSFLAMLVDFIFPCLCYLSILKGRLSKTQIGICVFIIISGIVSGCCGTYSAIGRLVGKLD

SEQ ID NO: 6102 - protein, 227 aa, Glycine max
MEFKGSVFIKLLLLLHFFSVLCASQDFDFFYFVQQWPGSYCDTQKSCCYPTKGKPAADFGIHGLWPNYNDGKYPSYCDPNNPFDPSGISDLTSSLESNWPTLACPSGDGIEFWTHEWDIHGTCSESVLKQHDYFEAALNLKQKANLLQALTSAGIQADGQSYSLSEIKGAIEGAIGFTPFIECNVDSSGNSQLYQVYLCVNTSGSDFIECPVFPRGKCGSDIEFPSF

SEQ ID NO: 6103 - protein, 409 aa, Vibrio vulnificus CMCP6
MAKVSLEKEKIKILLLEGLHPSSVEVLQAAGYTNIEYHKGSLSDDALLEAVKDAHFIGIRSRTNLTEEVINAAQKLVAIGCFCIGTNQVDLNAASKRGIPVFNAPFSNTRSVAELVLGQILLLLRGIPEKNALAHRGIWKKSADNSYEARGKRLGIIGYGHIGTQLGIIAENLGMRVYFYDIENKLSLGNATQIPTMSELLNKCDVISLHVPETPETKNMMGAEEFARMKPGSIFINAARGTVVDIEALCHSLESGHIAGAAIDVFPVEPATNAEPFESPLQKFDNVILTPHVGGSTQEAQENIGVEVAGKLAKYSDNGSTLSSVNFPEVSLPEHRSCSRLLHIHQNRPGILTQINTIFAEEGINIAGQYLQTSADIGYVVIDVETERSEEALVKLKEIEGTIRARILH

SEQ ID NO: 6104 - protein, 498 aa, Geobacillus kaustophilus HTA426
MSMNWGMAMHNDQPLIFERSKPGRIAYSLPALDVPAVDVSELVPADYLRTEEPELPEVSELDLMRHYTALSKRNHGVDSGFYPLGSCTMKYNPKINENVARLAGFAHIHPLQPEKTVQGALELMYDLQEHLKEITGMDAVTLQPAAGAHGEWTGLMMIRAYHEANGDFNRTKVIVPDSAHGTNPASATVAGFETVTVKSTADGLVDLEDLKRVVGPDTAALMLTNPNTLGLFEEQIVEVAEIVHAAGGKLYYDGANLNAILGKARPGDMGFDVVHLNLHKTFTGPHGGGGPGSGPVGVKADLVPFLPKPVIEKGENGYYLDDDRPQSIGRVKPFYGNFGINVRAYTYIRSMGPDGLKAVSEYAVLNANYMMRRLADYYDLPYDRHCKHEFVLSGRRQKKLGVRTLDIAKRLLDFGFHPPTIYFPLIVEECMMIEPTETESKETLDAFIDAMIQIAKEAEENPEIVQEAPHTTVVKRLDETTAARKPILRYQKPKHSDN

SEQ ID NO: 6105 - protein, 220 aa, Vibrio vulnificus CMCP6
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 6106 - protein, 448 aa, Geobacillus kaustophilus HTA426
MLHRYLPMTEEDKQEMLKTIGVASIDDLFADIPEQVRFRGELKVKPAKSEPELWKELAALAEKNASVKQYVSFLGAGVYDHYIPAVVDHVLSRSEFYTAYTPYQPEISQGELQAIFEFQTMVCELTGMDVANSSMYDGGTALAEAVLLSAAHTKRKKVLISTAVHPQYREVVRTYAKGQKLEVKEIPYDGGITDLKALEAEMGDDVACVVVQYPNFFGQIEPLKAIAPLAHEKKSLFVVASNPLALGVLTPPGAFGADIVVGDMQPFGIPTQFGGPHCGYFAVKAPLMRKIPGRLVGQTTDEDGRRGFVLTLQAREQHIRRDKATSNICSNQALNALAASVALSALGKRGVKEMAAMNIQKAHYAKVELEKRGLSSPFAGPFFNEFVIRLGRPVSDVNDRLLEKGIIGGYDLGADYPELAGHMLVAVTELRTKEEIDRFVNELGDGHA

SEQ ID NO: 6107 - protein, 246 aa, Methanosarcina barkeri str. fusaro
MSGSTVYECLTYRNENINQALEALRAGKMIQIYDSDTREGETDLVIPAKAVTFKDVKWMRKDAGGLICVAVDPVASKQLRLPFMAELVREASKTSDVLGEIAEKEGDLKYDAHSSFSLWVNHRETRTGIPDNERALTIRKIGEITEKKLSGDVIHFGEEFRTPGHVALLRAAEGLLDERKGQTELSVALARMAGITPAMVVCEMLDDNNGKALSKEDSKEYGKEHELVFLEGQEIVEAYMMWAGSE

SEQ ID NO: 6108 - protein, 125 aa, Zea mays
  misc_feature (53)..(53): Xaa can be any naturally occurring amino acid
  misc_feature (108)..(108): Xaa can be any naturally occurring amino acid
  unsure (1)..(125): unsure at all Xaa locations
KEQNLPNNKKSFNLLLSVPSLSLSHISINMARSLSSVKFVSAFVSQEVSNAIXFRRGFAATTAQPSGGKGGAVVSAVMKKGMEESNQKLSAWIPDPKTGYYRPGNGSXNRFDPAELRAALLNKKQ

SEQ ID NO: 6109 - protein, 449 aa, Pseudomonas aeruginosa UCBPP-PA14
MALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLDGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIAVLVIAYRRWVRPKGDAAHGVLQAQGGL

SEQ ID NO: 6110 - protein, 142 aa, Coffea congensis
RRDNSATPEEQIKMVENCGFPSLDSLIDATVPKSIRLDGMTFSKFDEGLTEAQMIDHMEKLASKNKVFKSYIGMGYYNTFVPPVILRNLLENPAWYTQYTPYQAEISQGRLESLLNYQTMIADLTGLPMSNASLLDEGTAAA

SEQ ID NO: 6111 - protein, 365 aa, Zea mays
  misc_feature (63)..(63): Xaa can be any naturally occurring amino acid
  unsure (1)..(365): unsure at all Xaa locations
MPPKKAAPSKAELAKKQKVVEDKTFGLKNKNKSKNVQKYVQSLHQAVQPKPDSTKTAAKKKKXEEKAREKELNDLFKVAVSQPKVPVGVDPKSILCEFFKAGQCQKGFKCKFSHDLNVQRKGEKIDIYTDKRDAETMEDWDQETLEKVVESKKMEYQQNKPTDIVCKYFLDAVEKKQYGWFWVCPNGGKECHYRHALPPGYVLKSQMKALLEEESEKIAIEDEIEDQRKKTKTTTPMTTELFMEWKRRKAEEREAGQAALKAERAKNDRMSGRELFMADASVFVDDAEAYEVYEREESEANEESTNKSQNPGPSSSTSNGKEVEEPDDDDIDVDDDLDIDELNELEASLSRTSIQIREPGEGTSS

SEQ ID NO: 6112 - protein, 142 aa, Coffea eugenioides
RRHNSATPEEQIKMVENCGFPSLDSLIDATVPKSIRLDGMTFSKFDEGLTEAQMIDHMQKLASKNKVFKSYIGMGYYNTFVPPVILRNLLENPAWYTQYTPYQAEISQGRLESLLNYQTMIADLTGLPMSNASLLDEGTAAA

SEQ ID NO: 6113 - protein, 321 aa, Oryza sativa (japonica cultivar-group)
MSTSRDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 6114 - protein, 514 aa, Escherichia coli K12
MLVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 6115 - protein, 540 aa, Campylobacter coli RM2228
MDNFLEIFLITAALAIVLNVIFKKFEIPTIIGYIAAGEIISKIYHLSGKGEITHIAEFGIVFLMFTIGLEFSFKHLIAMKQEVFLNGSLQMLTCGFVFMLLAIEILGLGDKSATIVGFALALSSTAVVLKILNDNGDINEQYGRKALGILLFQDIAVIPLLLLVDIFSSNNQNIGQLLLTTLLSAVILIALLFFIGKYLVDRIFRLIIRASSQEIFISTILFMVIGASFLANYFGFSYSLGAFIAGALIAETKYKHKIEADLIPFRDLLLGLFFITVGMQIQLHIVAQNWFIICVLTLLIMGLKFGIVCGFLFLYTKKRVALKTAFSIAQVGEFALAIFSLLQAKSMLDVETAQILIVVSIVTMIITPFVLNNIRKIANVVEDMTLNTNVVQQSTHSTLKNHLVIFGYGRLGQEIVQKIKNTGVPYLVLESDLNLVELGISRGENVVFANAAQEETLKIANITECAVAIVTITNEAKLEMICQVLASYPKPIDTIIHVNGSLEKMLFSSIDENIRIVRSEKVIARNLVQEALECRIHKNT

SEQ ID NO: 6116 - protein, 281 aa, Arabidopsis thaliana
MTTFNYYLAEHPTIVNFRWSPTQSYASTWSFLFTAVSSYIIAAVTLHLLLLITLSLSNRRRGFSLGPIPALHSLTISIISAVIFVGILLSAAAEIRDTRWLWRRTRTTALQWFLCFPVGTRASGRVFFWSYAFYLSRFLHLFRTFFSVIRRRKLSFFQLINQSSLLCISFLWLEYSQSFQVVAILLTTVSYAVVYGYRFWTEIGLRGACFPFVGNCQAILLGCMTVCHVGVLCIHLVKRGGCNGIGAWLFNSVLNAVITLLYLKFYCKTRSMMTKANHNTT

SEQ ID NO: 6117 - protein, 138 aa, Brassica napus
  misc_feature (51)..(51): Xaa can be any naturally occurring amino acid
  misc_feature (119)..(119): Xaa can be any naturally occurring amino acid
  misc_feature (132)..(132): Xaa can be any naturally occurring amino acid
  unsure (1)..(138): unsure at all Xaa locations
MGDFNLALVIVAIVVCVIVFISSVYLLVNYQHPDDANQAYFPKFVVVFGLXIAMISILMLPADVANRHACRHAIYNGACNLTLPMKDLWLAVYIVDAILVFFVIPFAMFFYEGDQEKTXGKRIKSALLWVVXTAGVCA

SEQ ID NO: 6118 - protein, 312 aa, Saccharomyces cerevisiae
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYHECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCVEFDNAGAMMSVDESLLCSFQILKPAQKSLPRQAGGRKKK

SEQ ID NO: 6119 - protein, 830 aa, Rhodopirellula baltica SH 1
MSNTLSAPPNASPTDTSFPHLDLSSELARHLTITLGHDFTGDSTDKQNSEYLYQALAITVRDRLVPIWLETWKKTCLSEDRKVYYLSLEFLIGRSLTNAVENLDLDEDVRKALRAYSVGMEEVADKELDAGLGNGGLGRLAACFLDSCANLQLPVVGYGIRYEYGMFHQHIEDGRQVEDPDRWLRDGNPWEIKRPEDTRRVRFYGRTENYYDEHGTLRPRLVDSYDVLAVPFDMPVPGYRNDTVNTLRLWKASTTDVFNLSEFNAGSYPEAVAAKNDAEQISMVLYPNDASENGKELRLKQQYFLVSASLQDVIARWVEQHGEDFSDFGRKNCFQLNDTHPACAVPELMRLLMDEHGLEWDDAWDVVTRCMAYTNHTLLPEALERWSVGLFSRLLPRLLDIIYEINARFLKLVDQQWPGDVAMRREMSLIEEGDNPHIRMAYLAIVGSFSVNGVAGLHTQLLESGLFKHFNTLWPRKFNNKTNGVTQRRWLSHCNPGLRDLLNETIGEGWQKDLTKIKELTPYATDADFRKKWIDVKQENKARLSDLVVAETGVRFDTSFMFDVQVKRIHEYKRQLLNVLHIVHLYDRILRGETAGMVPRCVLIGGKAAPGYHVAKLIVKLINDVAKKVNNHPAANDLLKVVFFPNYRVSSMEVICPATELSEQISTAGKEASGTGNMKFMMNGALTIGTLDGANIEIRENAGAENFFLFGLDAAEVTELKKDYRPNEIIAADEDIVRIMNLLESGHFNPDNPGLFDLLTSGLRNPQDPWVTIADLRAYIDAQAEVGKAYQDVDHWNQMSILNTAGSGWFSSDRTIQQYADDIWDVRPLS

SEQ ID NO: 6120 - protein, 571 aa, Oryza sativa (japonica cultivar-group)
MRSHEMNNSSSRYASEEERGSNSFLIESEEEEEDEEAHPHSSILLKDADSDSDSDDSSCATPRPSSYATHQWPQSYRQSIDIYSSVQSPNLSFLGTPTLSRLSNSFLTNSFRGKTPEILSNLVKPLLRPSSSSDDQQQQQQHDDDTRKSSQYLLPSRKPSLQQIPEDQKPLVPAHEVPAYQQCSYTQAVMNGINVLCGVGILSTPYAIKQGGWLGLVILCLFAVLAWYTGVLLRRCLDSKEGLETYPDIGHAAFGTTGRIAISIILYIELYACCIEYLILESDNLSKLFPNAHLTIGSMTLNSHVFFAILTTLIVMPTTWLRDLSCLSYLSAGGVIASILVVVCLCWVGVVDHVGFENKGTALNLPGIPIAIGLYGYCYSGHGVFPNIYSSLKNRNQFPSILFTCIGLSSILFAGAAVMGYKMFGESTESQFTLNLPENLVVSKVAVWTTVANPITKYALTITPLAMSLEELLPPNQQKYANIIMLRSSLVVSTLLIALSVPFFGLVMALVGSLLTMLVTYILPCACFLAILKRKVTWHQIAACSFIIVVGVCCACVGTYSSLSKIIQNYT

SEQ ID NO: 6121 - protein, 377 aa, Vibrio sp. Ex25
MEEEGHKILKLNIGNPAPFGFDAPDEILVDVIRNLPTSQGYCDSKGIYSARKAVVQHYQRKGIRSLDVEDVYVGNGVSELIVMAMQALLNNGDEMLIPAPDYPLWTASVALSGGKPVHYLCDEGADWYPDLEDIKKKITPKTRGIVLINPNNPTGAVYSRDFLLEVIEIARQHKLIIFADEIYDKVLYDGATHTSVATLTEDVLVMTFNGLSKAYRVCGFRGGWMFLTGPKHLAQGYVNGLELLSSMRLCANVPMQHAIQTALGGYQSINELILPGGRLLEQRNRAYELINQIPGVSCVKPKGAMYLFPKIDTKMYNIKNDQQMVLDFLKQEKVLLVQGSGFNWPKPDHFRIVTLPHVEDLEIAIGRFERFLSTYSQ

SEQ ID NO: 6122 - protein, 174 aa, Arabidopsis thaliana
MLVGENCVHETYYEILSVKEDASYEEIRNSYRSAILHSHPDKLNNTSRSSSDDEKFLKIQKAWEVLSDAELRVVYDNDLRSSRHDGITADEISIEDMSVEITGDVIDLFYQCRCGDYFCVDSSELGTMGFALLRDGDFVYVKRLGAFVASVVLPCGSCSLKTRVWVDSDMKIPI

SEQ ID NO: 6123 - protein, 272 aa, Coccidioides immitis RS
MSVVSLLGVRVLNNPAAFTAPYEFEITFECLEQLQKDLEWKLTYVGSATSSEYDQELDSLLVGPIPVGVNKFIFEADPPDLKRIPTSEILGVTVILLTCSYDGREFVRVGYYVNNEYDSEELNKEPPTKPIIERVRRNVLAEKPRVTRFHIKWDTDSDPTEFPPVQPDADVLEDDGETYGAEELELEAALKRELEELDSQDADKMDVGEGRDDVDDNESDAGSEDLEGETSGSDDEEEEEGFEGEDEDVEMGDDSNPTPDQHQHPNPEVMVH

SEQ ID NO: 6124 - protein, 618 aa, Haemophilus influenzae R2866
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTESKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 6125 - protein, 308 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASDNNAGIMACPFMLSKDNIELQFATNHLGHFLLTKLLLDTMKSTSRESKREGRIVNLSSEAHRFSYPEGVRFDKINDKSSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 6126 - protein, 155 aa, Triticum aestivum
MAHMRVVHRDEEGHKVAEKLPVPETRRPDTARHVERKLEEQGLHRLERHPANAPRGVGIGAPPPKSGRGGKYTWEGPEGLVDSELDPAPAAIDRNDPNYDEEVRWRTRTHGRPRQRCAPRKKKHTLPPASARRGPAPLPGVRSTASLYIVLLSSS

SEQ ID NO: 6127 - protein, 355 aa, Prochlorococcus marinus subsp. marinus str. CCMP1375
MALSYYKEELKKTASSLATSGKGILAVDESTKTIGKRLASINVENTEENRKAYRGLLFTTEGLGEYISGAILFEETLFQAHPDGEPMVKKLEKLGVIPGIKVDKGLRPLAGGNDVETFCSGLDGLVERSSDYYAQGARFAKWRAVLQITNNGSPSKLSIKENAWGLARYARSVQESGLVPIIEPEILMDGSHSINKTAEVQEEVIKEVYMACQLNGVFLEGTLLKPSMTVQGADCKDKADPQKISELTIRTMERCVPASVPGIVFLSGGLSEEAASIYLNLMNKQPRKANWNVGFSYGRALQHSCLKEWGGKNLEAGQKALLARAQANSEASKGIYVAGSQPSSDEALFVAGYKY

SEQ ID NO: 6128 - protein, 269 aa, Vibrio parahaemolyticus RIMD 2210633
MRNDVHLGHKARKRFGQNFLNDPYIIDGIVSAINPKPGQNLVEIGPGLGAITEPVGREVDKFTVIELDRDLAERLRNHPDLADKLTIHEGDAMRFDFTQLVKPNNKLRIFGNLPYNISTPLMFHLFEFHKDIQDMHFMLQKEVVNRLAAGPGSKAYGRLTVMAQYYCKVVPVLEVPPTAFVPPPKVDSAVVRLVPYEELPCPAKDLRLLDRVCREGFNQRRKTVRNCYKSLLSAEVLEELGVNPSMRPENLTLQQFVAMANWLADNPQH

SEQ ID NO: 6129 - protein, 149 aa, Arabidopsis thaliana
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 6130 - protein, 236 aa, Zea mays
RLVGANLENSTPLGKAGTGLVVLSAALAEVIVALGGGLLVGANNLNGALVDLDAREDGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 6131 - protein, 528 aa, Magnaporthe grisea 70-15
MATALDHLYIGGRINWLAQLNTAAQPDKNYRRSSIICTIGPKTNSVEAMNDLRKAGMNVVRMNFSHGSYEYHQSVIDNAREAEKQMPGRQLAIALDTKGPEIRTGNTKNDEDLPISAGKELNFTTDEQYATSCDTDNVYVDYKNITKVIEKGRIIYVDDGVLAFEVLDVIDEKTVRVRARNNGFICSKKGVNLPNTDVDLPALSEKDKADLRFGVKNNVDMVFASFIRRGQDIKDIREVLGQDGAHIQIIAKIENRQGLNNFPEILKETDGVMVARGDLGIEIPAAEVFAAQKKMIALCNMAGKPVICATQMLESMIKNPRPTRAEISDVGNAVTDGSDCVMLSGETAKGSYPCEAVREMSDACLKAENTIPYVSHFEEMCGAVHRPVSIVESCAMAAVRASLDINAGGIIVLSTSGVSARLLSKYRPVCPIFMVTRNASASRYSHLYRGVYPFLFPEAKPDFSKVNWQEDVDRRIKWGVKHALDLGVLEKNDSIVVVQGWKGGMGNTNTIRVLKADTESLGIGQADI

SEQ ID NO: 6132 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 6133 - protein, 250 aa, Triticum aestivum
  misc_feature (94)..(94): Xaa can be any naturally occurring amino acid
  misc_feature (111)..(111): Xaa can be any naturally occurring amino acid
  unsure (1)..(250): unsure at all Xaa locations
LIGGGGRRSAGQPGETKDNRKEGPRRYAAWGQVQSGMVLGLGTGSTAAFAVAEIGALLASGKLSGIVGVPTSKRTFEQATSLGIPLSTLDDHPXVDLAIDGADEVDPDLNXLVKGRGGALLREKMVEAASGKFVVVVDETKLVTGLGGSGLAMPVEVVQFCWKHNQVRLQDLFNEEGCEAKLRLNEDGKPYVTDNSNYIVDLYFKTPIKDALGAGKEIAALEGVVEHGLFLNMATSVIIAGSDGVSVKTK

SEQ ID NO: 6134 - protein, 489 aa, Clostridium perfringens SM101
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGLFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 6135 - protein, 530 aa, Gibberella zeae PH-1
MRFLTGLLVLGMSLWTTQAYEIGLSNKEGYQEYCTGMYSKSSWGGPVDPFILVKFLNSSDSGVKDPTASLVIFEWKDRNLVGIPDPDVPGNRLGVCGDDFVKQGYCNKTDIGKFILNPDVDKKSSSVVLTKAVHLNTAAPINYAIKKTGYYCVLTDVVNTKKYDLVVEYRNAYGELEATQIPKLPFYGGMSILYALLAAYWGFLYYQHRHDISILIFLVVEMLITWGFYEYQNRHGSNIGSKVFLTIVGILNAGRNSFSFFLLLIVCMGYGVVKHTLGKSMIRVRWLAAAHFLFGLVYSLTFLSITPETAGPFVLLIVLPLAGTLTAFYVWTLNSLNWTLKDLRERKQHAKEAMYRKLWWAILISVMVIFGFFFFNSFTFASASDPDFVPFHWKTRWFILDGWLNVVYFADVAWIAYLWRPTSNNRRFAMSDEIAQDDDGNFDLGDIGVPGEDSDDEEAEVAKPQNNSQNANGLSFSSASRSAPQQPRNTRTGPRESLENETIFAVGEDGDKFSDDDDSDEEDAKLVKAK

SEQ ID NO: 6136 - protein, 460 aa, Pseudomonas putida KT2440
MTSVTPCASSSSEMNDFLQAHPDTQYVDLLISDMNGVVRGKRIERASLHKVYEKGINLPASLFALDINGSTVESTGLGLDIGDADRICFPIPGTLSDEPWQKRPTAQLLMTMHELDGQPFFADPREVLRQVVSKFDDLGLTICAAFELEFYLIDQDNLNGRPQPPRSPISGKRPQSTQVYLIDDLDEYADCLQDMLEAAKEQGLPADAIVKESAPAQFEVNLHHVADPLKACDYAILLKRLIKNVAYDHEMDTTFMAKPYPGQAGNGLHVHISLLDKKTGKNIFASDDPLQSDTLRHAIGGVLETMPASMAFLCPNINSYRRFGAQFYVPNAPSWGLDNRTVAVRVPTDSSENVRLEHRVAGADANPYLMLAAILAGVHHGLTNKVEPEAPIEGNSYEQLEQSLPNNLRDALRALDDSEVLNQYISPDYIDIFVACKESELAEFEVSISDLEYNWYLHTV

SEQ ID NO: 6137 - protein, 439 aa, Thermotoga maritima
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTGDNAQTVKLVIKTMAIFHGYHATFMPKPFYGVNGSGMHVHMSLFRGDKNAFYDPDDPLGLSKELRYFVGGILKHAKRLAAVTNPTINSYKRLVPGYEAPVYISWSVGNRSALIRIPKARGKATRLEYRSPDPTCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 6138 - protein, 609 aa, Mesorhizobium loti MAFF303099
MADPITHSVNLFSAFSAPAHVGAEIVAGLKATLGKPNSTLVGAAIGTGMAAQAASRGGADFLLALSAGRLRSMGAPSIFSLLALRNSNDFVLDFAQSEILPFAKVPVFFGACACDPRCSIEAELQTIADAGFGAIVNFPTCIFLDGRFRADIERAGLGFQRELEMLRAAQNKSMATLAYVRTVTEAQQAAEAGVDIINLNLGWNVGGTVGGRPGLSLTQAAEFAKIVFRQIRGISKDTLCVLEGGPIVSPDQMYEVSAASKADGYIGGSTIDRVPLEASIEQITSAFKSVGTLQKRIDELERQLEHVQREYWIVGRSPSIQQIKQRIKQLAASPLPVLITGEAGTGKRLLARGIHEAARRPASKLISASTPVPSGKSLFGSAPPEGGRKVLGLFQYHPRATLLIENFETLCLDAQERLVEVIETGVYRRLGDSDKGRFEGRLILTSTQPLSQLGASGVLIPSLESRLAPGHVFLPKLRDRLEDLPLLAEHFLQALRKDRRSRKLAVDHSAYRVLMTYGWPENIRELRSVLETAAIHCEGDWIKAEHLPPLSDPDAPKPKPADEREWILDALQRHRFRRGETARYLAISRKTLYNKMRAYGLTLQPRTNA

SEQ ID NO: 6139 - protein, 633 aa, Magnaporthe grisea 70-15
MSGTGSRQPLDASAGRDVVYCHACENEWFQDQNGLVCPQCHSEATEIVTPENDPRPVNTHDSRTEPQGHRDRYDDSDPEEEDIEEHSHRAPGGIYFTSRVFRMPVNHGAGTESPHVHPSDGNAVMERFYEMMNRDMGSSAAPGASNSDGTRSATGQGASENSGTRHYTTRTTMFPGGSTSFTITTAPLQRDGNNPPIGEFDAYADPHPRTRRRIVIVMLDSRGADSNASILSTIMGNITNPVGNTPHRGGETSSNDEASGLPPHGFPIAFQQLLGALMTGYGGTRNWGDVVTSQEEFDRIISQMMEANPMSNAAPPASEAAIEKLERKKLDEKMLGTDETVECTICMDDLSLGDEATVLPCKHFFHGECVTIWLKEHNTCPICRTPMEQRSSAERTQAPQNQSSSGPRAARPEPPRGIFPWAFQPSGSGTGSFVNSSSQRPSQSSQQSPIDIQQNDSGHTSHRRELLRSPSTNEERLRAIRDLANSDRHGGSDRPTTPPFAGRRRNSLSPPSPSMQAPWNLSYDPVHDFTSASRDRTRERDGDRSNSQSSSRFTSTNRDQEGHRDRERYRQQTYESSQPPSREQRDQERNDDNGSRRGDPNQTSSGSTFDPFSWIRDRLPGGGNSSGDSHRRG

SEQ ID NO: 6140 - protein, 285 aa, Mesorhizobium loti MAFF303099
MSTDTCIKRPTRSELVDRFQKKIRAGEPIIGGGAGTGLSAKSEEAGDIDLIVIYNSGRYRMAGRGSLAGLLAYGNANQIVVDMAREVLPVVRHTPVLAGVNGTDPFMVMSTFLRELKEIGFAGVQNFPTVGLIDGLFRQNLEETGMSYAQEVEMIAEAHKLDLLTTPYVFSPEDAVAMAKAGADILVCHMGLTTGGAIGARSGKSMDDCVSLINECIEAARTIRDDIIILSHGGPIANPEDARFILDSCQGCHGFYGASSMERLPAEEAIRSQTLAFKAIRRQPA

SEQ ID NO: 6141 - protein, 520 aa, Sinorhizobium meliloti 1021
MTAGNDFQHQAIAAHVAQRLAGPARAILGFQELLVEQARDLGLIHIKGDLDRIGAAARQLNGFIDRLLEGAACPLEEGEAEAEARLRHDLRTPLNAIIGYSEMILEEASDAPEHALKEDLHVILSAAAELLTQVDAIASLSRGETVEMLQPGERAEIDAAGLERLLFKAQEVACPEQGGRILVVDDVASNRDLLSRRLRREGHRVVTAESGLSALARLAEDEFDLILLDILMPDMNGIEMLSRLKSEERWQHVPVIMISGLSDVTAVARCIEAGADDYLTKPFNPILLRARINSTLEKKRWLDREHRYLQQIKTEKLRADSLIRAILPDQIVARLQDGEEIIADRFDEVSILFADIVGFSPIAASLTASDLVRRLDRMFRRFDLLTEQHRVEKIKTIGDAYMAACGIPEPAPDHADRIVALGKSMLRSLQDMEAGPDRFRVRIGIHTGPVVAGLIGRLRFVYDVWGETVNIASRLESQGVADVIQISEATRRALRGPWTLERRCALELRGIGAVETYLVR

SEQ ID NO: 6142 - protein, 408 aa, Mesorhizobium loti MAFF303099
MAGRTTMKIVYVVGTCDTKGSELRYLRDLIRDAGCDVVLVDVSVSEFHSEASDVDVQPAEVARCHPNPLKAEELKDRGKAVAAMSQALVEYIRSRPDVDGIIGAGGSGGTALIAPAMRALPIGVPKVLVSTVASGNVAPYVGPTDISMMYSVTDVSGLNRISRVVLANAAHSIAGMVLKQVGAAADERPAIGLTMFGVTTPCVQAVTRALEANFDCLVFHATGTGGQSFEKLADSGLLVGGIDVSTTEVCDYLVGGVFPCTPDRFGAFARTKLPYVGSCGALDMVNFGAMETVPSQFRSRRLHVHNPQVTLMRTNPEECSRIGEWIGERLNLCEGPVRFLIPELGVSAIDAPGQPFHDPEADAVLFAALERTLRCTDKRQLARVPLHINDPQFADLLVTNLKEAFREH

SEQ ID NO: 6143 - protein, 208 aa, Cryptococcus neoformans var. neoformans B-3501A
MSIVNIRNIELLNNPAKFDDPYNFRIKFEAIAPLVEDLDWRLIYVGSASSEEFDQELDNCSVGPIPAGINAFDFSAPAPAHHLLPSVEPDEILGVTVIIITASYREKEFVRVGYYVNTYYEDEELKENPPSVVQWDKLHRNVLIEKPKVTRFQNNWDSAPQLNTFDGQQPAAELPPSGGNPELFNAPLPPPVQRATAAGGMDVDQPMA

SEQ ID NO: 6144 - protein, 552 aa, Uromyces viciae-fabae
MSSDDVKALGGDLEKAHSIMDQEFVTEKGNGTITEDKQDGQMQRHLKPRHMSMIAIGGTIGTGLFIGSGQGLNQGGPVGLLLGYSTMGIVVYSVMVSLGEMVTMFPITGSFVHYASRFVDPALGFALGWNYWYCYAITLPTEITAAGIVIQYWTKSVNVAVWITIFLVASCGVNLFGVRWYGEAEFWCSAVKVIAIVCLIILGIIIDLGGGPNHDRIGFRYWISPGPFNQLNGIPGSTGRFLAFWSVFIQASFSYQGTEIVALAAGEALNPRKTIPKAINRVFYRILLFYVGGVTVIGLLVPYNSPDLLGGTGDATSSPFVIAIKSAGISVLPDVLNAVILAVVFSAANSDLYAASRMTFGLATDGMAPAIFSRCTSNGLPIAGLILTIGFGLLAYMNVNSSTGTVFQWLANFSSVTGLLTWWSISLAYIRFYHGLIHHKIDRNTFAYKAPYQPWLSYFSITMSTLIIFFNGFEVFMSGSWSTSKFVSAYLSIPMFIVFFITWKIYHKTAFVKIDQMDFVTGKREFDSMEQIESEKEVEPVGKFAQFLEWLM

SEQ ID NO: 6145 - protein, 398 aa, Nephroselmis olivacea
MAIEHASSIKKVKNFTLNFGPQHPAAHGVLRLVLELNGEVVARADPHIGLLHRGTEKLIEYKTYTQALPYFDRLDYVSMMCQEHAYSLAVEKLLHCEVPERAQYIRVLFSEITRILNHLLALTTHAMDVGALTPFLWAFEEREKLIEFYERVSGSRMHAAYIRPGGVACDLPANLCEDIYLFCQQFASRIDEMEEMLTNNRIWKQRLVDIGIVTAENAFAWGFSGVLLRGSGVAWDLRKTQPYDVYNRMIFDVPVGTQGDCYDRYLCRVEEMRQSIHIIMQCLNQLPKGMIKADDKKITPPSRSQMKQSMESLIHHFKLFTEGYTVPNSETYTSVEAPKGEFGVYLVSNGTNRPYRCKIRAPGFLHLQGLDMMSKNHMLADVVTIIGTQDIVFGEVDR

SEQ ID NO: 6146 - protein, 385 aa, Desulfovibrio desulfuricans G20
MKETGRTAGIKPFYAMDVLERAQELERQGADVIHLALGEPDFDVPEPVRQALVQAVEGGHTHYTGSMGMLELRQAIAKDYRRRYGVDVSPERIAVTSGTSPAMFMLFGALLQQGDEVIISDPHYACYPSFISFAGGVPVKVRVYEEDGFQYRLDAIKAKLTGRTRAIFINSPSNPTGNQLPADRMRRIASLGIPVISDEIYHGLEYGEKEHTILEFTDNAFVFNGFSKLYAMTGLRLGYVIAPDAWVPVLRKLCQNFFISPNSVSQHAGVAALTQCDADVARMRIIYDERRKFMIRRLREMGFGITVEPTGAFYVLANARFLSADSYALAFEILEQAHVGVTPGIDFGEGAEGYLRFSYASSLEKIHEAMNRLEQFVRSRTGCAC

SEQ ID NO: 6147 - protein, 336 aa, Pseudomonas aeruginosa UCBPP-PA14
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPSEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 6148 - protein, 446 aa, Lactobacillus rhamnosus
MARKAITADEIRQTVKDENVLFLRLMFTDINGIIKNVEVPISQLEKVLNNKIAFDGSSIDGFVRIEESDMLLYPDLNTWLLFPWENDHGKIARLICSVHRPDGTPFGGDPRNNLIRVVNEMKDAGFTAFNIGPEPEFFLFKLDEDGNPTTHLNDRGSYFDFAPLDMGENCRRDIVLELEKMGFEVEASHHEVAPGQHEIDFKYADALEAADNIQTFKLVVKTIARKHGLYATFMPKPLHGINGSGMHINMSLFHDKGNAFFDPDTGDQLSETAMHFLAGVLRHAYALTAINNPTVNSYKRLVPGFEAPVYVAWSGKNRSPLIRVPQSRGLSTRLELRSVDPTANPYLAIAAILQAGLDGVKNQLKPEEAVDRNIYRMQDDERKANHIQDLPSTLHNALKALAADDVVKAALGKHLYQSFMDSKNLEWSAYRQQVSEWERQQYLELY

SEQ ID NO: 6149 - protein, 297 aa, Bacillus subtilis subsp. subtilis str. 168
MRTKKRTKEMLPIFDQKKVAFIGAGSMAEGMISGIVRANKIPKQNICVTNRSNTERLTELELQYGIKGALPNQLCIEDMDVLILAMKPKDAENALSSLKSRIQPHQLILSVLAGITTSFIEQSLLNEQPVVRVMPNTSSMIGASATAIALGKYVSEDLKKLAEALLGCMGEVYTIQENQMDIFTGIAGSGPAYFYYLMEFIEKTGEEAGLDKQLSRSIGAQTLLGAAKMLMETGEHPEILRDNITSPNGTTAAGLQALKKSGGGEAISQAIKHAAKRSKEISEDIEKTAAPLSGVIK

SEQ ID NO: 6150 - protein, 403 aa, Cytophaga hutchinsonii ATCC 33406
MTTITNPQTLSTVVNSLSESETLAMTKKARELASQGNKVISLSVGEPDFKTPQHVMDAAKKAIDEGYHSYSPVAGFADLRAAIAEKLVKENNINVTAENIVVSTGAKQSLANVIQAIVDKGQEVIILAPYWVSYSEMVKLAEGKSVILTGTIENDFKVTAAEIAKAITPKTRAIMYSSPCNPSGSVYSEKELREIGELLKQNPQIVAIADEIYEYINFEGKNFSLGSIDEIKDQVVTVNGFSKGFAMTGWRLGYIAAPKYIAAATEKLQGQVTSGTCSITQRAGLAALQGDLSAPLKMKEAYLRRRDLIIDLLKEIPGLKINKPAGAFYIFPDVSAYLGKSVNGQVIKTSSDLSMFILNDAFVSTVGGDSFGSPNNIRISFAASDENIIEAIKRIKECLAKLK

SEQ ID NO: 6151 - protein, 398 aa, Methanosarcina barkeri str. fusaro
MFSINSECVLSKKSEDIPPFYVMEVLESAQALEAEGRHIIHLEVGEPDFPTAPHICDAACAAIGRGATKYTHSQGLPSLREAIVESYQQKFGVELSPDQVIVTSGTSPALLIVFMALLEKMDEVIMSNPHYACYPNFVKYLGGTPVFVYTSETNGFALEPKTVRQCLSPNTKAILINSPSNPGGHVMSPENLQGLAKIADEKRIPIVSDEIYQGLIYGGDEHTILEYTKNAFVLNGFSKLYAMTGWRLGYIICPPECVRAIQKIHQNFFICANSFVQEAGIAALKGPQDHVDEMVHTYNKRRQYMLKRLIGMGLEVRKEPMGAFYVLADARRYGPDSLEMSRRILNEAGVAVTPGIDFGNGAEGYLRFSYANSIENIKEGMDRLEAFLEKELEGLEIL

SEQ ID NO: 6152 - protein, 147 aa, Triticum aestivum
  misc_feature (2)..(2): Xaa can be any naturally occurring amino acid
  misc_feature (70)..(70): Xaa can be any naturally occurring amino acid
  misc_feature (72)..(72): Xaa can be any naturally occurring amino acid
  misc_feature (86)..(86): Xaa can be any naturally occurring amino acid
  misc_feature (91)..(91): Xaa can be any naturally occurring amino acid
  misc_feature (111)..(112): Xaa can be any naturally occurring amino acid
  misc_feature (131)..(131): Xaa can be any naturally occurring amino acid
  unsure (1)..(147): unsure at all Xaa locations
MXPTVMGSSGTSVAPFQGLKSTAGLPVSRRSNGASLGSVSNGGRIRCMQVWPIEGIKKFETLSYLPPLNXEXLLKQVDYLIRSKWXVACLXFSKGGFIFREHNATPGYYEXXVLGKCGKLAMFGVEPTPQXVINEVGRRSKKGVTLA

SEQ ID NO: 6153 - protein, 647 aa, Zea mays
MATMKLGSKPEIFVLQDLTWRCTIELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASKACGSDAAAPVVRNASVDKDALWNGIRSGDTTSSAAAAAAAAGMDWWYEDVSFLSLPMFKRLIQAMEAKGMRDESIAGAIMFYAGRFLPGLKRNTSFSNALASYGADGSGGAGGGMSSRNITPRAASVSAPSEGDQRYFLEEIVALLPTKKGVASTKFLLGMLRTAMLLHASPLCRENLERRIGAQLEDASLDDLLVPNLGYHVETLYDIDCVQRILDYFMSSTDGIGTGYTSPALAEEGGGSLGIPQGATPSSSLSPITMVAKLMDGFLAEVAPDTNLKLPKFQALAAVVPDYARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTAAIAGCPQADADSDVEGDAPDGKETITDVKARVSDLEKECKSMKQEIRRLGKPRRSWSLLTRKCGFGAKVQQAQTAMSGK

SEQ ID NO: 6154 - protein, 177 aa, Triticum aestivum
  misc_feature (99)..(99): Xaa can be any naturally occurring amino acid
  misc_feature (108)..(108): Xaa can be any naturally occurring amino acid
  unsure (1)..(177): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFXREHNASPGXYYDGRYWTMWKLPMSGCTDATQVINEVHEVNKEYPDAYVRIIGFDNMRHVQRVSFIAFKPPGCDESGKA

SEQ ID NO: 6155 - protein, 350 aa, Staphylococcus epidermidis RP62A
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKELGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 6156 - protein, 416 aa, Streptococcus pyogenes MGAS10394
MVYNMEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 6157 - protein, 528 aa, Photobacterium profundum SS9
MELVFVIAAFLAGFIALRCKLPPLVGFLLAGFALNSAGFHSTETLTVLADLGVTLLLFTIGLKLDVKTLLTKEIWGGATLHNLLSTALFTLALLGFKQLGIGMLADLELMQLTLLAFALSFSSTVFAIKALQEKGELNATYGTLSIGILVMQDIFAVLFLTISTGKVPEITALGLFALPLLRPLMFKLLDKAGHGEMLVLYAIFLALVAGAGLFELVGMKADLGALILGMMLAAHPKASEMSKTLFNLKELLLVCFFLNIGLAEQPTFDGFLMAILLLLLLPIKGLLYYVIFNLCRYRVRTSLLGTLTLFNYSEFGLIVSGMAYKLGWLPGNFLVAIAIAVSLSFLIAAPLNSMGHRLYTEASKWLKEYAPEKLNANDQLIDLGDAKILILGMGRIGSGAYDELVTRYGKQIIGVENRDDSALNHRNEGRNVIHGDATDPDFWARVIASHRIKLILLAMPHSQANTFALEQVNLRNYDGKVAAIAKYNDDEELLHELGVDAAFNIYNEAGSGFARHVCEHLKPDITPI

SEQ ID NO: 6158 - protein, 478 aa, Rhodococcus sp. RHA1
MTHPASPPSTVAAHLPPNEPGPHSKRLGMIAVVATFGGLLFGYDTGVVNGALKPMKEDLGLTPFTEGFVVSALVIGAAFGALIGGRLSDRFGRRNNILMLAGVFAFGTLGCVFSPTWEVLGAFRFILGLAVGGASVTVPVYLAEVAPFEKRGSLVTRNEVMIVSGQFAAFVINAIIFNVWGEHSAVWRFMLLIAVLPAFALFIGMLRMPESPRWLSSQGRDDDALAVLHQVRSPRRAEAEMAEVHQLAEEEEKAQTGGWTDLAVPWIRRLVFIGIGLGIVQQVTGINSIMYYGTQLLEDSGFSANGAIVANTLNGLFSVLGITVGIMLINRVNRRTMLLVGYGLITTFHILIGLSALLIPDGSVIKPYLILAFVVCFVFSMQGTLGPLAWLMLAEIFPLKIRSLAMGVCVFVLWMTNAGVAFGFPPVVASLGIAPTFFIFAGLGVLSWIFIVRYVPETRGKTLEEFEEEYSAAYSARR

SEQ ID NO: 6159 - protein, 404 aa, Oceanicola granulosus HTCC2516
MDGAKGFQDAQTGEQKIRNFNINFGPQHPAAHGVLRLVLELDGEIVERCDPHIGLLHRGTEKLMETRTYLQNLPYFDRLDYVAPMNQEHAWCLAIEKLTGTEVPRRAQLIRVLYSEIGRVLNHLLNVTTQAMDVGALTPPLWGFEEREKLMIFYERACGARLHAAYFRPGGVHQDLPDELVEDIDAWAKTFPEVLDDIDGLLTENRIFKQRNVDIGIVNEQEILDWGFSGVMVRGSGLAWDLRRAQPYECYDEFEFQVPVGKNGDCFDRYLVRMEEMRQSTHIIRQACEKLRRERGDVLARGKVTPPSRADMKTSMESLIHHFKLYTEGFHVPEGEVYCAVEAPKGEFGVYLVADGTNRPYRAKLRAPGFLHLQAMDHISKGHQLADVSAIIGTLDIVFGEVDR

SEQ ID NO: 6160 - protein, 330 aa, Saccharomyces cerevisiae
MLDPRILPYYDPAVERKIAVVTGGNTGIGWYTVLHLYLHGFVVYICGRNSHKISKAIQEILAEAKKRCHEDDDGSSPGAGPGPSIQRLGSLHYIHLDLTDLKCVERAALKILKLEDHIDVLVNNAGIMAVPLEMTKDGFEVQLQTNYISHFIFTMRLLPLLRHCRGRIISLSSIGHHLEFMYWKLSKTWDYKPNMLFTWFRYAMSKTALIQCTKMLAIKYPDVLCLSVHPGLVMNTNLFSYWTRLPIVGIFFWLLFQVVGFFFGVSNEQGSLASLKCALDPNLSVEKDNGKYFTTGGKESKSSYVSNNVDEAASTWIWTVHQLRDRGFDI

SEQ ID NO: 6161 - protein, 470 aa, Vibrio parahaemolyticus RIMD 2210633
MKKTKIVCTIGPKTESVEKLTELVNAGMNVMRLNFSHGDYEEHGTRIANFRKVMEATGKQLAILLDTKGPEIRTIKLEGGNDVDLVAGQEFTFTTDTSVVGNKDKVAVTYAGFAADLNVGNTILVDDGLIEMEVIATTDTEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIAKRTDSVLKAELGSRLDSPRLRITEAVCKGAVDTAEKLAAPLIVVATEGGKSARSVRKYFPTANILALTTNKKTAAQLVLTKGVTPVVVDAIESTDAFYVAGKELALESGLGNKGDIVVMVSGALVASGTTNTASVHVL

SEQ ID NO: 6162 - protein, 718 aa, Schizosaccharomyces pombe
CSVSSHTNFTFSNVYKAFIENGKIDVALRLLRKHIDPKVSLGNNTAPSSNSVALQLSILNGFWEVLTEELQKDVHVLLSLVSTLENQVNFPQVDFTTPLLRHITGYLVSRRLEPELISPRVFGFLLEYAAFNVVQTEGTFTSKVILTDLLKCYSNGTYKASFKNVHVVLRSFTYLKEDEMLVASVRDDIVSEAVVGFSTDNNGQKILADISQVCYCLDDLECIDQSINSLVSKMLTSASPEQVDVNILFFQFGKLIETNKFLHPEVYPTLISVLSKNKRFDAVQRVFEHSKHLYRKISTKSLEKANWFMALILDAMILSSSFARQFKSSNLFCDNMKMLGYIPRASTFAHLINNSTRRGDTDDATTALNIFEETKRHNVKPSVFLYNAVLSKLGRARRTTECWKLFQEMKESGLLPTSVTYGTVINAACRIGDESLAEKLFAEMENQPNYQPRVAPYNTMIQFEVQTMFNREKALFYYNRLCATDIEPSSHTYKLLMDAYGTLKPVNVGSVKAVLELMERTDVPILSMHYAAYIHILGNVVSDVQAATSCYMNALAKHDAGEIQLDANLFQSQIESLIANDRIVEGIQIVSDMKRYNVSLNAYIVNALIKGFTKVGMISKARYYFDLLECEGMSGKEPSTYENMVRAYLSVNDGRKAMEIVEQLKRKRYPLPVVNRISSLVNSHMGQKPKRRSLNTSHSSLASLGNASTQHSINSSIN

SEQ ID NO: 6163 - protein, 404 aa, Deinococcus radiodurans R1
MSDSITLSTIPDLLAELRAGRPVILVDDENRENEGDLLMPAATATPQWVNFMAREGRGLICVTLTPERARRLDLTPMVGAGAYGQGTDPNGTAFTVSVDHSSNSTGISAYDRAATIAALLEDTSQPTDFRRPGHIFPLVARPGGVLRRAGHTEAGCDLARLAGFAPVGVICEIMGDDGEMSRLPDLLAFGEKHGLKVGSIEALIAYRMEHDPFMEPVAEAELPTRFGDFRLIGFQDTLSGAEHVALVMGEVTPEPLLVRVHSECLTGDAFHSLRCDCGPQLDAALQAIAEEGRGAVIYLRQEGRGIGLLNKIRAYALQDGGADTVDANLQLGLPADARDFGIGAQILHLLGARKLRIMTNNPRKLHSLSGFGLEVVERVPLHVGEDPHNAGYLRTKREKLGHLR

SEQ ID NO: 6164 - protein, 145 aa, Haemophilus somnus 129PT
MERPMTLEQTLAIIKPDAVERNLIGNIISRLEDKGFQIIAMKMLHLNQEQAEGFYTEHSDKAFFAELIRYMTSAPIVVLVLQKENAVKDYRTFMGTTNPEIAENGTLRYEFAINQTQNSVHGSDSLENAQREIAYFFAEAEIYAR

SEQ ID NO: 6165 - protein, 492 aa, Delftia tsuruhatensis
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALAEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAADVTILPHNLSEALEVLETSKFFREAFGEEFIRYWMHLRRSEWKRFVDAEGQVDFSGDPVTNWEHREYFELF

SEQ ID NO: 6166 - protein, 137 aa, Synechococcus sp. WH 5701
MTTPADSPRAQYRADRVTMDAMTTPTPRAIRASALQQRLLSGEPLLLVDVREPAELEMAALQEPVLHLPLSRSAEWLERIESLIGRDQTVVVLCHAGIRSWQFACWLMEAQGYDDVLNLQGGIDAWSVEVDPSVPRY

SEQ ID NO: 6167 - protein, 546 aa, Staphylococcus aureus subsp. aureus MSSA476
MSKEIDWRKSVVYQIYPKSFNDTTGNGIGDINGIIEKLDYIKLLGVDYIWLTPVYESPMNDNGYDISNYLEINEDFGTMDDFEKLIKVAHQKDLKVMLDIVINHTSTEHEWFKEARKSKDNPYRDYYFFRSSEDGPPTNWHSKFGGNAWKFDSETDEYYLHLFDVSQADLNWDNPEVRQSLYRIVNHWIDFGVDGFRFDVINLISKGEFKDSDKIGKEFYTDGPRVHEFLHELNRQTFGNTDMMTVGEMSSTTIENCIKYTQPERQELNSVFNFHHLKVDYVDGEKWTNAKLDFHKLKKILMQWQRGIYDGGGWNAIFWCNHDQPRVVSRFGDDTSEEMRIQSAKMLAIALHMLQGTPYIYQGEEIGMTDPHFTSIAQYRDVESINAYHQLLSEGHAEADVLTILGQKSRDNSRTPMQWSDDVNAGFTAGKPWIDISENYHQVNVRQALQNKESIFYTYQKLIQLRHTHDIITYGDIVPRFMDHDHLFVYERHYKNQQWLVIANFSASAVDLPEGLAREGRVVIQTGTVENNTISGFGAIVIETNA

SEQ ID NO: 6168 - protein, 129 aa, Synechocystis sp. PCC 6803
MHDSPEASSPAPTPHPETTRTPPWGMVTMLEEGPRYRINRIVVKPGQHMSTQMHYHRSEHWVVVSGTAKVICNGEEKLLNQKESTYVPMNTPHRVENPGVIDLVMIEVQNGEYLGDDDIVRFPEELPKS

SEQ ID NO: 6169 - protein, 391 aa, Mesostigma viride
MLQTKTDPMVISMGPHHPSMHGVLRLIVTLDGENVIDCEPVLGYLHRAMEKIAENRTIVQYLPYVTRWDYLATMFTEAITVNAPEKLANIEVPKRASYIRVIMLELSRIASHLLWLGPFMADIGAQTPFFYILREREMIYDLFEAATGMRMMHNYFRIGGVASDLPYGWVDKCLDFSDYFLPKVDEYERLITNNPIFLKRVRDVGFISREEAINWGLSGPMLRASGVQWDLRKVDNYECYGELDWNVQWQSDGDCLARYLVRLGEMRESTKIIQQALKAIPGGPYENLEARRLSKGRKSEWNNFEYQFVGKKPSPTFKIPKQEHYVRVEAPKGELGVFLMGDDNVFPWRWKIRSPGFINVQILPELVRGMKLADIMTILGSIDIIMGEVDR

SEQ ID NO: 6170 - protein, 508 aa, Spiroplasma citri
MQKKTAQKYGFFMCFCMVVGTVIGTGIFFKNEGVYGLTNGNGILGLIAWIIGGLMALSFGLSFMEISSAKQDSNSGIALYAKMFGGKWFGRVVRNAMNHIYIPLTTFTVAYYTTKASIWAFGGGLMAEIAFSEKVGGYANYQLILTSFSVIYTVLLIYICTYLEKTGKYIQMVTVVLKLIPLILVGLIGMFFFNNDPNALSKSGLGDPDKYKLVLNKTGFEMILMALPGILFSFDGFLSTTYIQKDVKKPERNIPLALVLGLASVTILYLLVSIGTLNLDARGSVAAAAGKIFNNPVLNKIFERIIFFFILISAFGTLNGYSFSLVKLSHSSIEDNFIIGAKLWNKIMKKYSINFAIFLASVMITLVWGLIMGIPTIFAKETYNFYDFISNAGVVMAFLMYGTIIALRIWNRYHQRITTIKNWYFLPAAIISVICIIAIIGYNIYSYFLNAIVMPEKTGPILAIVLLLLILVLPWFGIWMKDNDTINKKLTMPMQFNEQDSKKDLKKI

SEQ ID NO: 6171 - protein, 228 aa, Triticum aestivum
MMRSCLSLALLVALSAAGCAAAQAADYDFFYLVLQWPGSYCDTKQSCCYPRSGKPAADFGIHGLWPNRDDGSYPQNCNPANAFDPSKVSDLLSTLRTEWPTLACPTSDGLQFWAHEWEKHGTCAQNLFNEHGYFQTALHLRDQLRVLDALTSAGVSPDGGYYTLSAIKGAIQQGTGFEPFVECNRDESGNSQLYQLYFCVDANASGFVECPVQPGGRPCGNRIEFPTF

SEQ ID NO: 6172 - protein, 263 aa, Magnetospirillum magnetotacticum MS-1
MTKILLVGCGKMGSAMLAGWLERGTSPGDVVVVEPSCPDLGSVRVVASHAAIPEGFVPHVVIFAVKPQVMADVVPPYARFGTSLFLSIAAGKTIAFFRSLLGPDAVIVRAMPNTPAAVRRGITVCCAEASVPAQARDLCGSLLEAVGEVGWVDDEALMDVVTAVSGSGPAYIFLLAEAMEAAGLAQGLPPALAERLARATVAGAGELLRLSSETTQQLRQNVTSPGGTTAAALAVLMAEKNGIPGLMSEAVAAATRRGRELAG

SEQ ID NO: 6173 - protein, 487 aa, Sinorhizobium meliloti 1021
MNPETTAVPYERLGILIDGRWIYEAERSTEVVDPATGQTIARLPFAADGEIAEAVASSQRAFESWKDRSPLERGRILRRFADLARKHADEIARNMTRDQGKPLSEAIGEIRFAADHADWHAEEARRIYGRVIPARDPRVQQMVLREPVGVCIAFTPWNFPFSQALRKVVAALASGCTIILKGPGESPSSTVAIGRLMQEAGLPDGCLNILWGDPAHLSETLLAAPEVRKISFTGSVEVGKHLASLAGRHMKRSTMELGGHAPVILFDDADIEAAADALAGQKVRNAGQVCISPTRFYVQAKGHDRFLARFAEKIASTRVGNGFQESVQMGPLCHGRRVAAMEGFIQDAREQGAEIVTGGERVGNAGFFYAPTVVAAGTDELRLMKEEPFGPIAVVTPFGDFDEVIRRANSLPFGLASYVFTGSSSRAQNAARALAAGMVSVNHFGLALPETPFGGINDSGYGSEGGSETFDGYLNTKFVTRFDQIPQ

SEQ ID NO: 6174 - protein, 108 aa, Triticum aestivum
GPKTRTKPPGNRKRPRKIYKVAPPENPPPEEFHIRTLAPVFGSKEKARGAVLYHYKHAASGFSAKLTTEQVEDLKKQPGVLQVVPSQTVQLHGNEGGHAKTTRTMGLM

SEQ ID NO: 6175 - protein, 233 aa, Zea mays
  misc_feature (224)..(224): Xaa can be any naturally occurring amino acid
  unsure (1)..(233): unsure at all Xaa locations
MAMERELMETFEAAKKAADAAAEEADGSSPEAERCLDALRRLREFRVNTDVLVSTQVGKRLRYLTKHPNSDIQAVAADLFGYWKKVVIEETGKKNGTPANGKSNNSAAKAEKPQPMKVEKKSAHVKVEKNSTSTTVKSEKNATVKTEKNSMSASVKIEKTANSDSKVQVKVEKVSKEVSRTSETKKPSSVPNGPPKLTSLVRCNDAARDKYRELLGDAFVKVPXETSDDDREE

SEQ ID NO: 6176 - protein, 399 aa, Mesostigma viride
MAIEYSVKPKKVKNFQLNFGPQHPAAHGVLRLVLEMNGEVVERADPHIGLLHRGTEKLIEYKTYLQALPYFDRLDYVSMMAQEHAYSLAVEKLLGIRSVPLRAQYIRVLFSEITRLLNHLLALTTHAMDVGALTPFLWAFEEREKLLEFYERVSGARMHAAYIRPGGVAQDIPQGLCDDIYQFTQQFASRIDEMEEMLTNNRIWKERLIDIGVVTAEKAMQWGFTGVMLRGSGIPWDLRKAEPYEVYDQLEFDIPVGTKGDCYDRYLVRVEEMRQSLRIIVQCLNKMPLGIVQIDDRKIMPPSRFSMKHSMESLIHHFKNFTEGFSVPAGETYTAIEAPKGEFGVYLVSDGTNRPYRCKIRAPGFVHLQGLDMMSKKHMLADVVTIIGTQDIVFGEVDR

SEQ ID NO: 6177 - protein, 413 aa, Yersinia pseudotuberculosis IP 32953
MAKVSLEKDRIKFLLVEGVHQSAVDNLRAAGYSNIEYHKGALDAESLKASIRDAHFIGIRSRTHLSEDVFAAAEKLVAVGCFCIGTNQVDLKAATKRGVPVFNAPFSNTRSVAEMVLGELLLMFRGIPSANAKAHRGEWNKLAVGSFEARGKKLGIIGYGHIGTQLGILAESIGMKVFFYDIENKLSLGNAQQVRQLSDLLNMSDVVSLHVPENHTTKNMIGAEQLAQMKPGALLINASRGTVVDIPALCDALSSNHLSGAAIDVFPEEPATNKDPFNSPLCEFDNVLLTPHIGGSTQEAQENIGDEVAGKLAKYSDNGSTLSAVNFPEVSLPAHGDNTRRLLHIHENRPGILTSINTIFAEQNVNIAAQYLQTSADIGYVVIDVETDDADNAEKALQAMKAIPGTIRARLLY

SEQ ID NO: 6178 - protein, 461 aa, Lactobacillus plantarum WCFS1
MTKENSQPATEQLSRGLKSRHVQLIAIGGTIGTGLFLGAGQSIHLAGPAILIAYLVTGLVCFLLMRALGELLLSDLHTHSYIDFIKQYLGDKTGFVAGWTYWVCWITIAMAEITAAGEYMQFWWPRLPQWLPGLIILILLLGLNSINVSAFGETEFWFAIIKIAAILALIAVGIGMVLLSVKTPVGHASLTNLVSYGGFMPHGIKGLVLSFQMVLFSFIGIEMVGMTASETADPKTVIPKAINDIPVRIILFYVGSLFFLMCMYPWQYFSAAHSPFVQVFTNLGIRSAAAIINFVVLTAAASSCNSALFSTGRMLFSLTYDGKSKFAKRMGILSTRQVPRNALWFSTLVIGLSVILNLLMPGKVFSLIASVSTTCFIFIWGAIVVAHIKYRRQAGSQAKVKFRMPLFPLSDYFILVFLAFIAVVLCLKFETLIALLVSAVWVVGLYIVKIVSDRIRQRTHD

SEQ ID NO: 6179 - protein, 406 aa, Oryza sativa
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIHKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMSTEIHQRVPLYIGNVEEVEKVEKFLA

SEQ ID NO: 6180 - protein, 360 aa, Zea mays
VVASSPPRPPPRRPSEFWYLKTKLFRCRPSTPFHGVAFLVGLASLASLETIKKQVAIMYLWPKALEVPIMDPSKASKKPVGILLVKVVRAQNLRKKDLLGKSDPYVKLKMSDDKLPSKKTTVKRSNLNPEWDEEFKFVVTDPESQSLEVNVFDWEQVGKHEKMGMNMVPLKDLPPEETKFTTLNLLKTMDPNDVQNEKSRGQLTLEVTYKPFKEADVETEDTEGTNVIEKAPDGTPAGGGLLYVIGHEAQDLEGKHHTNPYAKIIFKGEEKKTKVIKKNRDPRWEDEFEFVCEEPPVNDKLHVDVLSKASKKGLIHGKETLGYIDISLADVISNKRINEKYHLIDSKNGQIQIELQWRTS

SEQ ID NO: 6181 - protein, 146 aa, Zea mays
  misc_feature (59)..(59): Xaa can be any naturally occurring amino acid
  misc_feature (115)..(115): Xaa can be any naturally occurring amino acid
  misc_feature (133)..(133): Xaa can be any naturally occurring amino acid
  unsure (1)..(146): unsure at all Xaa locations
MPHGILVADESTATVGNCLASIIVYNVKDKRPALRALLDCCTVALHYIMRVILLKETLXLNTKDVKPLAYVIREVGPIPGSYVHNGSTEAGRTHTETTIRGHTDLGKRWSTYYDXAARFFQRIAVLYIAPYDXTLLAIDLNAQVVS

SEQ ID NO: 6182 - protein, 282 aa, Brassica napus
MASLRFSVTFPALLSLLLLSLWVVEAYTSRKLISNNEQEGQNISHLFKDGEFEDPTMYMFFKISDLKLGTKLPIYFNKNDLRKVPPLLTRQEADLIPFSESNLDFLLNHFSISKDSPQGKAMKETLKRCDFKAIEGEYKFCGTSLESMLDLAKKTIASNADLKVMTTKVMVPDQNRISYALHNYTFAEVPKELDGIKVLGCHRMPYPYVVYYCHGHKSGTKVFEVNLMSDDGIQLVVGPAVCHMDTSMWNADHVAFKVLKIEPRSAPVCHFFPLDNIVWVSK

SEQ ID NO: 6183 - protein, 249 aa, Phytophthora infestans
MDRDSLVFLAKLAEQAERYDEMVDHMKAVANNHNVELTVEERNLLSVAYKNVIGSRRASWRVISSIENKGDSERSEHIKAYRQKIEGELVDICNDILTIIENNLIPNSSSEEGKVFYYKMKGDYHRYLAEFQVDDERKESSDKALESYKQASTIAMAELPPTHPIRLGLALNFSVFYYEILNSPDRACNLAKQAFDDAIAELDTLSEESYKDSTLIMQLLRDNLTLWTSDQEPDNADANQGDMNVQDVE

SEQ ID NO: 6184 - protein, 303 aa, Burkholderia vietnamiensis G4
MSGFTNADVPDQSGKTFIVTGANTGIGLEIASTLAARRARVLLARRDEAKAEAAISRIRLKTPEANLAFLPLDLADLTSVRNAAKLVEKEPRVDVLINNAGVQGPKLKRTVQGFELTFGVNHLGCFAFTVLMLPRLTETSGSRIVVTSSGLHKSAKIEWDDLNAEKSYKWMPRYAASKLANLLFVFELDRRLRAAGIAVTALACHPGLAGTNLARDSWWGNIAMSLIGLFFNTPAQGAWGALQAATGQIKSGGYYGPTKTSELRGPSGECTPSQDARNPELAKRLWDVSVQLTRIDVELPSNA

SEQ ID NO: 6185 - protein, 725 aa, Rickettsiella grylli
MQPLAPLIKDLAVILGVASLVTLLFQKIRQPVVLGYLLSGMIVGPHIPPYDLVADVPSLRTLSELGVIFLMFSLGLDFSFHKLKRVGTPAIITGIFEVVIVLLIGFLLGKFLGWPIYDCIFLGAALSISSTTIIIKAMEELGLKSKHFAELIFGVLIVEDLLAILLLAGLSIVVGTHAVISTTLADSAIKLFIVVGSWFLIGYFLIPTLIRKLVNIANQETLTIVSVALCLILVCIAAYFGYSTALGAFIMGSILAETDLIQFIEQYMRPIRDIFAAVFFISVGMLIDPSIIIQNSGVVLFISILTIVAKIFATATGALVAGQSLTTAVRSGFSMAQIGEFSFIIAGLGLTLQVTRPALFPIIIAVSAVTTFTTPYLILSSATFSQFLEKNLPPRTSAFLNHYAILIHRYLRLKKKRVMYSQYITRLLINSVMVAIIFSLSEKWIFPKINQWISNTYWVNTLSCLIAFLFASPFIWGMIFAYRAFPHRRHTAIKPIIVLGWTFTLTVLTTLAITYFHTWSIILVLLIVALALFSLLHKPLQKFYPWLEKRFLANIKTPSIHETFKDELNAWGINLKGTDIQNNYYFINKTLQELKLFQQFGIHVIALYRGPKIILSPTHHEKIRLYDKLFILGSDEQIDTFSQLLKITTYHEELELFNQLELKTFLLDKNHPFVGLSIAEALKKTHIDGIVLGMERQKARKINPNKETILHKEDLLILLVYKTSH

SEQ ID NO: 6186 - protein, 492 aa, Ustilago maydis 521
MSETHGQAFHRAGFSPPAHAGSFSAMMAAQAGAQRLSNGTSIHSSTSPPASFSPTGARVRAASQSVPLSAPRLLTPFDTGDIRILLLENVSQGAVKMLKEQGYQVDFHTKAWSEEELIQNIGQYHAIGIRSKTKLTAKVFRAAHKLLVVGCFCIGTNQVDLEAAAKAGVAVFNSPFANSRSVAELVIGEMISLSRQLGDRVNEMRSGTWNKVSKGCYEVRGKILGIVGYGHIGSQLSVLAEAMGMHVIYYDVVPLMPLGSARQVSTLNELLSTADFVSLHVPELPETKNMIRKEQIEAMKKGAYLINNARGSVVDIPALVEGLRSGHLAGAAVDVFPKEPAASGPGTFSNELNSWASELCQMPNVMLTPHIGGSTEEAQRMIGIEVSDALIRYINYGGSVGAVNFPEVDLRAITEADSRVIRICYVHQNQPGSLRAVNEILGSFNVDKQHSDSYKATAYLLADISGVSENDIREIYDRISKTDANILTRLLS

SEQ ID NO: 6187 - protein, 97 aa, Ustilago maydis 521
MSANALTRAFPKALKEVRLHLCQTGQASAGARKFLEANYKPIKQSNPDLPFLVREASGTPARAFARFERGVEKHVELDGLSSADVEKKFGELLSSSA

SEQ ID NO: 6188 - protein, 842 aa, Thermosynechococcus elongatus BP-1
MTSLIPPGCPTVLTEDDRTGTSIETLRRAFMDNLFFIQGRFPEVATKNDYYLALAYTVRDRLLLRWLNSAKTYRDQESRTVCYLSAEFLLGPHLGNNLINLGLYEAVEEAMRQTGLNLKELLDQEEEPGLGNGGLGRLAACYMDSLATLEIPAIGYGIRYEYGIFDQEIRDGWQVEITDKWLRYGNPWEIPRPELILPVKFGGHTYSYTDDQGRYRVIWEPHQVVQGVAYDTPILGYKVNTANLLRLWRAEAVESFDFQAFNTGDYYGAVNQKIASENITKVLYPNDEQLQGKELRLMQEYFFCSCALQDMIRLYKQSGKQDLSRFHEKFTVQLNDTHPAISVAELMRLLVDEHLMPWEQAWDITRQTFAYTNHTLLPEALEKWPLDLFGSLLPRHLQIIYEINRRFLDEVRLQYPGDNDRLRRLSIIDESGCRYVRMAHLAAVGSHAINGVAVLHSELLKQTVLRDFYELTPEKFSNKTNGVTPRRWMVLSNPGLTRLITERIGEDWVKHLDQLRQLEPLAADAEFAAQWRSVKHGNKERLAQYIRDRIGVTVDPHSLFSILVKRIHEYKRQHLCVLKVITLYQMLRDQPHLEMVPQTFIFGGKAAPGYYMAKLIIKFINSVADVINRDPVVRDRLRVVFLPNYNVTLGQRVYPAADLSQQISTAGYEASGTGNMKFALNGALTIGTLDGANVEIREAVGAENFFLFGHTVEQLQELRCNGYRPWEFANGHPMLKRVLDLISSGYFSHGDTELFRPLVEHLWQDDRYCLLADYQSYVDCYQRVLQVYQDQAQWAKMSILNVARMGKFSSDRAIREYCQDIWHVQPVKIVLPATAYMTSPGQ

SEQ ID NO: 6189 - protein, 271 aa, Haemophilus influenzae R2866
MQHKLIAFIGGGNMAQAIILGLLKQGYPAEQIIVNDPNEEKKAFFANLGVATSENNVESVIKAEVVLLAVKPQMMADVCLPLSAVDFSDKLLISIAAGISTERLNALIPSVKSIVRVMPNTPALVGEGMAGLFAPKNTSENHRTFAQDLLGAVGRTVWVDDETQMHAVTAASGSSPAYFFLMLEAMQQALIKMNIDEKTARELVQQSMLGAAKMVIENPQIALSTLRENVTSKGGTTAAALAVFDAQHLNQTIEQAMQACLSRSQEMETLF

SEQ ID NO: 6190 - protein, 400 aa, Magnetospirillum magnetotacticum MS-1
MPFIADRLSAIKPSPTIAVTQKAAELKAAGRDVIGLGAGEPDFDTPDNIKTAAKVAIDKGLTKYGPPAGTVDLRNAIAAKFKRENGLDYTADQVTVGVGGKGVIFNAFMATINPGDEVIVPAPYWVSYPDIALMFGGKPVFVPCPEAAGFKLQPADLEAAITPKTKWLVLNSPSNPTGAAYSWDEMKALTDVLVKHPHVWIMSDDMYEHLVYDDFKFCTPAQVEPKLYDRTLTMNGVSKAYAMTGWRVGYAAGPVAIIKAINMIQSQSVTHTSSISQAASVEALNGTQDFIPKNAAVFKRRRDLIVGLLNQCPGITCRTPEGAFYVYPSCAGVIGKKTPDGKVINSDTDFVGALLEAEGVAVVQGAAFGLEPYFRISYATSDAALTKAAERIKRFCESLK

SEQ ID NO: 6191 - protein, 260 aa, Photobacterium leiognathi
MAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDQVVSQDFIGETQTSVFDAKAGTL

SEQ ID NO: 6192 - protein, 607 aa, Rhodococcus sp. RHA1
MSATPTLKKALSQRQLTMIAIGGVIGAGLFVGSGVVIGDTGPGAFITYALAGVLIIMVMRMLAEMAVANPSTGSFADYARAALGNWAGFSVGWLYWYFWVIVVGFEAIAGATIIQYWIDIPLWLSALVLMILMTATNLFSVSSFGEFEFWFAGIKVAAIVVFIGLGTLFVLGVWPNKSLDFSNLWSHDGFLPFGAMAITVGVVTVIFSMVGAEIATIAAAESADPERAVTKAANSVIVRIAVFFVGSTFLLATILPWNDEDAAASPFVAAFTEMGIPYADHIMNAVVLTAVLSCLNSGMYTASRMLFVLAARREAPAQLVRVTRRGVPAIAILASSVVGFLCVIAAAVSPDTVFVFLLNSSGAVILFVYLLIAVSQIVLRYRTKDSELRVKMWLFPVLSIITAAAIVAILVQMYLQEDVRSQLVLSLLSWAVVIVLFLANKWFVGRRPVVEGVAATTRPHRVLVLANQTVQSKEMLDELRRIDADRDATYFVVVPASPIETGTAATHGPLDVAEATREVAQRRLDDTLATLRAENLEADGELGDYRPLRALAAAVDSFRPDQIVISTLPPEESVWHRFDVVDRARAEHSVPVTHVVVTPVAAEGSPR

SEQ ID NO: 6193 - protein, 362 aa, Smittium simulii
SGMCKAGFAGDDAPRAVFPSIVGRPRHHGVMVGMGQKDSYVGDEAQSKRGILSLKYPIEHGIVTNWDDMEKIWHHTFYNELRVAPEEHPVLLTEAPLNPKSNREKMTQIMFETFNVPAFYVNIQAILSLYSSGRTTGIVFDSGDGVSHVVPIYEGYSLPHAILRLDLAGRDLTERLMTLLTERGHTFTTSAEREIVRDIKEKLCYVALDYDQEMETALQSGSTEKSYELPDGQIITVGAERFRCPEALFQPSLLGLECSGIHESTYNSIMKCDLDIRRDLYGNIVMSGGTTMYPGIADRMQKEISSMAPSSMKIKIVAPPERKYSVWIGGSIVASLSTFQQMWISKQEYDESGPSIVHRKCF

SEQ ID NO: 6194 - protein, 324 aa, Sorghum bicolor
MGFLICCARLLQLLLLLLLTTATPPVAAQPQPSSPARALDAALQDYAFRALSARPRTGIVYNATVPGNLTGIAASALRLRSGSLRRRGFPGYFQFALPPGIVVQPHVERVVLVYHDLGNWSDRYYPPPAGYAYLAPVLGLLVYDAANLSAVGVGLPELSIVASGVPISVAFDGVRAVPAGGAVARCVVFDLDGVPQFRDLEGTNVCTTYRQGHISIVVNSSEIAPAPAPAGVIAPPIPTEGGGKKGSSDAWKIAVGVVGGATALGLLAALLLCLVRYKRDKKLQLMERNAEVGETLRMAQVGRTQAPVALGTRTQPVIENDYAA

SEQ ID NO: 6195 - protein, 325 aa, Sorghum bicolor
MGFLICCTRLLQLLLLLLVLTTATPPVAAQPQPSSPARALDAALQDYAFRALSARPRTGIVYNATVPGNLTGIAASALRLRSGSLRRRGFPGYFQFALPPGVVVQPHVERVVLVYHDLGDWSDRYYPPPAGYAYLAPVLGLLVYDAANLSAVGVGLPELSIVASGVPISVAFDGVRAVPAGGAVARCVVFDLDGVPQFRDLEGTNVCTTYRQGHISIVVNSSEIAPAPAPAGVIAPPIPTEGGGKKGSSDAWKIAVGVVGGAAALGLLAALLLCLVRYKRDKKLQLMERNAEVGETLRMAQVGRTQAPVALGTRTQPVIENDYAA

SEQ ID NO: 6196 - protein, 400 aa, Methanococcoides burtonii DSM 6242
MKVIRDPIHGYIELDELILPLIDTPQVQRLRRIKQLGLSNLVYPGANHTRFEHSLGVMHLATMLTSQIDSIENEEKEELRAAALLHDIGHGPLSHATENLIRHYTRERHEDVKSILRKGEISEILEDNGLDPMTIAAHIKGETDLGKIVNSEIDVDRMDYLVRDAHYTGVAFGLVDYVRLIHEMRFYENNLVVNAGGLKAAESLLVSRFLMHPSVYYHHVSRIAETMFTRAVKHLIDKGALDPFKLRMMEDDQLFELIRADDDYAGKIAKRLDERRLYKRALHVGHEVVGEGVMRYRGKVERVEAEIADMVGIDSQEILIDIPKRPEIAEMKALINMNGKMVRLDEASNIVATLEKAHFDNWKMGVYTIKEHRDAVGKAAREFFGAKKETTQYRFSDIEE

SEQ ID NO: 6197 - protein, 307 aa, Magnetospirillum magnetotacticum MS-1
GAPDLHRVARFVEKPDAAGAERLIGEGALWNSGYFLFRADVMIAELEAHAPQVLEAARGALAKAATDLDFIRLEASAFAQAPKTSIDYAVMERTTRAGVLKVSFAWSDVGTWDAVWQVLERDAHGNAVRGRVELVETTGSLVHSEGDGLTTVVGLDDVVVVSTPDAVLVAAKAHSGKVKDLVGVLREKAHPEADAHRRIYRPWGWYQRIDIGERFQVKRIMVTPGGRLSLQKHFHRAEHWVVVKGTAEVTLNEQILLVHENEAVYLPIGSMHRLTNPGKIPLELIEVQVGSYTGEDDIIRVEDVYGR

SEQ ID NO: 6198 - protein, 414 aa, Arabidopsis thaliana
MNCFSCFYFHEKKKVPRDSDNSYRRNGEVTGRDNNKTHPENPKTVNEQNKNNDEDKEVTNNIAAQTFSFRELATATKNFRQECLIGEGGFGRVYKGKLEKTGMIVAVKQLDRNGLQGNKEFIVEVLMLSLLHHKHLVNLIGYCADGDQRLLVYEYMSRGSLEDHLLDLTPDQIPLDWDTRIRIALGAAMGLEYLHDRANPPVIYRDLKAANILLDGEFNAKLSDFGLAKLGPVGDKQHVSSRVMGTYGYCAPEYQRTGQLTTKSDVYSFGVVLLELITGRRVIDTTRPKDEQNLVTWAQPVFKEPSRFPELADPSLEGVFPEKALNQAVAVAAMCLQEEATVRPLMSDVVTALGFLGTAPDGSISVPHYDDPPQPSDETSVEDSVAAEERERAVAEAMEWGVASRAHSRNPSAS

SEQ ID NO: 6199 - protein, 148 aa, Trichodesmium erythraeum IMS101
MSEIENHQQPSTPFLDSEANNEQKYPTRTPPWGTVTILEEGLRYKISRIEVKPKHYISTQMHYHRSEHWIVVSGTAKVTFNDQEKLLFQKQSTYVPANTAHRVENPGIIPLIMIEIQNGEYLGEDDIIRFPDEDNQLFSFKKAITNKE

SEQ ID NO: 6200 - protein, 239 aa, Triticum aestivum
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHITVQGPYLTYEESYLAVTGGSGVFEGVYGQVKLNQIVFPFKIFYTFYLKGIPDLPKELLCTAPVPPSPTVEPTPAAKATEPHACLNNFTD

SEQ ID NO: 6201 - protein, 486 aa, Zea mays
MAPPRISFLELCLSFLCFVVFYYFHMRSKRKKPFRAAGLAAGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNGQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPKLSIILHMKNGFMATVKRRRQTFA

SEQ ID NO: 6202 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 6203 - protein, 469 aa, Vibrio vulnificus CMCP6
MSVENVLSLIQENEVKFVDLRFTDTKGKEQHISIPSHQIDADFFEDGKMFDGSSVAGWKGINESDMVMMPDASSAVLDPFTEEATLNIRCDILEPATMQGYDRDPRSIAKRAEEYMRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHAFGKTATFMPKPLVGDNGSGMHVHQSLAKDGVNLFAGDKYGGLSEMALYYIGGIIKHARALNALTNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLKQALEYLDNDREFLTAGGVFSDDFIDSYIELKTKEVERVNVAVHPLEFELYYSV

SEQ ID NO: 6204 - protein, 271 aa, Haemophilus somnus 129PT
MQHKLISFIGGGNMAQAIVLGLLKQGYPAHYIRVCDPNQSRRDLFIAQGTQVSSNNVEAIQDADVVLLAVKPQIMAEVCVPLSVVDFSDKLVISIAAGISTVRLTALLPSAKNIIRVMPNTPALVSAGMSGLFATPQVSVNLKQFAQDLLSAMGEICWLEQEQDMHAVTAGSGSSPAYFFLFMEAMQQALIEMNLDPKTARLLVQQSALGAAKMVIENPQIALSELRENVTSKGGTTASALVVFNEQNVTQIIKQAMLACVKRSQEMESLF

SEQ ID NO: 6205 - protein, 401 aa, Oryza sativa
  misc_feature (241)..(241): Xaa can be any naturally occurring amino acid
  unsure (1)..(401): unsure at all Xaa locations
MPLSSLSLLPLHRAPLPPTSNYPPPPPPSRALLLPLLRHSPLARRSPVSRARAVAADGMAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGYVLYSSRTRAHIIGXSRNHSFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEV

SEQ ID NO: 6206 - protein, 446 aa, Thermoproteus tenax
MFTKIVATLGPSTDRLPDITALLSKVHGVRINMSHASPSEVEARVNAVRKYEETSGRYIAIIADLRGPSVRTGLMRPLQITAGARVSFKLAEKGDGFVPVPRREFFEVIEEGDEVLMLDGKLVLRIISAAQTSAEAESLSSGVISSNKAIVVKGKEYHIEQPVEEDIRALQTLSRFRDDVDYVALSLVRDGADVRKMRSVVEEAGLTSGIMAKIETKSAVDKIEEIINAADYIVIARGDLALHYGLEYIPKVQRLLVERSLSAGRPVAVATQLLDSMQTNTTPTRAEVNDVYTTASLGVDSLWLTNETASGEHPLEAVDWLRRIVSQVEFGRLKAASPADARDRFAKAVVDMAEDMGGEIAVYSMTGTLAKRIAKFRPMTTVYVGVNERRLARMLELREDVGAHMGPRACGRAGAYLRGGPREAPLQILRQSLDSHVWAQRRHTYY

SEQ ID NO: 6207 - protein, 170 aa, Zea mays
  misc_feature (67)..(67): Xaa can be any naturally occurring amino acid
  misc_feature (76)..(76): Xaa can be any naturally occurring amino acid
  misc_feature (127)..(127): Xaa can be any naturally occurring amino acid
  misc_feature (143)..(143): Xaa can be any naturally occurring amino acid
  unsure (1)..(170): unsure at all Xaa locations
SPGCFFPPTPRASIIPVYCGKYTDELIKNAVYIGTPGKGILAADEGTGTMGKLLSTINVHNGEENRXRALRELLLXCPGALHDIRTVILYEETLYQKTNDRLPIVAVHEDGRVLPGINVDKGPMDAXATDYETTTLSADYLGXRCPKYYEAGARIAKWGADLKTGPYEPS

SEQ ID NO: 6208 - protein, 464 aa, Bradyrhizobium sp. BTAi1
MASLIEMAASEMDQATWAGRSGSSVVASVSWPVATAVVIADMIGVGVFTSLGFQVKDIPSGFAILVLWAVGGLVSLCGALSYAELGTMFPRSSGEYNFLTRAFHPAVGFMAGWVSATVGFAAPVALAAMAFGEYGRAVLPGVSPLMLAVGAVWLVTAVQLGGIRRSGHFQLLSTVLKLGLIVAFLIAGYVITVPQPVSFRPAAADIGHVTSAAFATGLVFVMYAFSGWNAATYIIGELHAPERTLPRALLVGTAVVLVLYMALNAVFLRAVPMQDLAGQLQVASIAGAHIFGETGGRFVAAMICVGLIPSIAAMMWIGPRVLMTMGEDVPALAVFARRSRDGAPTYAVLFQLAVATLMLFTESFEAVLDLVQFSLLCCSFLTVLGLITLRVTKPDLARPYRAWGYPITPLVFLGVTGFMIYYLVTARPWQAGLGALAMVSGLLIYWFAHARPGRAAAAAVSGSE

SEQ ID NO: 6209 - protein, 347 aa, Zea mays
MNPVFQAPSGTNKDQSVQGSLEPDPFDSSTKGAAKPQSSLSSLIFLGTGCSGSLPDTRCLLKPSTPPCGVCSMGVSLPPERNPNYRLNTSLLIDYCHDETHKYILIDIGKTFREQVLRWFVHHKVPSVNSIILTHEHADAVLGLDEVWVVQPRNGRNDIEQIPIFLTQFTMDSIARRFPYLMEQKPEDGDEDAQAAKIDWKIIEDDVDKPFVASGLEFVPLPVMHGEGYICLGFLFGRRARVAYLSDVSRFLPKTENVISKSGAGQLDLLILEANALHGVGDSFSTHLTLSESLDAIKRIRPKQALLIGMRHFFEHERENQMLAEWSIREGIPTQLAHDGLRVFIDL

SEQ ID NO: 6210 - protein, 506 aa, Triticum turgidum
MDGLQQGFHQSLRQHQSSMLQKRLQQEDQAKETEILATLAGSKEQDMSHIDRSYLTMNLRGDGRTMRDGDLRQRCSLQEMHCCMCQGVNNKHRRQRRAIHMEGPKFKTRAYLYCTCYGFYESKVSEANRQHNMTTTRTNCGAKMRLKKENDGTFVVKEIVWEHNHRLQLTAEMLAFLHSHKNFDKTILEYVKYLQFKGIEHAQIMSILGDDDPGSYFLEMNAKDLINLKAKNSRIDDVDDVLKTVNFFREMKAINREFFCDMQLDESDRTTFFGFALIRDEDADSFKWLFKTFLRCMRGKAPTCILTDQCPAMALAIPDVFKNTVHKLCRWHIMKKYMEHLAYLYYLHDDFKDEFTSMLNWPLMPTEVEDAWKRLMDKYNLHDDATMVGMWNERERWISAYFKEIFCAKMTSTQQSESMNYVLKKNFVSERQNLHRFVSQKEQNTLTFYGFDTQMAELYSRAVYSEIRKRLNLSTLFTAIEMEEPTKYLVRYNHPQKMSVWAQHAF

SEQ ID NO: 6211 - protein, 243 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSHIDCGVSIGTIFGIYMVKDKDNVTLEDVLQPGTNMLAAGYCMYGSSCTFLRPGRPIHFDSSYNCIDCRYQLWQLVLSTGNGVNGFTLDPSLGEFILTHPNIKVNDKKNSTLLFFPG

SEQ ID NO: 6212 - protein, 454 aa, Haemophilus influenzae 86-028NP
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQAKDAIGAYPRDCELAAAIQKACFKNKLLLERGGRGGNVVRVLCAVNINQSECEEFIKRFKQSVVDALKVVRS

SEQ ID NO: 6213 - protein, 243 aa, Prochlorococcus marinus subsp. marinus str. CCMP1375
MRKTVIAGNWKMHMTCSSAKEYIDKFIPFSKEFPSDRHVVIAPPFTAISTLASLLQGTNIQLSSQNVHWEDTGAFTAEISPSMLLEHDVRYAIVGHSEPRKYFSESDEQINLRARSAQSNGLIPIVCVGESIEQRERGEAERVIRRQVEQGLEQTDLTKLVIAYEPIWAIGTGKTCESNEANRICGLIREWAGFSDLIIQYGGSVKPANIDEIMSMSDIDGVLVGGASLDPENFARIANYQSI

SEQ ID NO: 6214 - protein, 166 aa, Triticum aestivum
MAARAVTMLVVAAVLAGGASAQSTSGCTQTLIGMSPCLNYITGNETAPSKSCCSQLATVVSSKPECLCVALNADPAALGLGAVNKTRALGLPDQCGVKTPPLSNCASAPTTSPSSGAPAGQTPTSSGAGSKSTPTADVGSGSASLRSSAGIVAGFIVAAVYAVSAM

SEQ ID NO: 6215 - protein, 167 aa, Arabidopsis thaliana
FSVLKLSNRGEEEKGRSGIGKLRSQKGKCEWRRLSFRIPMSWAAPDDIFFSTSLAAYLDKKLLVLLRDGRKLMGLLRSFDQFANAVLEEAYERVIVGDLYCDIPLGLYIIRGENVVLIGELDVEKEELPAHMVQVPEAEIKRAQKAEKEEMLLKGTMRKRMEFLDLD

SEQ ID NO: 6216 - protein, 506 aa, Arabidopsis thaliana
MASISLLQVSVAILCFLILHYFLFKKPHGRYPRNWPVLRMLPAMLKALHRIYDYSVEILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 6217 - protein, 189 aa, Physcomitrella patens
MAARGASPGHVQELFVYEINERDRGSPVFLPFGGKKQPGTDAHVNSLGDLVPFSNKIYDGSLKTRLGITAGLCTLISHSDQKNGDRYEALYSFYFGDYGHISVQGPYITYEDSYLAITGGSGIFAGCYGQAKLHQIIFPFKLFYTFYLQGIKKLPEALCAPCVPPSPSVAPADEAKQCLPNHVAPNFTK

SEQ ID NO: 6218 - protein, 86 aa, Glycine max
MSSGIRAWSVATSVGVVEALKDQGICRWNHALRSAQHHLKNHVGSFSQANKLSSSAMSSTTLKHGKTNQSEESLRTVMYLSCWGPN

SEQ ID NO: 6219 - protein, 741 aa, Cytophaga hutchinsonii ATCC 33406
MHHLPELITDLALILVTAAITTLIFKKIKQPLVLGYIIAGLLVGPNIKLFPTISEYKNISTWAELGVIILLFSLGLEFSFKKLIKVGGASSITAVFQIVVMLFVGYFAGHLMGWSQMNCFFLGAMLSISSTTIIIRAFEELDVKNKKYASVVFGALIVEDLVAIVLMVLLTTVAVSQQFAGMEMLYSILKLIFFLILWFAGGIYFIPTFLKKSRKLMTDETMLLVALGLCLTMVILADQAGFSPALGAFIMGSILAETTEAEHVEHLIKPIKDLFGAVFFVSVGMMIDPGVLVEYAYPIGILTLVTIFGKAIASTIGALISGQPLKQSVQTGMSLAQIGEFSFIIATLGLSLKVISPFLYPIIVAVSAITTFTTPYLIKYSGSFYGLIERNASPKFLRVIENYGTDTQSIVVLSDWNIFLKSYAINMLLNIVLLIAFGLLSALYIYPFIQEHVINGFNGSVTGIVISFILTVPFLWALTMKQIAPAEYQRLWDNEKKGRSPLILLGVVRLLVGLLSVGFLLSFYLDTALATIISLIVFAVFFFLFSKRLQFLYDRMEKRFLVNFNERDEANDYKAKITPWDAHIIEFKVSPLSPVIGKTLEEMAIREAYGVNIIMIEREYVTLPLPSRTERIYPGDIISVVGSDEQLLKLKEIIACELTADEIETYTLIKNDLVLKNVIVDKDTPLLNRAIKESGIREKRALVVGVERNGERILNPPSTLYFEEGDIVWIAGGSKVIKELF

SEQ ID NO: 6220 - protein, 320 aa, Kluyveromyces lactis
MGKAVKKKYSGASSGGKEVDAEKHLTTVFKFNTDLGQHILKNPLVAQGIVDKAQIKPSDIVLEIGPGTGNLTVRILEQARKVVRRGVRSSYGSGRTKRVHGTPVEKKLEILLGDFMKTELPYFDVCISNTPYQISSPLVFKLINQPKPPRVSILMFQREFAMRLLARPGDSLYCRLSANVQMWANVTHIMKVGKNNFRPPPKVESSVVRIEIKNPRPQVDFNEWDGLLRIVFVRKNRTIAAGFKSTTDLEILEKNYKAFLATQSAVPTTSSGDSLINEVKEKIEQVLSETGLAEKRAGKCDQTDFLKLLYGFHQVGIHFA

SEQ ID NO: 6221 - protein, 319 aa, Phytophthora infestans
MDSRGEMKALDAQIDRLRRAENLTETEIYELCQKAKEILAGESNVQPVKCPVTVCGDIHGQFYDLLELFRIGGACPDTNYLFMGDYVDRGYYSLESVALLVALKVRHRERITILRGNHESRQITQVYGFYDECLRKYGNANVWKYFTDLFDHLPMTALIENRVFCMHGGLSPSIDTLDHARALDRVQEVPHEGPMCDLVWSDPDDRCGWGISPRGAGYTFGQDITEQFKRSNGLTFIARAHQLVMEGYQWTHNRGVVTIFSAPNYCYRCGNQAALMEIDEVMADRNGDKVYETCKFIQFDPAPRDSNFNEKKRTPDYFL

SEQ ID NO: 6222 - protein, 312 aa, Nicotiana langsdorffii x Nicotiana sanderae
LGDARRVLNKTSDSLEEAQLRLADIKQAAGIPEHCNDDIVEVPKRPKGDNVWRELIFSPTPAVRHILLTGVGIHFFQQASGIDAVVLYSPRIFEKAGIKTDRNKLLATVAVGFVKTIFILVATFMLDKSGRRKLLLTSVAGMVLSLMLLATGLTIIDQSEQKVIWAIALSITMVLAYVALFSIGMGPITWVYSSEIFPLRLRATGCSIGVAVNRVTSGVVSMTFLTLVKRITIGGAFFLYFGLAAAAFVFFFTLMPETQGKTLEEMEALFGTFWNWRKTARELKEAKITEKTEKNSNDNGQIQMGTAPAISS

SEQ ID NO: 6223 - protein, 665 aa, Schizosaccharomyces pombe 972h-
MTDRLKCLIWYCIDNQNYDNSIFYSERLHAIEDSNESLYLLAYSHFLNLDYNIVYDLLDRVISHVPCTYLFARTSLILGRYKQGISAVEACRSNWRSIQPNINDSISSRGHPDASCMLDVLGTMYKKAGFLKKATDCFVEAVSINPYNFSAFQNLTAIGVPLDANNVFVIPPYLTAMKGFEKSQTNATASVPEPSFLKKSKESSSSSNKFSVSESIANSYSNSSISAFTKWFDRVDASELPGSEKERHQSLKLQSQSQTSKNLLAFNDAQKADSNNRDTSLKSHFVEPRTQALRPGARLTYKLREARSSKRGESTPQSFREEDNNLMELLKLFGKGVYLLAQYKLREALNCFQSLPIEQQNTPFVLAKLGITYFELVDYEKSEEVFQKLRDLSPSRVKDMEVFSTALWHLQKSVPLSYLAHETLETNPYSPESWCILANCFSLQREHSQALKCINRAIQLDPTFEYAYTLQGHEHSANEEYEKSKTSFRKAIRVNVRHYNAWYGLGMVYLKTGRNDQADFHFQRAAEINPNNSVLITCIGMIYERCKDYKKALDFYDRACKLDEKSSLARFKKAKVLILLHDHDKALVELEQLKAIAPDEANVHFLLGKIFKQMRKKNLALKHFTIAWNLDGKATHIIKESIENLDIPEENLLTETGEIYRNLET

SEQ ID NO: 6224 - protein, 324 aa, Synechococcus sp. WH 5701
MPLPTWLPPLAIGAGAGLLSLALVREWQRRDRRFQSTATVAEAYDRWTGDRLLENLWGEHVHLGHYGNPPVARDFRAAKEEFVHELVRWSGLDHLPPGTRLLDVGCGIGGSARTLARDYGFDVLGISISPAQVERARQLTPSGLSCRFAVMDALALELEDGSVQAVWSVEAGPHMPDKQRYADELLRVLAPAGQLVVADWNRRDPADGELNGLERWVMDQLLHQWAHPEFASIPSFRRNLEASPHRRAGAVETADWSEATLPSWIDSILEGVRRPGAILSLGPAAVLQGLREAPTILLMHWAFSTGMMRFGVFRYGSSDRLVSG

SEQ ID NO: 6225 - protein, 149 aa, Phytophthora infestans
MASALPRRIVKETQRLLAEPVAGISATPYEDNLRYFQVVIAGPQTSPYENGIFKLELFLPADYPMAPPKVRFLTRIYHPNIDKLGRICLDILKDKWSPALQIRTVLLSIQALLSAPNPDDPLANDVADHWKTDEVGAVQMAAEWTRRYA

SEQ ID NO: 6226 - protein, 257 aa, Rickettsiella grylli
MRGQYIIGNWKMNGCKTSVTSLLNALRDVEKKEQSNVTMVVCPPYIFLDKTQKMLEKSPLQWGGQNMAAEPEGPYTGEISGLMLYEFGCRYVLLGHSERRQHYAETNDQIAKKFNLAVNSGLTPILCVGETLAERQANQTQVVLQTQLEKIIAHASPLLPQAIIAYEPVWAIGTGVSAEPEQAQEIHQFLRDQIRMVDSDLAQILPILYGGSVKISNANALFQMPDIDGGLIGGASLDASEFLSIYEIMTSIERHNS

SEQ ID NO: 6227 - protein, 326 aa, Methanosarcina barkeri str. fusaro
MMGDKRSRIIKALKDAQKSPVSGEELGLKLGISRTMVWKYIKSLQADGYEIESSPKRGYVLKSVPQLLYPEEIQMGLKTTLLGKEIHYFEEVTSTNSIAKEIAASEEEGTLVIAEVQKGGRGRLGREWISPHGGIWMSVILKPGIPLRHASRLTLVAGLAVANVIRNMDLDARIKWPNDVRINGKKVCGILTEAKAEVDKVDYVVLGIGINVNMDLKDIPESFRAGSTTLKAELGRHIKRVSFLQDFLFELEQQYILFKTQPFSHILNDWLALSDTIGREVKVTTPSRIIEGKAVGVTPDGALVIKKADDTKEEIIAGRCIYARSR

SEQ ID NO: 6228 - protein, 156 aa, Oryza sativa
MDVGVGGKAAKKAVGRKLGGPKKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKTAEKADKPAKASKDKAAKSPKKQARS

SEQ ID NO: 6229 - protein, 617 aa, Triticum turgidum
MASWFETYHHPSKGKGKRRILRVQTRDTREQLCAHLCLLPLLLTAGENSYPVIVMIGTRVLAHSRVDPAIRWGAAAHGFVVIAPKKREAGQETSTSERKKTKRKWRRNFCGWTSHEAKEPSTSETKKTKRKWGRNFCGWTSHEAEEPLTSETKKTKRKWGRNFCGWTSHEAEEPSTSETKKKRKNGASSSEPDKKRWFKTKIWRKKKAKNKQLATLVKEISLPNSPKARAAAGEILRIGNHNIPSRVFTYSQLSDATNSFSQENLLGEGGFGRVYKGYIPETMEVISIPSPSFLFYVSLSWHLKMLCYIQQQHLPDVNYVIAVKQLDKDGLQGNREFLVEVLMLSLLHHPNLVTLLGYCTECDQKILVYEYMPLGSLQDHLLDLTPKSQPLSWHMRMKIAVDAARGLEYLHEVANPPVVYRDLKASNILLDGNLSAKLADFGLAKLGPVGDKTHVTTRVMGTYGYCAPEYAMSGKLTKMSDIYCFGVVFLELITGRRAIDTTKPTREQILVHWAAPLFKDKKKFTKMADPKLDSKYPLKGLYHALAISSMCLQEEASSRPLISDVVTALTFLADPNYDPPDDIEPLPITVPDFDRGISLGEPEEVKEKFEGKQVEDS

SEQ ID NO: 6230 - protein, 753 aa, Triticum turgidum
MEIRRWLLRLLALLTTTILLSPSTSTSSSISTVDDLQALLSFKSLITKDPLGALSSWTINSSSNGSTHGFCSWTGVKCSSAHPGHVKVLCLQGLSLSGTVSPFLGNLSRLRVLDLFNNKLEGQIPPSLGNCFALRRLNLSFNSLSGAIPPAMGNLSKLLVMSISNNNISGTIPLLFADLATVTMFSIKSNNVHGEIPPWLGNLTALKHLNMGGNMMSGHVPPALSKLIHLQFLNLAVNNLQGLIPPVLFNMSSFELLNFGSNQLSGSLPQDIGSILTNLKSFSLFYNKFEGQIPASLSNISSLEFIVLHGNRFRGRIPSNIGQSGRLTVFEVGDNELQATESRDWDFLTSLANCSSLVLVGLQLNNLSGILPNSIAPDKLASHKLIHILVFALVGGFILLGVCIATCCYIKKSRGDAGQVQETLPEMFQRMSYAELHLATDSFSVENLVGRGSFGSVYKGTFGSGANLITAAVKVLDVQRQGATRSFISECNALKRIRHRKLVKVITVCDSLDHSGSQFKALVLEFIPNGSLDKWLHPSTEGEFQTPSLMQRLNIALDVAEALEYLHHHIDPPIVHCDVKPSNILLDDNMVAHLGDFGLAKIIRAEESSQSLTGQSSSVGIKGTIGYLAPEYGMGTEISVEGDVYSYGVLLLEMLTGRRPTDPFFNDTTNLPKYVEMACPGNLLEIMDVNIRCNQEPKATLELFAAPVAKLGLACCRGPARQRIRMSDVVRELGAIKRLIMASQNSASWSTAQ

SEQ ID NO: 6231 - protein, 232 aa, Mesorhizobium loti MAFF303099
MTTRPNKVALITGANRGIGLETGRQLAKLGFTVLLGVRDLAKGEAAAKGLEGHVEAIALDVAAPDAATTAADEVQRRFGRLDVLINNAAIHYDTGSRALRPDWTVIREAFETNVFGAWRVAAAFAPLLKAGGHGRLVNVSSEGGSLASMGAGAPAYSTSKATLNALTCVLAAELRGSGVLVNAICPGWVATDMGGAGGRPVAQGAAGIVWAATLPDDGPTGGFFRDGKKLPW

SEQ ID NO: 6232 - protein, 268 aa, Pseudomonas aeruginosa PAO1
MSELYQHRARKRFGQNFLHDAGVIHRILRAIHAREGQRLLEIGPGQGALTEGLLGSGARLDVIELDQDLIPLLKLKFGLESRFSLHQGDALKFDFASLVESGEKLRVVGNLPYNISTPLIFHLLEHAPVIEDMHFMLQKEVVERLAATPGGGDWGRLSIMVQYHCRVEHLFNVGPGAFNPPPKVDSAIVRLTPFAEPPHPARDPKLLERVVREAFNQRRKTLRNTLKPLLSVEDIEAAEVDPTLRPEQLDLAAFVRLANQLAELPGNR

SEQ ID NO: 6233 - protein, 456 aa, Polyangium cellulosum
MISISKSKQKLLPPGPRSPMALQTLQWLKNPVPFLEACGARYGEMFTLKLPTQWPVVVVQHPEAVKEVFALDSNAGHAGEANNILKPFLGKYSLLVLDGEEHMRQRKMMMPAFHGERMEAYGHAMIDAAHASIDAWPVGSPFGVHAPMQAITLQVILRTVVGMTDGPLLAELEALYPQVIDAASAPAMHFELFRKDLGPWSPWGKFKRRSARGKEIMIHEIRRAREKGTAGRTDVLAMIIDAKDENGELLTEDEIHGELMTLLVAGHETTATALCWALRWLLRDAALTRRVAEEAAEVADDPVKIAKSELLDRVVKEALRLQPIGPVVARVLKQPLTIQGRELPADVMVAPCVQLLHHRPSLYPEPTRFDPDRYATFTPKPWEFIPFGGGLRKCIGAAFSMYEMKMVLATAFSRLSMELATDDIKIIRRGVTLAPSGGLPLVIRKKSPRATKPIAA

SEQ ID NO: 6234 - protein, 589 aa, Coccidioides immitis RS
MFRSRGHLRQSLGAASESSSSTSPERVIDDDTDFFNQPNDSQSSVGVGTLRDLRVDAGQDIVLPPISRLPPELLIAIFAKLNSPTDMLNCMMVCQRWATNCVAILWHRPSCNTWENLKRVAGAITTQGSYFPYYDMVKRLNLSSLSTRVNDGTIISFAQCKRIERLTLTNCSMLTDTGVSDLVNGNGHLQALDVSELKSLTDHTLFIVARNCPRLQGLNITGCVKITDDALVALAENCRQLKRLKLNGVMQVTDRAIRAFADNCPSILEIDLHGCRLITNFTVTNLLCTLRFLRELRLAHCADITEQAFLDLPEGIIFDSLRILDLTACENVRDDAVERIINSSPRLRNLVLAKCRFITDRSVQAICKLGRNIHYVHLGHCSNITDNAVIQLVKSCNRIRYIDLACCNRLTDASVQQLATLPKLRRIGLVKCQAITDRSILALAKPRIPQHPLVSSLERVHLSYCVNLSTYGIHQLLNHCPRLTHLSLTGVHAFLREELTAFCREAPPEFTPQQREVFCVFSGAGVSQLRDFLNQAAIAYHRELEEGTMFNDTDELDEDEGQVTGLMNATGLNDDNDGTPDGGTAPVQS

SEQ ID NO: 6235 - protein, 341 aa, Pisum sativum
MDHAGDAMRTDLMTITRYVLNEQSKRPESRGDFTILLSHIVLGCKFVCSAVNKAGLAKLIGLAGETNIQGEEQKKLDVLSNEVFVKALTSSGRTCILVSEEDEEATFIEPSLRGKYCVVFDPLDGSFNIDCGVSIGTIFGIYMVKDFETATLEDVLQPGKNMVAAGYCMYGSSCTLVLSTGSGVNGFTLDPSLGEYILTHPDIKIPNKGKIYSVNEGNAKNWDGPTTKYVEKCKFPTDGSSPKSLRYIESMVANVHRTLLYGGIFLYPGDKKSPNGKLRVLYEVFPMSFLMEQAGGQAFTGKQRALDLIPTKIHERSPVFLGSYDDVEDIKALYAAQEKTA

SEQ ID NO: 6236 - protein, 473 aa, Debaryomyces hansenii CBS767
MASKLSKLEAEQMAIRRQSGTMNRGRSHSPSKSGHNSRSSLILNDEFNRDLKWSITNHDPLERLVQKDIGEQNENKDDVNELWINEVSEEEHISDNEDNEKFHYDDTGNILPNYACQDDKINEISSILENSNLHDRAVTKRLEELTANERAFANAKNIGSNVDKDFLDKLKNDKHELTGNGLDLSKSEQDAASRKQKLENYSIYRKKIIDQENDNLKPNESNEDESSSSSDRPEESNEKDFMIPYTSAVEDKLDSEFASKLNETIKEGEIDSNKSNSRAIQVITRGNFFQLINPRVKPKIFLVCMDFSPESIFALEWCLGTVLVDGSVLFIVCVIEENDNNHHLKGNTLNESTRENQRLNTLNKAKQQVLNLLKLTKLQIHIVIEIIHHPIPRHLILEIIENLQPTLAVVGSKGQSAIKGVLLGSLSNYLVTKLTVPVMVVREKLKKINRFKTGSSVFSNNIKPLTLSEARVD

SEQ ID NO: 6237 - protein, 174 aa, Triticum aestivum
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 6238 - protein, 1261 aa, Schizosaccharomyces pombe 972h-
MVYTKAWFLQNIARQTLGKNVAVHRPPLKLGNMTNWIQQQQAQTNLSLSNTKAPGSLDERLFLTEDDIIFHDRSIQLGYFDPSLSERKQSPPGKSLHRFVDNLNPNSSHFSASLLPASLSSLCDSTCGDVDDEQQFNSLATSPLSTETQSEVSDPLLDTLTPNSLESSFASISLNSFTSANEFIQFLKRLASSKLSIHTFDLYKLVRNSPELLTLEAYNIVLQCMSTDDYFLSSSKNIQKIIKVYVDMLNSFISPNVTTFETVIFALCRRAKFVHQKIESLSKRTIYAHPSIAKEIQPELLDLQSEMPLQTAVFMFTSSLINHDLIYSPQFYAILIESVSLYGTQSQLDSLLECVPLGTIEANGHPDLLPALIRALGRAKRLNSCFQLLERYNLSDPTSDTSMTNVRSWEGLMEAYFDTDHHVEASALMKSFFRKADSNQVIPSSILDCFLRRLAQLGHYKESAEWLGMAIEKISTYKASPSTLSSILEAACLNNNDKFAIAFVRKYTLSRFSDCHAVLLRYLDLLARSGNVDLLHLHAYPVICSVSSHTNFTFSNVYKAFIENGKIDVALRLLRKHIDPKVSLGNNTAPSSNSVALQLSILNGFWEVLTEELQKDVHVLLSLVSTLENQVNFPQVDFTTPLLRHITGYLVSRRLEPELISPRVFGFLLEYAAFNVVQTEGTFTSKVILTDLLKCYSNGTYKASFKNVHVVLRSFTYLKEDEMLVASVRDDIVSEAVVGFSTDNNGQKILADISQVCYCLDDLECIDQSINSLVSKMLTSASPEQVDVNILFFQFGKLIETNKFLHPEVYPTLISVLSKNKRFDAVQRVFEHSKHLYRKISTKSLEKANWFMALILDAMILSSSFARQFKSSNLFCDNMKMLGYIPRASTFAHLINNSTRRGDTDDATTALNIFEETKRHNVKPSVFLYNAVLSKLGRARRTTECWKLFQEMKESGLLPTSVTYGTVINAACRIGDESLAEKLFAEMENQPNYQPRVAPYNTMIQFEVQTMFNREKALFYYNRLCATDIEPSSHTYKLLMDAYGTLKPVNVGSVKAVLELMERTDVPILSMHYAAYIHILGNVVSDVQAATSCYMNALAKHDAGEIQLDANLFQSQIESLIANDRIVEGIQIVSDMKRYNVSLNAYIVNALIKGFTKVGMISKARYYFDLLECEGMSGKEPSTYENMVRAYLSVNDGRKAMEIVEQLKRKRYPLPVVNRISSLVNSHMGQKPKRRSLNTSHSSLASLGNASTQHSINSSIN

SEQ ID NO: 6239 - protein, 379 aa, Triticum aestivum
  misc_feature (210)..(210): Xaa can be any naturally occurring amino acid
  misc_feature (260)..(260): Xaa can be any naturally occurring amino acid
  misc_feature (269)..(269): Xaa can be any naturally occurring amino acid
  unsure (1)..(379): unsure at all Xaa locations
MASALGAQVAAVAPIGSDGRHYRSCSSLKGNNSRNKSWTGKLAWENKTLQPRHTKKVFCMSVQQASKSKCKVAIKPLELENTKEPPLNLYKPKGPYTASIVSVERIVGPKAPGETCHIVIDHGGNVPYWEGQSYGVIPPGENPKKPGAPNTVRLYSIASTRYGDSFDGRTASLCVRRAVYYDPETGKEDPSKKGICSNFLCDSKPGDKIXITGPSGKIMLLPEDDPNATHIMIGTGTGVAPFRGYLRRMFMEDVPSFKFXGLAWLFLGXVANTDSLLYDQEFPTYLQQYPENFRYDKALSREQKNKSGGKMYVQDKIEEYSDEIFKLLDDGAHIYFCGLKGMMPGIQDTLKRVAEQRGESWHQKLSQLKKNKQWHVEVY

SEQ ID NO: 6240 - protein, 143 aa, Salmonella enterica
FMPKPMFGDNGSGMHCHMSLAKNGTNLFSGDKYAGLSEQALHYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 6241 - protein, 958 aa, Pseudomonas aeruginosa UCBPP-PA14
MSQTPSLAQLQPADAFLRRHLGPDPAEQQAMLDFLGVSTRAELIVQTVPPAIRLNRPLELPAALDEQAALARLRGYAGLNQRWTSLIGMGYYGTVTPPVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLVLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLESKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPCGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSAAPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 6242 - protein, 496 aa, Cucurbita maxima
MESTWAVAAVVTAVVAVATVFSVLKWAAKSLNEWIYEAKLGDRRLALPPGDLGWPLIGNMLGFLRAFKSKNPETFIDGYVSRYGKTGVYKVHLFGNPSVVVTTPETCRKVLTDDEAFQPGWPRAAVELIGEKSFIQMPQEEHKRLRRLTSAPVNGFEALSNYIPYIEKNVLESLEKWSKMGPIEFLTQLRKLTFTVIMYIFLSSESEPVMEMLEKEYTRLNYGVRDMRINLPGFAYHKALKARKNLVAALKGIVTERRRQKLDKWAPKRKDMMDQLIDIVDENGRKLDDEEIIDILIMYLNAGHESSGHTMMWATILLNQHPEVLKKAREEQEAIVRNRPAGQTGLTLKECRDMEYLSKVVDETLRYVSFSLVVFREAQMDVNLNGYLIPKGWKVLAWFRSIHYDSEVYPDPKKFEPSRWDGFVPKAGEFLPFGAGSRLCPGNDLAKLEICIFVHYFLLNYNLEWLTPDCEILYLPHSRPKDNCMAKITKKSSVAA

SEQ ID NO: 6243 - protein, 1035 aa, Zea mays
MAPSTAAASTLLPVLLLIATATQCTAADSFSSQDAAALLNLSAAVADPSGYLSTHWTPDTAVCSWPRVSCDATDTRVISLDLSGLNLSGPIPAAALSSFPYLQSLNLSNNILNSTAFPDEIIASLKSLRVLDLYNNNLTGSLPAALPNLTDLVHVHLGGNFFSGSIPRSYGQWSRIRYLALSGNELTGEIPEELGNLTTLRELYLGYYNNFTGGIPPELGRLRALVRLDMANCGISEEIPPELANLTSLDTLFLQINALSGRLPTEIGAMGSLKSLDLSNNLFVGEIPASFASLKNLTLLNLFRNRLAGEIPEFIGDLPNLEVLQLWENNFTGGIPTNLGVAATRLRIVDVSTNKLTGVLPSELCAGQRLETFIALGNSLFGDVPDGLAGCPSLTRIRLGENFLNGTIPAKLFTLPNLTQVELHNNLLSGELRLDGGKVSSSIGELSLFNNRLTGQVPTGIGGLLGLQKLLLAGNMLSGELPPEVGKLQQLSKADLSGNLLSGAVPPAIGRCRLLTFLDISSNKLSGSIPPELGSLRILNYLNVSHNALQGEIPPAIAGMQSLTAVDFSYNNLSGEVPSTGQFGYFNATSFAGNAGLCGAFLSPCRSVGVATSALGSLSSTSKLLLVLGLLALSVVFAGAAVLKARSLKRSAEARAWRLTAFQRLDFAVDDVLDCLKEENVIGKGGSGIVYKGAMPGGAVVAVKRLPAIGRAGAAHDDYGFSAEIQTLGRIRHRHIVRLLGFAANRETNLLVYEYMPNGSLGEVLHGKKGGHLQWATRFKIAVEAAKGLCYLHHDCSPPILHRDVKSNNILLDADFEAHVADFGLAKFLRGNAGGSECMSAIAGSYGYIAPAFRRVCRFNGSSLGIVGCDLMWPRFLCPPSPEYAYTLKVDEKSDVYSFGVVLLELIAGRKPVGEFGDGVDIVHWVRTVTGSSKEGVMKIADPRLSTVPLYELTHVFYVAMLCVAEQSVERPTMREVVQILADMPGSTSTTSIDVPLVIEPKEEDGGPEKKKKKQQQQQQEGPPDSPPQQDLLSI

SEQ ID NO: 6244 - protein, 319 aa, Ustilago maydis 521
MSSAAKKEAILRQFRQLTNATPQDANRILKAHGYRIEPATDAFFNNEQAQINASISSSTLDRKSEREVKERLNALFDRFRDAGADSDEEDDEASQPEDRDLISIGGALKMCEALEVSPEDVVFLPLSYYLKSASMGTFTREGYINGWKMLDLSDTIDKQKKTLEKLRQELLDNKPLRLERIAQEKSNPATASGANKGLYEKVYEYTYAFARREGQKSLALENALAFWDLVLPASPTFQRAGSQGTFTQAQLDLWKRFLSEQTRGRAVSKDTWMQFLDFTKEINSDFSNHDFDAAWPSIIDDFVLWVRDNMPASDGMDTS

SEQ ID NO: 6245 - protein, 607 aa, Pseudomonas fluorescens Pf-5
MPHEGNLLQAAVVFLCAAVLIVPLAKRLQLGAVLGYLLAGVLIGPSVLGLVGNPQSVSHISELGVVLLLFIIGLELSPKRLWVMRKAVFGVGLAQVLLTGMLIGVVALFLFGQSLNSAIVLGLGLALSSTALGLQSLAERKELNSPHGRMAFAILLFQDIAAIPLIAMVPVLAGGDHHTSSAEDLRHGLQVLGSIAVVVVGGRYLLRPVFRIVAKTRLPEVSTATALLVVIGTAWLMDLVGVSMALGAFLAGLLLADSEYRHELEAQIEPFKGLLLGLFFISVGMGANISLLLSAPIAVLGLTLLLIALKLPLLFVVGRLAGGLGRESAVRLGVVLAAGGEFAFVVFKIGRDQGLFEPRLYDLLVLTITLSMALTPLLLLACTRWLKPKAKPVEMPAEYRRIDSDGPRVVIAGMGRMGQIVARILRAQKVPFVALDTSVETIELIRSFGGMPVFYGDPLRPEILSAAKVGEAEYFVIATDDPETNIKTAEQVSRLYPHLKIIARARNRQHVHRLVDLGAQAVRETYYSSLEMSRRTLVGLGLSQAQADSRIQRFTQHDEQLLAAQHAVYDDAAKVLQSAQEARAELARLFEADEQDEQIESPLPPMR

SEQ ID NO: 6246 - protein, 534 aa, Streptomyces lividans
MAAPNSHRAEDWWRDAVIYQVYPRSFADGDGDGTGDLAGVRARLPYLAELGVDAVWFTPWYVSPLVDGGYDVADYRTIDPPFGTLGEAEKLIAEARELGIRTIVDIVPNHVSDRHAWFRAALEAGPGSAERERFHFRPGRGADGELPPNDWPSQFSGRTWTRVPDGEWYLHLFTPEQPDLNWAHPEVRREHEEVLRFWFERGVAGVRIDSAALLAKDPALADFVEGVDPHPYIDQDELHDIYRSWRKVADEYGGVFVGEVWLPDAERFARYLRPDELHTAFNFNFLSCPWEADRLRRTIDDTLAEHAPVGAPATWVLCNHDVTRTVTRYGRADTGFDFAKKAFGTPTDLVLGTRRARAAALLTLALPGSVYLYQGEELGLPEADIPRDRIQDPMHFRSGGVDPGRDGCRVPLPWAADAPYCGFGSETEPWLPQPEGWAAYAADRQGADPESMLSLYRRALGLRRSTAGFGDGGLDWLPAPDGVLAFRRAGGPVCVVNLSAAPVELPAHSAVLLVSGPLDEAGRLPADTAVWLRA

SEQ ID NO: 6247 - protein, 339 aa, Campylobacter coli RM2228
MKFVSIEQAIKDLQEGKMLVMVDAEDRENEGDLIFPAQFSTKEKVNFMIKEARGVVCVALAEELARKFELPLMVPKNTSNHETAFTITVDAKDATTGVSAYERDMTIKIFADDNAKASDFVRPGHINPLIAKKGGVLERTGHTEGTVDLCHLAGLKQACVICEIVKDDGDMARRSDLEEFCTKHNLNMIAVSDIIEYRLKNESLIKLQEKSDAILAGFKAQKFIFTDHNNAQHIAFAFKEIQKCENVKFHISGSDFELLTSDKFSKLLDQIRFLSENGGVIVFMQGEKSSVTQFKNYGIGAQILRYFGIEEIKLMSQSCDKDYIGLKGFGLNLKICNFN

SEQ ID NO: 6248 - protein, 458 aa, Bacillus anthracis str. 'Ames Ancestor'
MSTKMTPPVEKNEFIDVVFEDLTHDGAGVAKVKGYPIFVKNGLPGEEAQIKIVKVKKNFAFGRLMKLHTESPYRKDAECPVYNQCGGCQLQHLTYEGQLQAKEKQVRDVMQRIGGLGDVPVHPVLGMKNPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQLVDMFPHTTHVECVAWLKLV

SEQ ID NO: 6249 - protein, 477 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGIARPTFSEIIIRLDKIYAQCMKQGTWKDSLKIWK

SEQ ID NO: 6250 - protein, 182 aa, Lycopersicon esculentum
MRDDDLPISTPTAPSSSFTTSKKETSYFAIFGRGRYKFWAFAAISLLALWSMFTGTVTLRWSAGNLNAISDDIDIPLPEDLDVLEMEEREKLVKHMWDVYTNSRGIKLLKFWQEAFEAAYEELASDVPGVPEDALSEIAKMSVRYIPIESPPLHSSVYVFVNCVPNTEPKYFGSVRFFNGPV

SEQ ID NO: 6251 - protein, 223 aa, Pseudomonas syringae pv. phaseolicola 1448A
MTQDQLKQAVAQAAVDFILPKLDDKSIVGVGTGSTANCFIDALAKHKAAFDGAVASSEATAARLKGHGIPVYELNTVSDLEFYVDGADESDEHLNLIKGGGAALTREKIVAAVAKTFICIADGSKLVPVLGAFPLPVEVIPMARSHVARQLVKLGGDPVYREGVLTDNGNIIIDVHNMSITNPVELEAQINAIVGVVTNGLFAARPADLLLLGTTEGVKTLTR

SEQ ID NO: 6252 - protein, 472 aa, Rhodococcus sp. RHA1
MNTVHEPPKSTGLQQAMKPRQLVMMSLGGAIGAGLFVGSGAGIAVAGPAVLVSFLIAGFLVVLVMRMMGEMVAADPDSGAFSVHAENAMGPVAGRTIGWLYWVQVVIVVAAEATAAAAITAASIPAVPQWAAALAYMSVLTAVNLAGVSRFGEFEFWFAALKIVAIVAFLAVGSAMILGWIPSFDAPGLSNLTGHGGFAPNGVTGIAAGLLIVVFAFGGTEVMAIAAAETSEPRRNVSRAVRSIVWRILVFYVGSVLIMVTVLPWTADELATGPFVAVLNAAHVPGAGAVMTVVVVIALLSSLNAMLFSGSRMIYSLSERGAAAKVFGRVSGNGVPRVAVLASVTFGFVTVVLNYLAPDRVLPLLLNAVGSTILVLWTFVTVSQIVLRRRAERSGRTDLPLKMWGFPYLSYVALALLAAVAVLALFDDAAGNQLFATLTFTCAITVACWVLGRRQRGAAADSTPEKTPETVG

SEQ ID NO: 6253 - protein, 594 aa, Prochlorococcus marinus subsp. marinus str. CCMP1375
MTTIDLKRRTKIVATIGPATESPEKITELIKAGATTFRLNFSHGDHEEHAKRIKTIRSVASDLGVNIGILQDLQGPKIRLGRFKEGPVNLKTGDVFALTSENKDCNQEIANVTYENLVNEVEKGKRILLDDGRVEMIVENVDKKNKSLICKVTVGGILSNNKGVNFPDVQLSINALTEKDKIDLSFGLKQGVDWVALSFVRNPADIQEIKELIRRHGYTTPIVAKIEKFEAIDQIDSILSLCDGVMVARGDLGVEMDAEEVPLLQKELIKKANSLGIPIITATQMLDSMASSPRPTRAEVSDVANAILDGTDAVMLSNETAVGDYPIEAVETMAKIARRIERDYPQRALESHLPSTIPNAISAAVSTIARQLNAAAILPLTKSGATAHNVSKFRPATPILAITSEISVARRLQLVWGVSPLLIDAQKSTSKTFGIAMEQAMDMKLLKPGDQVVETAGTLTGISGSTDLIKVGIVSKIVASGKTKPIVKEGTISGKLRVINKATDLSDLKSGEILVLAENVQYNLDTKTHISAMIFEGEYSLINTNNQIEDNNIIPAIYNVEGACTKFKNGEIVTLDLKDGNIIKGLAQDLKTYN

SEQ ID NO: 6254 - protein, 175 aa, Triticum aestivum
MAPTVMASLATSVAPFQGLKSTAGLPVSRRSNGASLGSVSNGGRIRCMQVWPIEGFKKFETLSYLPPISTEALLKQVDYLIRSKWVPCLEFSKVGFIFREHNASPGYYDGRYWTMWKLPMFGCTDATQVINEVEEVKKEYPDAYVRIIGFDNMRQVQCVRFIAFKPPGCEESGKA

SEQ ID NO: 6255 - protein, 254 aa, Arabidopsis thaliana
MASSTISLQSISMTTLNNLSYSKQFHRSSLLGFSKSFQNFGISSNGPGSSSPTSFTPKKKLTPTRALSQNLGNTENPRPSKVQELSVYEINDLDRHSPKILKNAFSFRFGLGDLVPFTNKLYTGDLKKRVGITAGLCVVIEHVPEKNGDRFEATYSFYFGDYGHLSVQGPYLTYEDSFLAITGGAGIFEGAYGQVKLQQLVYPTKLFYTFYLKGLANDLPLELIGTPVPPSKDVEPAPEAKALKPSGVVSNFTN

SEQ ID NO: 6256 - protein, 441 aa, Streptomyces coelicolor A3(2)
MNAEELGLPRSRQANERLHALVPGGAHTYAKGDDQYPENLAPVISHGRGAHVWDVDGNRYVEYGSGLRSVSLGHAHPRVTEAVRRELDRGSNFVRPSIVEVDAAERFLATVPTAEMVKFAKNGSDATTAAVRLARAATGRPRVAVCADHPFFSVDDWFIGTTPMSAGIPAATNELTVAFPYGDLAATEDLLARHEGEVACLILEPATHTEPPPGYLAGLRELADRHGCVLVFDEMITGFRWSEAGAQGLYGVVPDLSTFGKALGNGFAVAALAGRRELMELGGLRHSGDRVFLLSTTHGAETHALAAAMAVQGTYVEEGVTARLHALGDRLAAGVREAAASMGVGDHVVVRGRASNLVFATLDENGQPSQRYRTLFLRQLLAGGVLAPSFVVSSALGDADLDHTVDVVAEACAVYRKALDAADPTPWMAGRPVKPVFRRLV

SEQ ID NO: 6257 - protein, 254 aa, Arabidopsis thaliana
MEKKREGVIEGMSRIVSDPYYFLHFMAFFSYLPIRSSAAPYTSHRLFDREIQAFLAFLMFSAIKMVREETWEAFVADSLLYAKIFLIAVSLIMDYRVAVWVSIIFSGIYLLAQQPAFCVKLGTAKKLTPMQLEDLLSDGNTTKYWLIEFFACSSSKCVRSSRCFPELSITYSNNLLSFGTVDLGLFPNTAAKFGISLAGGMSQLPTYILFEKGVEVSRFPDFYVDAAPSLPITKKLLCQHFELDRLLLDYINGT

SEQ ID NO: 6258 - protein, 1137 aa, Burkholderia vietnamiensis G4
MMKREDSLDDVRRAQFASVAPAGTARARRARRREPALSTDDPLWYKDAIIYQVHVKSFYDSNNDGIGDFPGLIMKLDYIAELGVDTIWLLPFYPSPRRDDGYDIADYRGVHPDYGTLADVRRFIREAHARGIRVIAELVINHTSDQHPWFQRARRAKPGSTHRDYYVWSDTDTKYAGTRIIFLDTETSNWTHDPVAGQYYWHRFYSHQPDLNFDNPAVVREVIQVMRFWLDLGIDGLRLDAVPYLVEREGTNNENLPETHAILKRIRATIDAEYPNRMLLAEANQWPEDVQEYFGNEDECHMAFHFPLMPRIYMSIASEDRFPILDIMRQTPALAPSNQWAVFLRNHDELTLEMVTDSERDLLWQTYASDRRARLNLGIRRRLAPLMERDRRRIELINSLLLSMPGTPVIYYGDELGMGDNIHLGDRDGVRTPMQWSSDRNGGFSRADPELLVLPPVMGSLYGYDAINVEAQTRDPHSLLNWTRRILATRRATQVFGRGTIRFLRPENRKVLAYLRELDGHEPVLCVANLSRASQAVELDLSEFAGRVPIEMTSDSPFPPIGQLTYLLTFPPYGFLWFVLSEHGREPSWRQPQAEPLPEYVTIVMRRGEQRPDVGQLHTLAHDALSSWLTRRRWFASKDRKIGDARLNVVTPMPDEPFQYAEAWVTTHGGDVERYVVPLAAAWGGETSNPLFAQLALARVRRGHTVGYLTDAFALPAFGRGMLRMLRDGATVPTSDGGRLEFLPEQALAALDPGDDAEVRWLAAEQSNSSLVIGDAIVLKLVRKVAHGVHPEAEMSRYLTRIGYANTATLAGEVVHVDPDGTPHTVAILQRYVDNQGDAWTRSFDFLKRAIDELALPAVGDGEPAERDGEPDALLGYAAFAGVVGTRLGELHVALAQPSDDAAFAPERATPEHVDGWCVDAIASFGHALDVLATRLDALDPSARDAAETLLASRDAAVQALGALVPRTLDAVCTRIHGDFHLGQVLDVQGDALLIDFEGEPARALERRRAKSHPLRDVAGLLRSLSYVSATAQFAIEKVPPQAAGRKRALFDRFGQAAADRFVECYRAAAEHAPERFVDPRYADRLLALFLIDKASYELCYEAANRPDWLGVPVGGLAALVERLLDAHAASDHGGTR

SEQ ID NO: 6259 - protein, 601 aa, Salmonella enterica subsp. enterica serovar Typhi
MEGADLLTAGVLFLFAAVAAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAVVGGIGLAMSSTAMALQLMREKGMNRSESGQLGFSVLLFQDLAVIPALALVPLLAGSADEHFDWFKVAMKVLAFAVMLIGGRYLLRPVFRFIAASGVREVFTAATLLLVLSAALFMDALGLSMALGTFIAGVLLAESEYRHELENAIDPFKGLLLGLFFISVGMSLNLGVLYTHLLWVAASVVILVVIKMLTLYLLARLYGIRSSERMQFASVLSQGGEFAFVLFSTASSQRLFQGDQMALLLVTVTLSMMTTPLLMKGIDKWLSRRLNGPEENDEKPWVEDDKPQVVVVGFGRFGQVIARLLMANKMRITVLERDIGAVNLMRKYGYKVYYGDATQVELLRSAGAEAAESIVITCNEPEDTMKLVALCQQHFPHLHILARARGRVEAHELLQAGVTQFSRETFSSALELGRKTLVSLGMHPHQAQRAQLHFRRLDMRMLRELIPEHSDMVQISRAREARRELEEIFQREMQQERRQLDGWDEFE

SEQ ID NO: 6260 - protein, 446 aa, Enterococcus faecalis V583
MTRKAKTAEEIKHIAEEENVRFLRLMFTDIMGTIKNVEVPVSQLDKVLDNKMMFDGSSIEGFVRIEESDMYLYPDLSTWMIFPWESDHGKVARLICDIYNPDGTPFAGDPRGNLKRALADMKELGFTSFNLGPEPEFFLFKLDENGEITTDLNDKGGYFDFAPTDLGENCRRDIVLELESLGFEVEASHHEVAPGQHEIDFKYADVVDACDNIQTFKLVVKTIARKHGLHATFMPKPLFGINGSGMHCNMSLFNEEGNVFYDESGEMGLSQTAYHFLGGLLKHARAYTAVCNPTVNSYKRLVPGYEAPVYVAWSGRNRSPLIRVPESRGLSTRLELRSVDPSANPYLTMAVLLQAGLDGIRNELTPPPAVDRNIYVMNEEERQHAQIEDLPSTLHNAIKELRKDQVMIDALGRHIFANFVEAKRMEWAAFRQTVSEWEREQYLELY

SEQ ID NO: 6261 - protein, 622 aa, Populus tomentosa
MEAGKKNSLFCCVASLICLWTTAYGELTAAGVNYEVEALMGFKNSLHDPHNILNWDEHAVDPCSWAMVTCSPDNFVTSLGAPSQRLSGTLSPYIGNLTNLQSLLLQDNNISGHIPSELGRLPKLKTIDLSSNNFSGQIPSALSNLNNLQYLRLNNNSLDGAIPASLVNMTQLTFLDLSYNDLSTPVPPVHAKTFNIVGNPQICGTEQGCAGTTPVPQSVALNNSQNSQPSGNNKSHKIALAFGSSLGCICLLVLGFGFILWWRQRHNQQIFFDVNEQHNEELSLGNLRSFQFKELQVATNNFSSKNLIGKGGFGNVYKGYLQDGTVVAVKRLKDGNAIGGVIQFQTEVEMISLAVHRNLLRLHGFCMTTTERLLVYPYMSNGSVATRLKAKPALDWGTRKRIALGAARGLLYLHEQCDPKIIHRDVKAANILLDDYCEAVVGDFGLAKLLDHRDSHVTTAVRGTVGHIAPEYLSTGQSSEKTDVFGFGILLLELISGLRALEFGKSTNQKGALLDWVKKIHLEKKLELLVDKDLKNNYDRIELEEIVQVALLCTQYLPSHRPKMSEVVRMLEGDGLAEKWEASQRAEESRSRANEFSSSERYSDLTDDSSLLVQAMELSGPR

SEQ ID NO: 6262 - protein, 224 aa, Triticum aestivum
  misc_feature (186)..(186): Xaa can be any naturally occurring amino acid
  misc_feature (199)..(200): Xaa can be any naturally occurring amino acid
  misc_feature (204)..(204): Xaa can be any naturally occurring amino acid
  unsure (1)..(224): unsure at all Xaa locations
TLARAAAAAVMDGGGGVGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFSKELRLDTKVFYFDIGENKRGRYLKVSEASVNRNRSTIIVPAGSSGEEGWEAFRNVLLEIHDEASRLYVLSNHXSQQHLGPPERLSXXSDDXGAGFIAGHGHPSGCCPRGRW

SEQ ID NO: 6263 - protein, 486 aa, Alkaliphilus metalliredigenes QYMF
MKKYNQLSFELSKPGRIAYQLPACDVPEVNLSEILPAEMIRDQDVELPELSQGDVMRHYTLLSNKNFGVDTGFYPLGSCTMKYNPKVNEDIARLAGFSHIHPYQPEETVQGALALTYELDQMLSEITGMERVTLQPVAGSHGEMTGLMIIKAYHESRGDHKRKKIICPDSAHGTNPASAAVAGFDIIEVKSNDQGEVDVESLKAVLSDEVAGLMLTNPNTLGLFETNIKEMAQLVHEAGGLLYYDGANTNAIMGKTRPGDMGFDVVHLNLHKTFATPHGGGGPGSGPVGVRKDLVPFLPTPVVEKKEDRYILDYDRPQSIGKVSTFYGNFGVTVKAFAYILSMGGDGLKKASEMAVLNANYLMHLLKDHYEVAVNRVCKHEFVLAGLKKEIAEMSTLNIAKRLLDYGYHPPTVYFPLIVREAMMFEPTETESKETLDQFADALIKIAQEAKDNPELVSSAPQHTSVGRLDEAKAARSPVVKWQRSQ

SEQ ID NO: 6264 - protein, 459 aa, Staphylococcus epidermidis RP62A
MADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 6265 - protein, 447 aa, Alkaliphilus metalliredigenes QYMF
MFPYIPNTVEDEKKMLAAIGLPSIESLFEDIPENVRLNRELNLGKSLSEFELVKYMKSLSNQNKSIEDLTCFMGAGAYDHLIPSTVDHVISRSEFYTAYTPYQAEISQGTLQVIFEYQTMIANLTGMDVANASLYDGSSAIAEAAAMAVDATRRMEVIVSSTVHPESKRVLNTYANFKNIKIVEIESKDGVTDVEQLKNAISKETAAVILQNPNFLGIIEKVEEVEKAIHEQKGLLIMSVDPISLGVLKSPGDLGADIAVGEGQALGNTLSFGGPYLGFMATTKKLMRKMPGRIVGETTDVNGERGFVLTLQTREQHIRREKATSNICSNQALNALAAAVYLTTLGKAGLKEVALQSTQKAHYALKEITKSGKYQLAFNQPFFKEFAVKTDVTAEVVQSGLLEKDILGGYHLEKFDPKLKNMLLFAVTEKRTKGEIEQLARVLGGIK

SEQ ID NO: 6266 - protein, 369 aa, Azoarcus sp. EbN1
MGRPGAGTSALAPITEIVEDIRAGRMVVLVDEEDRENEGDLVLAAEHVTPEAINFMAKFGRGLICLTLTEARCRQLDLHLMVRDNRSPHGTAFTTSIEAAEGVTTGISAHDRSRTVQAAVARHAKPADIVQPGHIFPLMAQKGGVLIRAGHTEAGCDLAALAGLEPASVICEILKDDGTMARLPDLVEFAKEHGLKIGAIRDLIEYRSANEHLVERVAEKDVETPYGRFRLAAFEDKTSGEVHFALSHGEIRPERETLVRVHEPISVVDFIDPESGRHTFPVNQAMARLAEAEQGVIVLLYRPQSGSELLAGLRGDTSLAAKWDARLFGVGAQILRDLKVGKMRLLASPRKIPSMAGFGLEITGFVERP

SEQ ID NO: 6267 - protein, 171 aa, Prunus avium
YFQFVQQWPPTTCRVQKKCSKPRPLQNFTIHGLWPSNYSNPTMPSNCNGSRFKKELLSPRMQSKLKISWPNVVSSNDTKFWESEWNKHGTCSEQTLNQVQYFEISHEMWNSFNITDILKNASIVPHPTQTWKYSDIVSAIQSKTQRTPLLRCKTDPAHPNANTQLLHEVVF

SEQ ID NO: 6268 - protein, 167 aa, Prunus avium
YFQFVQQWPPTNCRVRIKRPCSSPRPLQYFTIHGLWPSNYSNPRMPSNCTGPQFKRILSPQLRSKLQTSWPDVESGNDTKFWESEWNKHGTCSKETLNQMQYFERSYAMWMSYNITEILKNASIVPHPTQTWKYSDIVAPIKAATKRTPLLRCKQDKNTVLLHEVVF

SEQ ID NO: 6269 - protein, 318 aa, Arabidopsis thaliana
MMTSMEGMVEKGVLDDIIRRLLEGKGGKQVQLSESEIRQLCFNARQIFLSQPNLLDLHAPIRICGDIHGQYQDLLRLFEYGGYPPSANYLFLGDYVDRGKQSLETICLLLAYKIRYPSKIYLLRGNHEDAKINRIYGFYDECKRRFNVRLWKVFTDCFNCLPVAALIDEKILCMHGGLSPDLDNLNQIREIQRPIEIPDSGLLCDLLWSDPDQKIEGWADSDRGISCTFGADKVAEFLDKNDLDLICRGHQVVEDEYEFFAKRRLVTIFSAPNYGGEFDNAGALLSVDESLVCSFEIMKPAPASSSHPLKKVPKMGKS

SEQ ID NO: 6270 - protein, 498 aa, Sinorhizobium meliloti 1021
MTAVFARTAFHDALKNLSDRQLLRELAYVGGRWVAGRDGTCLEVSDPASGAALAFVASLDAAQTSEAIDAAQKAFRSWHNMLPQARAAILRKWHDLMLEAREDLALLMTLEQGKPLAESRGEIDYAASFIEWYAEEGKRLNAESVTSHLAGAEMIVRREALGVVGIVTPWNFPSAMITRKAAAALAAGCTVVAHPSSETPLSALALAELGERAGLPAGVFNVVTGKAATIVGRMCEDARVRAMSFTGSTEIGRLIASQCAPTMKRLVMELGGHAPLIVFADANVEKAADIAIAAKFATSGQDCLAANRIYVERPALKAFQEAFAARIAGLKVGSGMEPDTDIGPLMHERAVAKVEEQVADALKLGARLAVGGKRHAAGPLFFQPTLLTDVPDDALIMREETFGPVAAVTAFDSEEEVVARANDTEYGLVAYVVTENGARQMRLARALEYGMVAVNRVKITGGPIPFGGWKQSGLGREGSRHGMEAFTELKYLCIDTAA

SEQ ID NO: 6271 - protein, 94 aa, Oryza sativa (japonica cultivar-group)
MGVTKEDVEAAITSSLSPSSLVVTDTSGGCGASYEIEVVSEKFEGKRLLERHRMVNTALAPHMAEIHAVSIKKALTPAQAQPQPEPAADKAPQA

SEQ ID NO: 6272 - protein, 159 aa, Arabidopsis thaliana
MKDGDSLPISTSSVAATTVTGKKETGYSALFSKGRYKFWALAAILLLAFWSMLTGTVNLRWSAGNINHFTDDLVFPIHEDLDVLEMEEREKVVKHMWDVYNNGRRIRLPRFWQEAFEAAYEELTSDVPDVVEAAISEIARMSIRSIVIDPPPLHSTVRV

SEQ ID NO: 6273 - protein, 958 aa, Zea mays
MEETGNINSIATDGQQIAQMTQNESITIGPVIPHTSSLSDGANAEGDANMVVDKDGPVVIVPKVGMSFASENDAYEMYNTYAGIVGFSIRKSVIKRRADKTIYNRVIVCSSQGHAEMGSSNATTRTGCKALVKFNVSREGIWTLQKVELDHNHILATPKKKHMLRSQRHVIDADRHLIAQIREAGMKPTQVYEFMKQFYGGADKVPFLRMDCNNEIGRERKKYLESNDAQTLLEYLKNKQIEDPAFFYAMEIDRQDGRIANFFWADGQSIMDYACFGDAISFDTTFQTNKFEMPFAPLLGTNHHKQTIIFGAALLFNETIESFVWLFQTFLKAMSGKHPSTIFTDQDAAMAGAIAYVFPNTCHRLCLWHIYLNAAKHLGHVIHKYPEFLYAFKRCVYEDRSEEYFTKKWNELLTKYGLEENSWMDQLYGLRRKWAAVYRNSFTADMTTTQRSEGMNNVFKKRFRRKLGLSELLVECDKVSASLRENELDEDFKSLSKVPVIYVPELPLLKSALESYTRRMYTEFETEFKKQFEYSCKLLQTEGSISTFTVTHMHSDYGATTILNIADMTITCSCRKFESIGILCKHAFKVFNMNDVFILPSQYILNRWTKYAKRGHYVQKKGRPNENLKARAARISRIATSLALKCATSEPLLDDLERALENLESMADDSLNKMRKNEDSFVGLNDHDICTENSVISFRVPHVVKGPKSKRAKNVVEKNTRKKKKSHQEKASCLLIAAISDAVGEETRNIGDNSGGNVALPNISTNNAINFPIIVQGEYTSLLLGLDQDASAARKLQFDTGANDTTMRYPENFFPLWDPFEGFFPFGSGDVRSLVPSLPRTSSETAAFAGARIDWKETPEAHVFKADVPGLRKEEVKVEVEDGNVLQISGERNKEHEEKNDRWHRVERSSGKFLRRFRLPDNAKADQIKASMENGVLTVTVPKEEAKKADVKNVQITG

SEQ ID NO: 6274 - protein, 1067 aa, Oryza sativa
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRNANGHGTHTLATAGGDACYDSDILAAFEAAIADGVHVISASVGADPNDYLEDAIAIGALHAVKAGITVVCSASNFGPDPGTVTNVAPWILTVAASTMDRAFPAHLVFNRNRVEGQSLSPTWLRGKTFYTMISAANAAVPGYPPADALLCELGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKPDVTAPGVSVIAAWSGAAGPTGLPYDQRRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 6275 - protein, 229 aa, Acidovorax sp. JS42
MTAPTSLSQDELKTLVGQAALQYVVPGELVGVGTGSTVNKFIDALASIKDSIRGAVSSSEASTARLKALGIPVLDANDVRSLSVYIDGADEIDGNGYMVKGGGAALTREKIVAALARRFVCIADESKLVNVLGAFPLPVEVIPMAAAYIARRFESLGGQATLRLKDGQPLVTDNGQHILDVRGLTISDPLAFETEVNQWPGVVTVGVFALQKANVCLLGTAQGVRTLSL

SEQ ID NO: 6276 - protein, 152 aa, Triticum aestivum
  misc_feature (49)..(49): Xaa can be any naturally occurring amino acid
  misc_feature (94)..(94): Xaa can be any naturally occurring amino acid
  misc_feature (98)..(98): Xaa can be any naturally occurring amino acid
  misc_feature (105)..(105): Xaa can be any naturally occurring amino acid
  misc_feature (115)..(115): Xaa can be any naturally occurring amino acid
  misc_feature (123)..(123): Xaa can be any naturally occurring amino acid
  unsure (1)..(152): unsure at all Xaa locations
MAPTVMASSATSVAPFQGLKSTAGLPVSRRSNGASLGSVSNGGRIRCMXVWPIEGIKKFETLSYLPPLSTEALLKQVDYLIRSKWVPCLEFNKXGFNXPLTTTQXLGYYDGRYWXTMWKACLXFGCRTPKILNKVRSKKTLTPVRNHPNPTP

SEQ ID NO: 6277 - protein, 253 aa, Glycine max
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 6278 - protein, 369 aa, Oryza sativa (japonica cultivar-group)
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 6279 - protein, 295 aa, Listeria monocytogenes str. 4b H7858
MSKDIATPGRTTEILKKYGFLFKKSLGQNFLIDSNILTRITDTAEITKETNVIEIGPGIGALTEQLAKTANEVVAFEIDQRLLPILDDTLSAYNNIQVVHGDVLKADVEEVIAEQFAKPDLPLKIVANLPYYVTTPIILKLLHDNIPADSMTFMLQKEVADRISAVPSTKSYGSLTIAIQFYMEAELAFIVPKTVFMPQPNVDSAVIHLKRRKEPLAEVNDEEFFFEVTRASFAQRRKTLWNNLASKFPALKPRKDDLVEGLNAIGIDLIRRGETLDIPEFAKLSNFLGDFLKGK

SEQ ID NO: 6280 - protein, 370 aa, Arabidopsis thaliana
MGKGGMSQGEGSKVEEENMAAWLVGINTLKIQPFLLPSVDLCSFKGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 6281 - protein, 559 aa, Apium graveolens
MGSSGVSWKLADHPKLPKGKVVAMIVLDGWGEAHDNQYNCISVAETPTMDSLKNGAPDRWRLVRAHGTAVGLPTEDDMGNSEVGHNALGAGRIFAQGAKLCDLALESGKIYDGEGFNYIKESFESGTLHLIGLLSDGGVHSRIDQVLLLVKGASERGAKRIRVHALTDGRDVLDGSSVAFVETLQNYLSELREQGIDAQIASGGGRMYVTMDRYENDWDVVKRGWDAQVLGEAPYKFKSALEAVKTLRAEPKANDQYLPPFVIVDESGKAVGPIVDGDAVVTFNFRADRMVMAAKAFEYEDFDKFDRVRVPKIRYAGMLQYDGELKLPNHYLVSPPEIDRTSGEYLTHNGVRTFACSETVKFGHVTFFWNGNRSGYFDSEMEEYVEVPSDSGITFNVQPKMKALEIAEKARDAILSGKFHQVRVNLPNSDMVGHTGDIAATVVACKAADEAVKMILDTIEQVGGIYVVTADHGNAEDMVKRNKKGEPALDKDGKIQILTSHTLEPVPIAIGGPGLLPGVRYRKDVPSGGLANVAATVMNLHGFVAPDDYETTLIEVVDN

SEQ ID NO: 6282 - protein, 211 aa, Oryza sativa
  misc_feature (32)..(32): Xaa can be any naturally occurring amino acid
  misc_feature (133)..(133): Xaa can be any naturally occurring amino acid
  misc_feature (177)..(177): Xaa can be any naturally occurring amino acid
  unsure (1)..(211): unsure at all Xaa locations
MQFAGINGILYYTPEILEQVGVGGFFSKFDLXSSSTSILLSAIATLVMIPCIGVAVPFVDTKGRNFILLGTIPILLLSLAIMLVANIMNMSTDLHAITSALCVIVYQCVFVMGFGPIPNILCAEIFRSWIRPXCLVICSLAFWICDTIVTYTFPVLMNAIGLAGVFGIFATVCALAXLFVYFKVPETKGIYLLRFCRSVLLLPTSHPKMIR

SEQ ID NO: 6283 - protein, 361 aa, Gibberella zeae PH-1
MPSTTHSEFGTNTEAIDVAKAFSDGIHGETILITGVNRGGIGFSTAQAFIKSTQDPALIIIANRTLAKANDSIDNLKAEFPNVNYRFLEVDLSSQTSVRKAAEQVISWSDVPTIDLVINSAGVMGINERTITEDGLEMHLATNHIGHWLLTCLIMPKLIKAAEDKPKGSVRIVNITSASPMRSAMRWSDMNFDKKNKDLPQEEQPVYQFLKLWGYTDVEDAAYLPLDGYNRSKVANVLFGIGATKRLFNKYGILSLSAHPGVIWGTELGRNFPQATIDAAKKMGEKGLYTLKSLGAGASTGLVAALDPKLAVDVCEGEGNHGSYLVDCQISDQANPLAVSSSEAERLWEVSEKATGSEFAW

SEQ ID NO: 6284 - protein, 394 aa, Prochlorococcus marinus str. MIT 9313
MSQLETRTEPMVVNFGPHHPSMHGVLRLVVTLDGEDVVDCEPVIGYLHRGMEKIAENRTSVMFVPYVSRMDYAAGMFYEAIVVNAPERLANISVPKRASYIRVLMLELNRIANHLLWLGPFLADVGAQTPFFYIFREREMIYDLWEAATGQRLINNNYFRIGGVACDLPWGWLEKCQDFCDWFGPKIDEYEKLITNNPIFRRRIEGLGAIGRDEAINWSLSGPMLRASGVPWDLRKVDHYECYDDFDWDVAWEKEGDCYARYRVRIEEMRQSLKILRQACDMIPGGPTENLEAQRMAEGKTSPFMGFDYQYVAKKVAPTFKIPNGELYTRLESGKGEIGVFLQGNNDVTPWRFKIRAADLNNLQILPHILKGAKVADIMAILGSIDVIMGSVDR

SEQ ID NO: 6285 - protein, 1373 aa, Burkholderia pseudomallei K96243
MSKHRQAPGPRGGLVMGNLAAYKRNPITMLLRLHQQYGDVARNRLGPFVTHALAHPDHIQYVLQENHRNYVRGRFYDNFKMFFGDGLLTTDGEFWRRHRRVVQPLFHKKQVDAHTAAVGDAALALAHRWSALPPGKALDVVEEMMHLSLRMLGLMVFNTDVSSHAEAVGPAVRFGIEAMMPQGNLNDFIPRWAPTRFNRRIAHARRAIDTIVAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGATISLRPVHGIRLIVKPRERQQSHLARVREHESARALRPLGDTATTAGAACPMTAAREPGASAAALAAVEAGALDAAHRGGAAAAAAGEPCPPRDPAEAAPLPLAASPAPASPAVDADASARGVPAWRFTWRPVPVDPVPDEPSPALSGRRIALVNGRGGTAERVAAALARTCAKVSVFAPAASADHAEAARVFVNEAGPLDGIVDLGLEAPFALDDAGAWEAPMRRTVELLKACYGDWAAEDDTSRLFYVALTWMDGQMGYGETAGAQPLGGLWAGLAKTLPQELPNCNVRVLDIAPDETGRVDRLVVNELYRWGLFEVGYRGGVRYTLHAKRNELPPHAVDARTTLGAGDTVLFSGGARGIGLLCARALAERHGCTVIVTGRETPPDGGEPWMALDEPGFKHYGLEQLRAATPEHPPKAIRAALQRLKRRRELKTALDEMAALGLPVHYRVCDVTDRAAVRALCDELGDSLRMVIHNAGVDRPVRLIQKRAEDFADTVRTKVLGFANLCDAVRARPRLVQFCNVGSLTGRWGGMTGETDYAAANEALARLGLWAARHAFSPACGVKTLVWPTWEGVGMITNFAVTQRYVSPMNVDEGVRHWLRELATPGSGEVMFMGAVGRAPTPVQIKGFVPIRELPNIGELVTRRHHVGEPVRFRPFKRFESRYAIDPAVAPYAHAFRFNGRAVLPASLVLEHACAVGDWVMPPTGEPRELSEMTNVVLRLDALPDVPAGGAPVELASEAAGYMIGDVWCVDVRCSDARTQAELLSMTLVYRPQPEQIGAAFARAPDTTPEPAPLTSAPHAAWNGELLPAGDWSVPDDASAGIVRIGRVPPAAVLSLWALPFPLELRLPVNHVEHVLRVLLAEWGAARADAPAVWRIGGAKLARLPAASADGVVEYAAGRFAVLDARGYVLLRIDDARVDGEPAQAALPETGALADPLTA

SEQ ID NO: 6286 - protein, 272 aa, Geobacillus kaustophilus HTA426
MNIGVIGTGNMGTILIEAFLDSGAVKADQLVITNRTLAKAFAIQRAHPGIAVVADAAEVIKQSSLVFLCVKPLDIHPLLQQLAPHWTNEHYLVSITSPISVEQLEAAVPCQIVRAIPSIANRALSGSILVTFGSRCSAACRQTIDDLLRRIASPVYIDEAITRVASDISSCGPAFFSYLLQRFIDAAAAKTAITKEQATMLATDMIIGLGELLKRNLYTLPTLQEKVCVKGGITGEGIAVLEQRMNGVFEEVLAKTHEKFKEDVEKVKQQFP

SEQ ID NO: 6287 - protein, 272 aa, Staphylococcus epidermidis RP62A
MKTLNHLNKMKASQQKISMVTAYDYPSAKQAQQAEIDMILVGDSLGMTVLGYDSTVQVTLNDMIHHGKAVKRGASDTFIVVDMPIGTVGLSDEEDLKNALKLYQNTNANAVKVEGAHLTSFIQKATKMGIPVVSHLGLTPQSVGVMGYKLQGDTKTAAMQLIKDAKAMETAGAVVLVLEAIPSDLAREISQQLTIPVIGIGAGKDTDGQVLVYHDMLNYGVDRHAKFVKQFADFSSGIDGLRQYNEEVKAGTFPSENHTYKKRIMDEVEQHD

SEQ ID NO: 6288 - protein, 450 aa, Streptococcus agalactiae NEM316
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTFVKMIPLVLIALIGAFWSDKAPQLPQHLTAIQPSNVGWSWVSGLVPLYFAYDGWTIFVSIAPEVKNPKKNLPLAFVIGPALILLSYLAFFYGLTQILGASFIMTTGNDAINYAANIIFGPSVGRLLSFIVILSVLGVANGLLLGTMRLPQAFAERGWIKSERMANINLKYQMSLPASLTVTAVAIFWLFVHFMVTKFNLLPGSDISEIAVVFNNTSLIILYVLVLSLYLKKDIKNKFTGLVSPILAILGGLILFIGSLLSNFFTVLIFQCFCLLFCLICHYIYQKNNPKTHE

SEQ ID NO: 6289 - protein, 178 aa, Arabidopsis thaliana
  misc_feature (118)..(118): Xaa can be any naturally occurring amino acid
  unsure (1)..(178): unsure at all Xaa locations
SITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNXTRQVQCISFIAYKPPSFTGLILCFCTSKLYPPPLIYPWFLFPGKSLTVSGEIPRREEGKA

SEQ ID NO: 6290 - protein, 144 aa, Myxococcus xanthus
AIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 6291 - protein, 276 aa, Triticum aestivum
  misc_feature (88)..(88): Xaa can be any naturally occurring amino acid
  misc_feature (104)..(104): Xaa can be any naturally occurring amino acid
  unsure (1)..(276): unsure at all Xaa locations
MAAAATATAVRLHAAATRRAAPRRPARLAVRADAARAATALTQDDLKRLAAVRAVEQVQSGMVLGLGTGSTAAFAVAEMGALLASGKXLSGIVGVPTSKRTFEXQATSLGIPLSTLDDHPVIDLAIDGADEVDPDLNLVKGRGGALLREKMVEAASAKFVVVVDETKLVAGLGGSGLAMPVEVVQFCWKHNQVRLQGLFNEEGCEAKLRLNEDGKPYVTDNSNYIVDLYFKTPIRDALGAGKEIAALEGVVEHGLFLNMATSVIIAGSDGVSVKTK

SEQ ID NO: 6292 - protein, 546 aa, Prochlorococcus marinus subsp. marinus str. CCMP1375
MTATNSLNIAFDQIADALAAIRNGECVVVVDDESRENEGDLICAAQFATPQQINFMATEARGLICLAMDGERLDQLDLPLMVDRNTDSNQTAFTVSIDAGPEYGVSTGISAEDRARTIQVAINPQTKPNRLRRPGHVFPLRANKGGVLKRAGHTEAAVDLSLLSGLSAAGVICEIQNADGSMARLPELTKYAKTWGLKIISIADLIRFRLENERFVYRKAKTRLPSIFGDFQAIGYTNELDGTEHIALVKGNINELKEPVLVRMHSECLTGDAFGSLRCDCRPQLEAALNLISEEGEGVVVYLRQEGRGIGLINKLKAYSLQDGGLDTVEANLKLGFAADLRNYGVGAQILTDLGINRLRLLTNNPRKIAGLGGYGLRVESREPLVINPTDYNANYLAIKRTKLGHYIGNDDDSGKYYVIYWKGIVSSNMLSAYKNKAEQIASDNKVELNPESSSRLLALLQRPQFVWRVQNCIDFESIINLLKEIIKWDGTKSIGIFITNSKEQAIHPSQDVETILENISNLKDTNYKNIANINDKDLPFIMTWQ

SEQ ID NO: 6293 - protein, 132 aa, Robiginitalea biformata HTCC2501
MIKPDAVENGHIGPILEKITAAGFRIVAMKYTQLSRRDAEEFYAIHKERPFFGELVDFMTRGPIVSAILEKDNAVEDFRALIGATNPAEAAEGTIRKLFASDIAENAIHGSDSDANAEIEGAFHFSGREIYS

SEQ ID NO: 6294 - protein, 138 aa, Arabidopsis thaliana
MQTFAPGTRVYHLIIIVFFFFFFFCLSSFFASIVMADEYTGEATGSSEAKVHIIYTEKPTDEEPKTYHLRTLSSALGSEEAAKDALIYSYKEAASGFSAKLTPEQVAEISKQPGVIQVVPSQTYQLHKPGGGGGFKLT

SEQ ID NO: 6295 - protein, 260 aa, Schizosaccharomyces pombe
MPQNEYIEESIRKHGRRFDHEERKRKKAAREAHDASLYAQKTRGIKAKLYQEKRRKEKIQMKKTIKQHEERNATQRGSDAQTQGAVPTYLLDREQESQAKMLSSAVKQKRKEKAAKYSVPLPQVRGVAEEEMFKVIRTGKSKKNSWKRMITKATFVGDGFTRRPVKYERFIRPMALRQKKANVTHKELGVTMQLPIIGVKKNPQSPTYTQLGVLTKGTVIEVNVSELGLVTSGGKVVWGKYAQITNNPELDGCVNALLLT

SEQ ID NO: 6296 - protein, 432 aa, Magnetospirillum magnetotacticum MS-1
MTHELEIAARERGIKYFLVSYTDLFGTQRAKLVPAAAIGSTCRNGAGFAGFATWLDMSPADADLLAVPDPSGLIQLPWKPEVGWLPADLVMGGKAVEQGPRNILKRLIKEAAREGLQMKSGVECEFFLITPCGSEPADTADKQTKPCYDQSALMRRYDVISEICDAMLSLGWKPYQNDHEDANGQFEMNWDYDDALITADRHAFFKYMARSIAEKHGFRATFMPKPFMDLTGSGCHAHVSLWSGGQNVFADESDEIGMSRKGYHFIGGLIHSADALAALTNPCVNSYKRINAPRTTSGATWAPNTVTYTGNNRTHMIRIPDGGRFEFRLADGAANPYLLQAGILAAGLDGIRQQRDPGQRLDINMYTDGHKVEGVKQLPLNLLDALRALEASSVLNEALGSFVPSYLKLKRQEWDDYCRHLTQWERDTTLDC

SEQ ID NO: 6297 - protein, 86 aa, Brassica napus
  misc_feature (7)..(7): Xaa can be any naturally occurring amino acid
  misc_feature (12)..(12): Xaa can be any naturally occurring amino acid
  misc_feature (15)..(15): Xaa can be any naturally occurring amino acid
  misc_feature (22)..(22): Xaa can be any naturally occurring amino acid
  misc_feature (34)..(34): Xaa can be any naturally occurring amino acid
  misc_feature (41)..(41): Xaa can be any naturally occurring amino acid
  misc_feature (54)..(54): Xaa can be any naturally occurring amino acid
  misc_feature (66)..(66): Xaa can be any naturally occurring amino acid
  misc_feature (69)..(69): Xaa can be any naturally occurring amino acid
  misc_feature (85)..(85): Xaa can be any naturally occurring amino acid
  unsure (1)..(86): unsure at all Xaa locations
KRRQEVXVYSMXSSXAVVTSPXQATMVAPFTGLXSSSAFPXTRKANNDITSIVXNGGRVNCMQGWXPPXEKKKFETLSYLPDLTXS

SEQ ID NO: 6298 - protein, 385 aa, Vitis labrusca
MDDAKISELKQFVNSVKSDPSILHNPSLSFFKSYLQSLGARIPAKPDKCGCGTSDHGEHVDAKKTNLCSEDDKFEDDIVESDIELDDTDVVEPDNDPPQKMGDLSIDVTEENQDAAQMLKSKAMEAISEGKLDEARDNLTEAIMLNPSSAILYATRASVYVKLKKPNAAIRDADAALKINPDSAKGYKIRGMARAMLGLWEEAATDLHVASRLDYDEEIALVLKKVEPNARKIEEHRRKYARLCKERELRKYGHQKQQQQAQPHDPEAAAALKDGQVMAIHSSSELETKLKAASKTSRLAILYFTATWCGPCRYISPVFTSLSGKYPKVVFLKVDIDGAQDVAVSWNVSSVPTFFFIKNGKEIDKVVGVDKSALETKIAQYAGQS

SEQ ID NO: 6299 - protein, 504 aa, Burkholderia thailandensis E264
MNATLAADARSACTAGTRVAVQPVVLAGGSGTRLWPMSRERHPKQLINLLGDESLLQSTARRLDGLSGAHPVSERMIIVCGEEHRFTTAEQLRLAGKDATLLLEPLGRDTAPALTIAALRAVADGDDAVLTVMPADHAVADIARFQQAVAAGVRCAEQGMIATLGIVPARAETGYGYIRVGAAASASDAELGVAVRKLDRFVEKPHLELARQYVASGEYWWNSGIFIVRASVWLKAIRHFQPAIHEACARAVELGSVDGPFFRVDRDSFAASPSNSIDYAVMEPLSNLPAVCEGVVVPLDAGWSDVGSWDALWQISDKDDEGNVARGRVCFEQASSTFAHSEGRLIACVGTQNLVVVETPDAILVADRAHVQDVKKIVGRLKAESGTEASEHRKVHRPWGHYDSVDSGERFQVKRIVVKPGARLSLQMHHHRAEHWIVVRGTARITRGDETFLLSENESTYIPLGVSHRLENPGKMPLELIEVQSGSYLGEDDIVRFEDNYGRH

SEQ ID NO: 6300 - protein, 627 aa, Saccharomyces cerevisiae
MVNILPFHKNNRHSAGVVTCADDVSGDGSGGDTKKEENVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 6301 - protein, 580 aa, Schizosaccharomyces pombe 972h-
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 6302 - protein, 541 aa, Campylobacter jejuni RM1221
MDNFLEIFLITVAIAIVLNVIFKKFEIPTIIGYIAAGEIISEIYHLSGKGEITHIAEFGIVFLMFTIGLEFSFKHLMAMKQEVFLNGSLQMLTCGFVFMLLAIGILGLGDKSATIVGFALALSSTAVVLKILNDNGDINEQYGRKALGILLFQDIAVIPLLLLVDIFSSNNQNIEKLLFTTLISALILITLLFFIGKYLVDRIFRLIIHTSSQEIFISTVLFMVIGASFLANYFGFSYSLGAFIAGALIAETKYKHKIEADLIPFRDLLLGLFFITVGMQIQLDVVAQNWFLIIVLTLLVMALKFGIVFGFLFLYTKKRVALKTAFAIAQIGEFALAIFSLLQAKNMLDIKTSQILIVVSILTMIITPFILNNIRKITNVVEDIALNTNAVQNIDSNIKLKNHLVVFGYGRLGQEVVQKIKNTGVPYLVLESDLNLVELGVSRGENVVFANAAQEETLKIANIEECAVAIITVTNEAKLEILCQVLANYPKPIDTIIHVNGTLKKMLFSSIDENIRIIRSEKVIARNLVQEALECRIHKNT

SEQ ID NO: 6303 - protein, 285 aa, Triticum aestivum
  misc_feature (10)..(10): Xaa can be any naturally occurring amino acid
  unsure (1)..(285): unsure at all Xaa locations
RFRDCVSVNXDDFVTDVESGDMLLVDGGMMSFLVKSKTEDSVKCEVIDGGELKSRGDLGAELPIEEVPLLQEEIIRMCRSMGKAVIVATNMLESMIVHPTPTRAEVSDIAIAVREGADAVMLSGETAHGKFPLKAVKVMHTVALRTEATIIGGETPSNLGQVFKNHMSEMFAYHSTMMSNTLGTSIVVFTRTGFMSILLSHYRPSGTIFAFTDQEIVRQRLALYQGVCPVHMEFSDCAEKTFADALSYLLKHGMVKEGEEVALVQSGRQPIWRSQSTHNIQVRKV

SEQ ID NO: 6304 - protein, 398 aa, Trifolium pratense
MASASASVFKSSSLVLDKSEWVKGQTLRQPMSVVRCSPAAPSSLTIRAGAYTDELVKTAKTIASPGRGILAMDESNATCGKRLASIGLENTEANRQAWRTLLVTVPTLGEYISGAILFEETLYQSTVDGRKIVDVLVEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRVENVKAAQEALLHRAKSNSLAQLGKYAGDGESEEAKKELFVKGYVY

SEQ ID NO: 6305 - protein, 143 aa, Glycine max
  misc_feature (3)..(3): Xaa can be any naturally occurring amino acid
  misc_feature (9)..(10): Xaa can be any naturally occurring amino acid
  misc_feature (16)..(16): Xaa can be any naturally occurring amino acid
  misc_feature (22)..(22): Xaa can be any naturally occurring amino acid
  misc_feature (31)..(31): Xaa can be any naturally occurring amino acid
  misc_feature (39)..(40): Xaa can be any naturally occurring amino acid
  misc_feature (46)..(46): Xaa can be any naturally occurring amino acid
  misc_feature (51)..(51): Xaa can be any naturally occurring amino acid
  misc_feature (65)..(66): Xaa can be any naturally occurring amino acid
  misc_feature (100)..(100): Xaa can be any naturally occurring amino acid
  unsure (1)..(143): unsure at all Xaa locations
APXGEPENXXEGPHDXAKGADXTERARAAGXKAPNDHHXXREGTPXKPNRXTPGTESARAFFFFXXEHTERALHLTAPPAVPAIVFLSGGQSEEEAIANXTAMNHLKGKKPWTMTFSYGRALQQTTLKARRGKDENIPKVQSA

SEQ ID NO: 6306 - protein, 208 aa, Arabidopsis thaliana
  misc_feature (66)..(66): Xaa can be any naturally occurring amino acid
  misc_feature (123)..(123): Xaa can be any naturally occurring amino acid
  misc_feature (139)..(139): Xaa can be any naturally occurring amino acid
  misc_feature (150)..(150): Xaa can be any naturally occurring amino acid
  misc_feature (179)..(179): Xaa can be any naturally occurring amino acid
  misc_feature (186)..(186): Xaa can be any naturally occurring amino acid
  unsure (1)..(208): unsure at all Xaa locations
TRKKKKKKSPYYPPPPTRGLTKSEEDLWLSSMVSSARMVASPAQVTMVAPFNALKTSGAFPVTREXNNDITSITSNGGRVNCMQGWPPIGKKNRDTLSYLPDLTDSELDKEVDYLIRTKWIPXDEFELKNGFVYPEHGXNSPGYYDGRDXTMRMLPLFSCTYSAQVLKEVGECKKEYPXAFIKIIXFNNTREVQSIRFIAYKTPSFTG

SEQ ID NO: 6307 - protein, 289 aa, uncultured alpha proteobacterium EBAC2C11
MRNGIFTHQFICLIAGATLLAGTTNMVQADEDRIPVGTVNGETIWLDDVMRQAERLPAKFRQAPMESYFNQLVTDMIDSKIAADAARAAKYDTKKEIASAMKTAADRVLAESWIGEKISGDVTDAAIEKAYKTFVADTASREQVTAAHILVATEDEAKKIIASLAGGADFAELARSKSTGPSGPNGGSLGKFGRGQMVPAFENAAFALEDGKITTQPVQTQFGWHVIKVESKEIAPAPTIEDMREQLVQTLSTQALGRVLEELRAKQEIRLRSFDDIRKDAIATDKNKQ

SEQ ID NO: 6308 - protein, 182 aa, Glycine max
MNVSHASVHPVEEAPTTEGGGDQNVNAPRVRMKDVQGMPGTAGGLSLRVSQFVFAAAALSIMASTSDFPSVTAFCYLVAAAGLQALWSFSLAITDVYALLVRRSLQNYRIVSLFTVGDGVTSTLTFAAACASAGITVLIDNDLGSCSQNHCVQFETATGMAFLCWFTTLPSFLLNFWSLASR

SEQ ID NO: 6309 - protein, 242 aa, Aspergillus nidulans FGSC A4
MWSWFGGAAAQKRKEAPKNAILQLRSHLDMLQKREKHLENQMNEQEAIAKKNVTTNKNAAKAALRRKKVHEKNLEQTQAQIVQLEQQIYSIEAANINHETLAAMKAAGAAMEKIHNGMTVEQVDETILRDKLREQQAINDEIAIAITNPGFGEQVDEEDLEAELEGMEQEAMDERMLHTGTVPVADQLNRLPAPANAERKALPFPPQKRTPTDSLPAAKAKQKAEEEDEEAELEKLRAEMAM

SEQ ID NO: 6310 - protein, 445 aa, Lactobacillus acidophilus NCFM
MSKQYTAEEIKTEVEDKNVRFLRLCFTDINGTEKAVEVPTSQLDKVLTNDIRFDGSSIDGFVRLEESDMVLYPDFSTWSVLPWGDEHGGKIGRLICSVHTTDGKAFAGDPRNNLKRVIGEMENAGFDAFDIGFEMEFHLFKLDDNGNWTTEVPDHASYFDMTSDDEGARCRREIVETLEDMGFEVEAAHHEVGDGQQEIDFRFDNALATADRCQTFKMVARTIARKHGLFATFMAKPLEGQAGNGMHNNMSLFKGKKNVFYDKDGEFHLSDTALYFLNGILEHARAITAIGNPTVNSYKRLIPGYEAPCYIAWAAKNRSPLVRIPSAGEINTRLEMRSADPTANPYLLLAACLTAGLNGIKEQKMPMKPVEENIFEMTEEERAKKGIKPLPTTLHNAVKAFKEDDLIKSALGDHLTRSFIESKELEWSKYSQSVSDWERQRYMNW

SEQ ID NO: 6311 - protein, 461 aa, Rhodococcus sp. RHA1
MRRELRFVMSKILAVPPAQSQLQPVSGRSGLPGVGHVLEYIRDPLALMQKHWDRYGEVSWFSMVGRRWVAVLGPDACQEVLQNKDRAFVNGDGWSVLIGPFFHGGLMLLDSEEHLRHRRIMQQAFTRSRLENTVDVLNPAIDSALDAWTPTNGFRAYTALKALTLDLATDIFMGGAEGSTESEISSVKKAFVDCVQAATSVVRYPVPGTRWKRGLDGRRVLEDFFRQYLPARRSHETDDLFSVLCHIESEAGQRFSDDEVVDHMIFLLMAAHDTSTITISTMMQYLGQHPQWQDRCRAESLALGTPAPSYADLDGLDSLDLVMKECLRIVSPVPVMARRAVRDTQVQGHFVPAGTYAAVVPHFTHHMPQYWPEPERFDPERFAEHRREDKVHRYAWEPFGGGVHKCLGMHFAGAEIKAIMHHLLLRFDWHVDADYVAPLNFTSLPFPSDGQPVDLRLLATS

SEQ ID NO: 6312 - protein, 288 aa, Trichodesmium erythraeum IMS101
MLEFNQQKFINSLSNIQGTKLSHSSSPLTPNHLHIFSSLPSTNQTLWQLIDSGASSGTMVIAAQQTAGRGQWGRNWISSIGGLYMSVAFCKGCGWTSMPKILISHIPQLTLCTAWGIASSLQNYGVPVKIKWPNDLILENRKLGGILTETRVKKEKVPWAVIGIGINWANSEIGDTGINLQSYYRNESQPGISSLEMLAAIVFHALESAIRQLLDSGIENILPAYNQLLINMGKQVLVEDRLGEVVGVTKSGELKVKINSGSATAKTQSQILPSEIYLKPGTISLGYG

SEQ ID NO: 6313 - protein, 302 aa, Heterosigma akashiwo
RIGRLVARAALANPETSLVAINDPFMSIDYMVYLFKYDSVHGRYPGTVEVGENAIVVDGVSISVFAERDPTQIPWGAASATYVCESTGVFTTTEKASAHIQGGCSKVIISAPSADAPMFVMGVNADGYSKDMTVVSNASCTTNCLAPLVKVINDAYGIEEGLMTTVHAMTATQLTVDGPSKGGKDWRGGRCASANIIPSSTGAAKAVGKVIPEMNGKLTGMAFRVPTADVSVVDLTCRLVNGASMDEIKATVKAAAEGPMAGVLGYTDEDVVSQDFVDDKRSSIFDANACIGLTNNFVKLVS

SEQ ID NO: 6314 - protein, 231 aa, Methanococcoides burtonii DSM 6242
MKERNANASSSEKEAAGNAAASLVEDGMIIGLGTGSTTAFAIAEVGRRVREEGLNVLAVVTSYQAEMLAIEAGVPLTSLAEHPVLDLAIDGADQVDAKLNVIKGGGAAHTHEKVVAHSAKRFIVVVDESKISEELDHFVPIEVLPYARELAKKQFIELGGKPQIRLASRKDGPVISDNGNVIIDVEFGVIEDAAELSQKLSTCVGVVEHGIFLNTDEVYVGMKDGSVKIIN

SEQ ID NO: 6315 - protein, 97 aa, Citrus unshiu
MARCLFKAKLLLAPVADGISLSISRRGYAAAAPLGTISRTGIMEKNDLRPAVREDSGASSAWAPDPITGYYRPENRAVEIDPAELREILLNHKVRAH

SEQ ID NO: 6316 - protein, 461 aa, Salmonella enterica subsp. enterica serovar Typhi
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 6317 - protein, 608 aa, uncultured bacterium
MGFTTCKVKSHEAHSYNYANSLWSLRMKSLFILLLTLVFVAGCSDSGSVSQSAANLSSSTSSDSTTSADYLSLAIVEEPTHWWHSTIFYEIWPRSFQDSDGDGSGDFNGMTNKLDYLKDLGVKGIWLTPVFEAPSYHGYDFQDFYNVETDYGTMADFENFIAQAHKRNIKVILDLVLNHISDKHEWFIKSANKTAGYEDYFIWRDERPTSGWGQPWSAESNPAAVWHWNETRKAFYYGAFGSSQPDLNLTKQVVIDELNKLASFWLAKGVDGFRLDAVRYAVEEGGYPLQADTQGTIDYWTIFSQHVKSVKPDAMLVAEAWADLKTIGKYRNNGKGLDSSFDFDFGTVVIDMLNPAVKQTADFGTISTNHLQQSRESLWANLTARKAAAPIHYFSPFLTNHDQTRIMYTLENDIAKAKIAASLLMTTPGILYIYYGEEIGLSQYKTGDDQYRRAIMQWSDEDSAGFNATGEFWLDQAKWFPWMQNHQGWWANYWQSLKGTGKSVAAQAQDPQSLFNHYKRMINVRNKNPVLQLPQEVRYYPVDNKEVWLVENIVVGKSVWVLINLSSTVDAEFVVPKNLRGARVDQVTGKEINLGERVSLPAAGVMIF

SEQ ID NO: 6318 - protein, 486 aa, Ralstonia eutropha JMP134
MQIQNPSLFRQQCHVNGQWVDAADGEVVPVTNPATGQQLGTVPRMTAADVQAAIAAADRALPAWRATSSRERSRLLRRWFDLCMAHQEDLATILTLEQGKPLKESRGEIAYGSGFIEWFSEEARRIYGDVIPAPSSDRRIIVIKQPVGVVAAITPWNFPNAMITRKAGAALAAGCTIVIKPASATPFSALALAALAKEAGIPDGVLNVVTGSASVVGGELTSSPVVRKLSFTGSTDVGKTLLEQCAGTVKKVSMELGGNAPFLIFDDADLDAAVAGVMASKFRNAGQTCVCANRIFVQDGVYDAFAEKLRIAVEAQVVGDGMAPGVDLGPLIDDAAIEKVREHIYDAVSLGAQVFTGGRAHALGGRFFKPTILTDVSPKAKLMNEETFGPLAPLIRFKTEEEAVAMANDTPFGLAAYFYTTNYARSWRVAEALECGIVGLNEGLISTEVAPFGGVKESGVGREGSKYGIEDYVEVKYICAGGLALR

SEQ ID NO: 6319 - protein, 182 aa, Cucumis sativus
YRGDWHGSEVAVKILTEQDFHPERVNEFLREVAIMKSLRHPNIVLFMGAVTKPPNLSIVTEYLSRGSLYRLLHKSGVKDIDETRRINMAFDVAKGMNYLHRRDPPIVHRDLKSPNLLVDKKYTVKVCDFGLSRLKAHTFLSSKSAAGTPEWMAPEVLRDEPSNEKSDVYSFGVILWESNSRG

SEQ ID NO: 6320 - protein, 754 aa, Streptococcus thermophilus LMG 18311
MFTFTNYVESKNKNLKELSNEEIYYLLLEFVKEAAASKPKNDSKRKVYYISAEFLIGKLLSNNLINLGIYKDVKAELAAAGKSISEIEDIEPEPSLGNGGLGRLAVCFIDSMSTLGINGEGVGLKYHCGLFKQVFKDNKQYAEPDYWIEDQSWLVPTDISYDVPFKNFTLKSRLDRLDVLGYKKETKNYLNLFDINGLDYGLIEKGITFDQDEIQKNLTLFLYPDDSTRKGELLRIYQQYFMVSNAAQLLIDEAIERGSNLHDLPDYAFVQINDTHPSMVIPELIRLLTEKHGFEFDEAVAIVSKMVGYTNHTILAEALEKWPLDYLEEVVPHLVVIIKKLDAIVRGKFDDPRVQIIDEHNRVHMARMDIHFSTSVNGVAKLHTEILKTSELKPFYDLYPERFNNKTNGISFRRWLEFANQELADYIKELIGDDYLTDATQLEKLAAFADDPAVHKRLSQIKYDNKLALKRYLKANKGIDLDENSIIDTQIKRFHEYKRQQMNALYVIHKYLEIKKGNLPKRKITIIFGGKAAPAYVIAQDIIHLILSLSELINNDPEVSKYLNVHLVDNYNVTVAEHLIPATDISEQISLASKEASGTGNMKFMLNGALTLGTMDGANVEIAELVGPENIFIFGKDSDTIIDLYKKEGYVSRDYYENDANIKAAVDFIVSEDLVKVGDKERLERLYKELISKDWFMTLIDLAEYIEKKEEVYAAYEDQDAWNKKVVYNIAKAGFFSSDRTIEQYDKDIWHTKY

SEQ ID NO: 6321 - protein, 139 aa, Glycine max
  misc_feature (129)..(129): Xaa can be any naturally occurring amino acid
  misc_feature (131)..(131): Xaa can be any naturally occurring amino acid
  misc_feature (133)..(133): Xaa can be any naturally occurring amino acid
  unsure (1)..(139): unsure at all Xaa locations
MSSKESCRSELRIAIRQLSDRCLYSASKWAAEQLVGIEQDPAKFTPSNTRFQRGSSSIRRKYKTHEITGTPIAGVSYVATPAMEEDELVDGDFYLLAKSYFDCREYKRAAHVLRDQNGRKSVFLRCHAXYXAXEKRKEE

SEQ ID NO: 6322 - protein, 489 aa, Burkholderia thailandensis E264
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLAEAKGEIGYAASFLEWFAEEGKRVYGDTIPSPANDKRIVVTKEPVGVCAAITPWNFPAAMITRKVGPALAAGCPIVVKPAEATPFSALAMAVLAERAGVPAGVFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGLGTEAGVVQGPLINGAAVQKVESHIADALDKGARVTTGGKRHALGHGFFEPTVLTGVTPDMKVAKEETFGPLAPLFKFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 6323 - protein, 238 aa, Prunus tomentosa
AHYKSEADVGNAIAEAIQSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDI

SEQ ID NO: 6324 - protein, 252 aa, Prunus padus
AHYKSEADVGNAIAEAIQSGLVKREELFITSKASNHGHVVEACKNSLKKLQLDYLDLYLVHYPLATKHNGVGTTASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLGLAKKYQKSVAQIALRWNIERGTPVIPKSSKVERLKENLEVLNFKLEKEDIELIDTIDKKSRTTL

SEQ ID NO: 6325 - protein, 968 aa, Tropheryma whipplei str. Twist
MHERHIGPSQEEIDHMLGFLGYKSLDDLMNAALPNGVQSPPDIKIPSHDELTCLTQLAAYAKMNRIKTSMLGQGFYNCITPAVIRRNILENPSWYTSYTPYQPEISQGRLEMLINFQTMICDLTGLEIANASMLDEASCAAEAMLLAKRVSRSSSNKYLVHNGVFPHIRRVLETRADAVGVEIVDLPEGQSIDFDHFGVYAQYQSASGKLLDLRHLFSRSKRAGAICVIGCDLLMLTLFTSPGELGADIAFGSAQRFGIPMNFGGPLASFLAARKAMERSLPGRLVGVSVDADSNHAYRLTLQTREQHIRREKATSNICTATVLMAIAAVAFAQHHGPKGLRAIAHRINTVAVGFARLLKQTAFRVSSLDIFDTIEINNPTQLCVEAESKHDLLFWKVDDNKLRITFDEVTARLDGDLPERLSKVFGISPDKIRDLGCNYDSCDCSFYSDSQQAREGLSSVASRNISVHSDLARHPLRRFSGYLKHPVFNNYTGEVALMRYLKALSDKDFALDRGMIPLGSCTMKLNAAFQLEPVLWPEFANLHPFAPRGDADGTLQIIDQIETWLANLSGYDAVSLQPTAGSQGELAGLLAIRGYYKSLNLDRDVCLIPASAHGTNAASAVLAGMRVVVVACDQQGNIDLDDLRLKASKNAHALAALMVTYPSTHGVYEDNISEVCSVVHKYGGQVYVDGANSNALIGYLRTGDFGGDVSHLNLHKTFGIPHGGGGPGIGPVVAKAHLAPFLPFRNRVHKPSTDLPAVKHMGGPIASSDYGFAGALYISWAYIFCLGSQGMKRCTAVAVLVANYIAKQLSDTFPVLYTGKNNLVAHEFIMDFREVTRVSGITVDDVCKRLIDYGFHAPTMSFPVPGTLMVEPTESEPFSEIQRFIKTIRSIRAEIDRVIDKTYDPDNNPLKRAPHTLEQIASDKWDRPYSRRTGIVYTSGKYWPASARIDNAYGDRNIFCTCPDLPD

SEQ ID NO: 6326 - protein, 252 aa, Prunus caroliniana
AHYKSEADVGNALAEAFETGLVKREELFIISKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSMSPLEDPVLHGLAKKYKKSVAQIALRWNIERDTPVIPKSSKVERLKENLEVLNFKLEKEDIELINTIDKKSRTTL

SEQ ID NO: 6327 - protein, 298 aa, Propionibacterium acnes KPA171202
MSETGLLNPASIRRIADQIGLRPTKTRGQNFVHDANTVRRIVSLAQVGAADRVIEVGPGLGSLTLGLLETGAEVVAIEIDEVLANQLPGTVAERMPGAAERLEVVLSDALDVKVIPGAEPTALVANLPYNVAVPVLLHMLAICPQWSTGVVMVQSEVADRLVAAPGSKIYGVPSAKLAWYAEAIRVGNVPPTVFWPVPNVDSGLVRITRRRPPHVDGRDPRVTRSQVFRVVDAAFASRRKMLRSALAGLCGGSMAASELITAAGIDPTARGEALDIGDLARVVEALAQAGALSDSGQV

SEQ ID NO: 6328 - protein, 251 aa, Prunus laurocerasus
AHYKSEADVGNAIAEAIQRGLVKREELFITSKASNHGHVVEACKNSLKKLRLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINSIDKNPGPL

SEQ ID NO: 6329 - protein, 287 aa, Frankia sp. EAN1pec
MAHPTSALAAEVGKFYDHLTTYQTAQDEDLNFHFGYWDVPPDGTPPAPGTDVAELEAAAERLTELMIEKIRVRTGDRVLDVGSGSGIPAVRLTRATGASVVGISISREQVRRSTDRARDENLSDRLEFEYADAAELPFGPDSFDAAWALESIIHVPDRAQVLREIARVIRPGGRFVATDIFERSPVPDEKRHAVDSFYSGLLLGPSVRFDDYPALLRGAGLRPLELIDVSDQVIARSFQLLAERIRRDKENLDDLLGDELYQRLASTGVDGLREIGYLVVVAERPTE

SEQ ID NO: 6330 - protein, 231 aa, Glycine max
  misc_feature (200)..(200): Xaa can be any naturally occurring amino acid
  unsure (1)..(231): unsure at all Xaa locations
MPQGDYIELHQKRHGRRMDYEERKRKKEARAVKKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRPVAEEEMFKVLRTGKRKTKQWKRMVTKATFVGPGFTRKPPKYERFIRPTGLRFTKAHVTHPELKCTFNLDIISVXKNPNGPMYTSLGVMTRGTIIEVNVSELGLVT

SEQ ID NO: 6331 - protein, 283 aa, Nocardia farcinica IFM 10152
MSVSDSETPAYGAAQPAQPRRKTRIPHLRQMKADGERWAMLTAYDYSSARLFEEAGIPVLLVGDSAANVVYGYDTTVPITVDELIPLVRGVVRGAPHALVVADLPFGTYEGSAQQALAAATRFMKEGGAHAVKLEGGERVAEQIALLTAAGIPVMAHIGFTPQSVNTLGGFRVQGRGDGAEQLIADAIAVQEAGAFSVVMEMVPAELAGQVTRKLTIPTIGIGAGPDCDAQVLVWQDMAGYTSGKTAKFVKRFGDIGDQLRAAAAAYAAEVREGTFPGPEHSF

SEQ ID NO: 6332 - protein, 429 aa, Legionella pneumophila str. Paris
MFKRIALVCALFSGICFAEGKQLLDKVVAIVNDNVITSSELNAQVELSKKQIIAQNMQMPDESVLRKQVLQHLIDVDLEMQMAKQNGITIENAEIDEAIEKIAASNHLNLSQMRDEITKQGISWQEYRQNIRKEMLISRVQQKAVGKDIIVTNEQVEQYLKNAGRIENSNLTYHLKNIVIPLSEEPTTKQLQRAKIEAENLLNKIKKGEDFSRLAIEESSGEFALEGGDLGERHLAELPEVFAKEVVHMKVGQVAGPIRAGNGFHLIKLVAVGGENQRHVITQTHVRHILLKPDASMVPSEAIKQVNNIYRQIQSGKDFALMAKQYSLDAASAVKGGDLGWVNPGELVPEFEKTMNSLPLHKVSKPVKTQYGWHLIEVIARRQKDDSEAFKKQQVRQFLQQRKFVEAVQNWQQHLRSQAYINIVDKDLA

SEQ ID NO: 6333 - protein, 723 aa, Aspergillus nidulans FGSC A4
MANFRLYLAFVGTFIFAVVLLQLISVLHGFDDSPVLEASLQWHDRSSNYVGDDSIFVVGAGKADITGPVVEVGFGGYADLDQVGTGLRQRLYSRAFIVANPNNLEQTWIYIVLDTLTGDTGVRDGVLKGLAELGSDYSRQSYNAIVDGVLLSIRRAHESLAPGRLTFGTIDVEDANINRSPYSYDANPEEEKARYPHNVDKTLELLRFDRENDNKTMAVLTFFPVHGTSLYGNNTLASGDNKGVAAWLFERSVQDDSRFANDFVAGFSQSNVGDTSPNILGAWCDDGSGEECRYSDSTCGGQSTTCHGRGPFFREDSYGAKSCFEIGRRQYSAAKELYSQMETNAIQIRKSSQVSSFHLFEDLKGYTFQSPFNSSTLTTCSAALGFSFAAGTTDWPGYFDFTQNDTTPAERNPLWYIARGFLHTPTPEQRKCQEPKDVLLDVGEMSLPYAWTPNIVDIQLHRIGQLIIVTSTSEVTTMAGRRWREAIAKSARDILSIFDPLVVLGSPANSYAHYVTTEEEYSRQRYEGASTLYGPNTLAAYVNLTLTYLPYLDESAAAGQYPEPSGIEPPINTEKSLSFIPSVVYDGHPIGKAYGDIITSAGNTRYAPGDVASATFIGANPRNNLRLESTFAAVERQTDDGHWETVRTDSDWSLVYRWKRTNTVLGHSEVTLQWEIEDDYYAVGSPRPVQAGVYRFHYYGDAKGLNGRIEAFEGVDEPFTVVV

SEQ ID NO: 6334 - protein, 515 aa, Wolinella succinogenes
MIIGYVTTGTLIVYAFGLASVAGSSTLSHIAEFGIVFLMFMIGLEFSFDKIKAMKQEVLLFGTLQILLSWVIFYLVAHLFFGIESKVALVVSAAFSLSSTAIVLKSFNETRETHTGYGRNAIGILIMQDIAVIPILLLISLLANHEARLEELLLHTFLSAVLVLFILFVPGKKVATMILKLAADARMDEIFVGTILFIVLGASALAGYFGFSYSLGAFIAGMIIAGTKYKYQAEADLSHFRDLLLGLFFITVGMQVDLEFLRNHLFRILWVLLAVMGLKALIIYIIIRFFRSAKVAFKTALSLAQVGEFSFAIFALSQSNGLLDKETHQLLVLTVIFSMILTPFLLKNLRAISAVFVREREKSVPAFSGTIGLHNHIVVCGYGTFGKEVVTYLKRYDINYIAIDYNLAQVEEGIRAGDNVQFGNIAQKAILEKLNLEECVAVVVAVDDTRKIRVICESILQKAPHCHIIAKVTTKAEEEELGELDIYRVVNEKHEIARLLGQAAISCEYERLKGR

SEQ ID NO: 6335 - protein, 559 aa, Mesembryanthemum crystallinum
MGSTEFSWKLADHPKLPKGKTLAMVVLDGWGEASANQYNCIHVAETPTMDSLKQGAPEKWRLIRAHGKAVGLPTEDDMGNSEVGHNALGAGRIYAQGAKLVDLALESGKIYDGEGFNYIKESFETNTLHLIGLLSDGGVHSRLDQLQLLLKGSAERGAKRIRVHILTDGRDVLDGSSVGFVETLENDLAQLRAKGVDAQIASGGGRMYVTMDRYENDWSVVKRGWDAQVLGEAPYKFKNAVEAVKTLRQEPKANDQYLPPFVVVDESGKAVGPIVDGDAVVTLNFRADRMVMLAKALEYEDFDKFDRVRFPKIRYAGMLQYDGELKLPNRYLVSPPEIERTSGEYLVHNGVRTFACSETVKFGHVTFFWNGNRSGYFKPEMEEYVEIPSDSGITFNVQPKMKALEIAEKARDAILSGKFDQVRVNLPNSDMVGHTGDIEATVVACKAADEAVKMIIDAIEQVGGIYVITADHGNAEDMVKRDKKGQPAMDKNGNIQILTSHTLEPVPIAIGGPGLTPGVRFRNDIPTGGLANVAATVMNLHGFEAPSDYEPTLIEVVSN

SEQ ID NO: 6336 - protein, 686 aa, Lotus japonicus
MPLLSSQNYITVTQNQSIQDDETLVSAEGTFEAGFFGLGNSQRQYFGIWYKSISPRTIVWVANRDAPVQNSTATIKLTDKGNLLILDGSKGIIWSSNGSRAAEKPYMQLLDSGNLVVKDGGKRKKNLIWESFDYPGDTLLAGMKIKSNLVKGPTSYLTSWRNTEDPASGEFSYLIDTRGFPQLVITRNATAYYRAGPWTGKLFSGSSWLRLRKILTFSMQFTSQEISLEYETANRSIITRAVINPSGTTQRLLWSDRSQSWEIISTHPTDQCTYYGLCGANSMCDISNNPICHCLEGFRPKFQAKWNSFDWPGGCVPMKNLSCQNGDGFLKHTGVKLPDTSSSWYGKNKSLDECGTLCLQNCSCTSYAYLDNDIGGSACLIWFGDILDLSIHPNPDQGQEIYIKVVASELDHRRNKKSFMTKKLAGSLAGIVALVICIIILGLATSTCIQRKKNERGDGDSTRSKLLDWNKRLQIIDGIARGLLYLHQDSRLRIIHRDLKTSNILLDNEMNPKISDFGLARIFIGDQVEARTKRVMGTYGYMPPEYAVHGSFSIKSDVFSFGVIVLEIISGKKIRKFYDPHHHLNLLSHAWRLWIEGSPLELVDKLFEDSIIPTEILRYIHVALLCVQRRPETRPDMLSIVLMLNGEKELPKPSLPAFYTGKHDPILLESPSRRCSTSVTISLEAR

SEQ ID NO: 6337 - protein, 862 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDLCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKVGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 6338 - protein, 730 aa, Lotus japonicus
MAQKQSIQDDETLVSPEGTFEAGFFRFGNSLRRYFGIWYKSISPRTIVWVANRDAPVQNSTATLKLTDQGNLLILDGLKGIVWSSNASRTKDKPLMQLLDSGNFVVKDGDKEENLIWESFDYPGDTFLAGMKIKSNLATGPTSYLTSWRNAEDPASGEFSYHIDTHGYPQLVVTKGATVTLRAGPWIGNKFSGASGLRLQKILTFSMQFTDKEVSLEYETANRSIITRTVITPSGTTQRLLWSDRSQSWEIISTHPMDQCAYYAFCGANSMCDTSNNPICDCLEGFTPKFQAQWNSLDWTGGCVPIKNLSCQNGDGFPKHTGVQFPDTSSSWYGNSKSLDECGTICLQNCSCTAYAYLDNVGGRSVCLNWFGDILDMSEHPDPDQGQEIYLRVVASELDHRRNKKSINIKKLAGSLAGSIAFIICITILGLATVTCIRRKKNEREDEGGIETRIINHWKDKRGDEDIDLATIFDFSTISSTTNHFSESNKLGEGGFGPVYKGVLANGQEIAVKRLSNTSGQGMEEFKNEVKLIARLQHRNLVKLLGCSIHHDEMLIYEFMHNRSLDYFIFDSRLRIIHRDLKTSNILLDSEMNPKISDFGLARIFTGDQVEAKTKRVMGTYGYMSPEYAVHGSFSVKSDVFSFGVIVLEIISGKKIGRFCDPHHHRNLLSHSSNFAVFLIKALRICMFENVKNRKAWRLWIEERPLELVDELLDGLAIPTEILRYIHIAL

SEQ ID NO: 6339 - protein, 145 aa, Brassica napus
THASNSPMMNGSVATENGGEGSSLIFLGTGCSSAVPNAMCLIQKSDPPCYVCSQSLSIPPERNPNYRGNTSLLIDYCQSDGKHKYIQIDVGKTFREQVLRWFTLHNIPQVDSIILTHEHADAVLGLDDIRSVQPFSPTNDIDSTP

SEQ ID NO: 6340 - protein, 211 aa, Triticum aestivum
  misc_feature (173)..(173): Xaa can be any naturally occurring amino acid
  misc_feature (180)..(180): Xaa can be any naturally occurring amino acid
  misc_feature (199)..(199): Xaa can be any naturally occurring amino acid
  unsure (1)..(211): unsure at all Xaa locations
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENXAMLVERXNVNLPGVVGDLPTLPEKDXEDILSWGWSRTR

SEQ ID NO: 6341 - protein, 403 aa, Dehalococcoides sp. BAV1
MPNARVEEAIADIKAGRFVIVVDDYDRENEGDLVMASEKVTPDAINFMAKNARGLICVSLIAERLEQLKIPMMVTENTSPYSTGFTVTVEARKKVTTGISAADRAVTVQVLIDPAATREDIAMPGHMFPLRAREGGVLVRAGHTEASMDLARMSGLYPSGVLCEIMNDDGTMARLPQLEQKAAEWGIKIISIKDIISYRRRTEKMVKKVTEAELPTSHGQFKAVAYKSQFDADEHIALVMGDISGPEPVLVRVHSECITGDVFGSKRCDCGEQLDMALNQIAQAGRGVLLYMRQEGRGIGLHNKLCAYALQDKGLDTVEANLELGFAPDLREYGIGAQILVDLGLSKIRMLTNNPKKVVGLEGYGIKVVETVPIIVEPNSFNRHYLETKQRKMGHILNVDKAN

SEQ ID NO: 6342 - protein, 254 aa, Oemleria cerasiformis
SEADVGQAFAEAFKTGLVKREELFITSKANHGHVVEACKNSLKKLQLDYLDLYLVHYPLATKHSGVGTTASLLDENKVLDIDVTVSLEETWRGMEKAVSLGLTRSIGLSNYELFLTRDCLSYAKIKPAVSQFETHPYFQRESLVRFCQKHGVVATAHTPLGGATANTKYFGSISPLGDPVLHDVAKKYQKSVAQICLRWNIERNTPVIPKSSKVERLKENLQVLEFKLEKEDIELINGIDKKSRSTLPSLSWGL

SEQ ID NO: 6343 - protein, 328 aa, Yarrowia lipolytica CLIB122
MGNNPNEVIQRLLDAGYSGKITKAVCLKNSEIALICRRARSILLSQPTLLELLPPVKIVGDVHGQFGDLIRMFDMCGFPPAANYLFLGDYVDRGKQSLETILLLLCYKIKYPENFFILRGNHECAKVTRVYGFYDECKRRCNIKTWKTFVDTFNTLPIAAVVAQKIFCVHGGLSPSLSSMSEIRSIVRPTDVPDYGLINDLLWSDPADTQNEWEDNERGVSYCFSKVAINKFLTKFSFDLVCRAHMVVEDGYEFFNDRSLVTVFSAPNYCGEFDNWGAVMSVSEELLCSFELLKPLDSAALKQEMKKGKHQRRLSLETRSAPATPQSV

SEQ ID NO: 6344 - protein, 264 aa, Sorbus aucuparia
AHYKSEADVGEALTEAFKTGLVKREELFITTKIWNSDHGHVVEACKNSLEKLQLDYLDLYLVHYPMPTRHNAIGKTASLLGEDKVLDIDVTVSLQQTWEGMEKAVSLGLVRSIGLSNYDLFLTRDCLAYSKIKPAVSQFETHPYFQRDSLIKFCIKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVS

SEQ ID NO: 6345 - protein, 265 aa, Kageneckia oblonga
AHYKSEADVGEALAEAFKSGLVKREELFITTKIWNSDHRYVAEACKNSLEKLQLQYLDLYLVHYPLPTRHNAIGKTASLLGEDKVLDIDVTIPLQQTWEGMEKTVALGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDKKYRTSLPSKTWGLDVYA

SEQ ID NO: 6346 - protein, 311 aa, Zea mays
  misc_feature (191)..(191): Xaa can be any naturally occurring amino acid
  unsure (1)..(311): unsure at all Xaa locations
MEAAAIPTSAPETRIAVVTGGNKGIGLEVCRQLAGAGATVVVLTARDETRGAAAAQELRESGLSDVIFHQLDITDAASVSRLAEFLKARFGKLDILVNNAAVGAVEYVQDPADSSTSEEELSGMDMVQRLQCMFKRVRETYDAATQGIKTNYYGIKHVIEALLPLLQASSDGRIVNVSSDFGLLRLINNEXLRQELNDVEKLTEERLDEVLAAYLRDFDAGEVGARGWPVDFSAYKVAKVAMNAYTRILARSHPGLRVNCAHPGYVSTDMTVHTGPLTPEQGAANVVKVALLPEGGPTGAYFALGEEASFV

SEQ ID NO: 6347 - protein, 174 aa, Zea mays
PSSNSVAVGASYVRSTAHERRTHASPPPPTPSSSPHPSLRRRAMTTTTLPCAGAAAAFLLLVLFSSAAVSLATAAGRESKQGQQAAGASVYVVMVKPPAEGVDSKAYQMGILAAALGSEEKAKQALIYSYKAAASGFAAKLTPAQVAALQEHPDVLQALPDVKYTLQDSNHLNR

SEQ ID NO: 6348 - protein, 265 aa, Vauquelinia californica
AHYKSEADVGEALAEAFKTGLVKREELFITTKIWNSDHGHVVEACKNSLEKLQLDYLDLYLVHYPMPTRHNAIGKTASLLGEDKVLDIDVTISLHTTWEGMKKAVSLGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLKFQLSDEDMQLIHGIDRKYRTSLPSKTWGLDVYA

SEQ ID NO: 6349 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTISLQQTWEGMEKAVTLGLVRNMGLSNYDLFLTRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 6350 - protein, 351 aa, Propionibacterium acnes KPA171202
MKAALVEQYHEPLAIRDIPEPAHDSDGVVVEVKACGVCRSDWHGWQGEWPGFTGGSLPHIFGHEFVGLVSDIGNNVSRYRVGDRVIVPFTLGCGHCEYCRSGHSNVCPTVSMPGFSYDGGFAQYVTVPDADANLVKLPDAVDFTDAAGMGCRLMTAYHGIVEVGQIHPGDWLVVYGAGGVGLSATLVATSAGANVIAVDIADDKLALARKVGAIATINSRETDPVEAVRELTDGGADKSVDALGISETLHNAVNSLRSRGTHIQIGMTAEGPVGDVALTINDLIAKEIDFRGSFGMPAVEFRYLLNQVAAGKMKPGQLVTKTIALSEVNDALTAMSTYNTVGTTVITDFTR

SEQ ID NO: 6351 - protein, 470 aa, Salmonella typhimurium
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKCICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 6352 - protein, 366 aa, Acidovorax sp. JS42
MTAMMKAAVFVEKGRIELADKPIPDVGPNDALVRITTTTICGTDVHILKGEYPVAKGLTVGHEPVGVIEKLGSAVQGYQEGQRVIAGAICPNFNSYAAQDGYPSQDGSYLVPRGLCGCHGYKATAGWRFGNLIDGTQAEYVLVPDAQANLAPIPDGLTDEQVLMCPDIMSTGFKGAENANIKIGDTVVVFAQGPIGLCATAGARLLGATTIIAVDGNDDRLAVAKKMGADVTLNFRNVDVVEEVMKLTGGKGADGSIEALGTQATFAQAMKVLKPGGTLSSLGVYSEDLSIPLAQFAAGLGDHTIRTALCPGGKERMRRLMNVIAANRLDLGLLVTHQRKLDDIVEAYDLFAHQRDGVLKIAIKPH

SEQ ID NO: 6353 - protein, 603 aa, Xanthomonas campestris pv. campestris str. ATCC 33913
MHSGGLELALVLMLAAIVAVPVFKRFGLGAVLAYLVAGVVLGPDGVGVVQDAERISGAAEIGVVMLLFVIGLELSPARLKVMRHSVFGAGTTQVVMTALILGGLLMAGQLGWKTSLIVGVALALSSTAVGLQLLAERKALGSDYGRLAFAILLFQDLIAIPLLAAIPLLGGSKNATLDWQEVAKALVALTLVILCGRFVLRHLFNVVARTRMPEVFTASALLVVLGTAWIMQEAGLSASLGAFIAGVLLADSEFRHELESQIEPFEGLLLGLFFISVGMGIDLDRVVSEPWLIAAGVGILLLVKFALLVGIGTVAKLPLRSSLMLGGVLWLGGEFAFVVFNEADRVGLLDAANHDRLVAIVGVSMALTPLLLLGIQRALNGPLRIKVPKSERPYDTIDTQTPKVLIAGMGRFGQVIARLLTARHVPFVALEHNPDTVEDLRRFGSQLYYGDPTRPELLRAAGAERIKVFVIAVDDPDTNIKTVRLIRRLYPNATVLARARNRQHAWKLMDLGAEPFREVFASSLELGGRVLTSLGLGEADAQEHVTRFRHHDEDLLRRQHLVYDDEAKVIQTSRDAREDLMHLFEADVKAEVDPEPAPVTPER

SEQ ID NO: 6354 - protein, 629 aa, Cocos nucifera
MAVLERDVMVPWFLWLILVFHPLARVLANSEGDALHSLRTNLIDPSNVLQSWDPTLVNPCTWFHVTCNNDNSVIRVDLGNAQLSGTLVPQLGLLKNLQYLELYSNNISGTIPSDLGNLTNLVSLDLYLNSFTGGIPDTLGKLTKLRFLRLNNNSLSGSIPQSLTNITALQVLDLSNNNLSGEVPSTGSFSLFTPISFANNPQLCGPGTTKACPGAPPLSPPPPFISPAPPSSQGSSASSTGAIAGGVAAGAALLFAAPAIGFAWWRRRKPQEHFFDVPAEEDPEVHLGQLKRFSLRELQVATDNFSTKNILGRGGFGKVYKGRLADGSLVAVKRLKEERTPGGELQFQTEVEMISMAVHRNLLRLRGFCMTPTERLLVYPYMANGSVASCLRERPPSEPPLDWTTRRRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLDMLVDPDLQDDYVEAEVESLIQVTLLCTQGSPMERPKMSEVVRMLEGDGLAERWEEWQKVEVVRLDVEMAPPNGNNEWIIDSTDNLHAVELSGPR

SEQ ID NO: 6355 - protein, 561 aa, Uromyces viciae-fabae
MILIQKKDQKNDSFRIEDELEKHANQAYYESTEVNASSSPTGDGAVGENTVHRALEQRHISMIAIGGTIGTGLFLGMGEALNKGGPLGLILGYMVMGLVVYAMTIALGEMVTMFPVSGSFTHYPCRFVDPALGFAVGWNYWYSLTIAVPSEVIAATIVVEYWKAPVNKVVWIITFIVLSCGINFFGVRWYGETEFAFAAVKVVAIIVLILVGIVIDIGGGPTHERIGFRHFIDPGPFNQLHGIPGALGRFLAFWSVFTQASFSYMGTEMVAITAGEAANPRKTVPKAIERVFYRILVFYLGSTLVVGLLVPYSSPQLLGSTGDASSSPFVIAINRAGITVLPDMINVVILLSAISTASSKLYGGSRVLYGLSKDGMAPRFFSKCNASGLPMWSLLATSSTAALSFMCLNSKAGVAFQWFQNLSAMTGILTWWTVLVSYVLFYQGLKVQGLSRDKLHYKAPFQPYASWIALAMLTLIMFMSGFETFLKGGWSISDFLANYLTLPIFLGFYLYWKISTRSKFVSSKHVDFVTGTRELNEMDAQEREKEIIPTTKWGKFIDKLL

SEQ ID NO: 6356 - protein, 223 aa, Gibberella zeae PH-1
MWGWFGGAAAQKRKDTPKNAILGLRAQLDMLQKRERHLQNQIDEQDGIARKNVSTNKNAAKAALRRKKTHEHSLDQTVSQIGTLEQQINAIESANINKETLAAMSDANAAMKHIHKGLTADKVDAIMDELREQNAMSDEIVNAITQTPMGDAIDDDELENELDELQQEQLDEQMLKTGTVPVSDAVHKLPTPASAEPVSSKKQAVEEDDEEAELRKLQAEMAM

SEQ ID NO: 6357 - protein, 611 aa, Candida glabrata
MENKEHHHHHHHHHHHHSNGSYVSNKVSSLADGSRVGNYQIVKTLGEGSFGKVKLAYHVTTGQKVALKSINKKVLAKSDMQGRIDREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISIPTSLPQIHRANMLAQGLPAASKISPLVTKKSKTRWHFGIRSRSYPLDVMGHIYIALKNLGAEWANPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 6358 - protein, 446 aa, Nocardia farcinica IFM 10152
MDRQKEFVLRTLEERDIRFVRLWFTDVLGYLKSVAIAPAELEGAFEEGIGFDGSAIEGFARVSEADMVARPDPSTFQVLPWATSKGHQHSARMFCDITMPDGSPSWADPRHVLRRQLNKAGDVGFSCYVHPEIEFFLLENGPQDGSPPRPADSGGFFDQAVHDAAPNFRRHAIDALESMGISVEFSHHEGAPGQQEIDLRYADALSMADNVMTFRYLIKEVAIDEGVRATFMPKPFAEWPGSAMHTHMSLFEGETNAFADPDDPDNLSATARAFIAGILEHASEISAITNQWVNSYKRLIHGGEAPTAASWGRSNRSALVRVPMYTPNKASSRRVEIRSPDSACNPYLTFAVLLAAGMRGIEKGYTLPPEAEDDVWSLTSAERRAMGFRELPGTLDEALQAMERSELVAETLGEHVFDFFLRNKRREWADYRSQVTPFELREYLGL

SEQ ID NO: 6359 - protein, 326 aa, Zea mays
MLPPTQPLTITIAASLHHQLPIAAPAPPHLPTLLTSPLRTAAPPLPPPTRAPMAATAISVRLHPTAARHVASARRARLGAVRAQSAPAAAAAALTQDDLKRLAAVRAVEQVKSGMVLGLGTGSTAAFAVAEIGALLAAGKLEKIVGVPTSKRTFEQAQSLGIPLSTLDDNPLIDLAIDGADEVDPDLNLVKGRGGALLREKMVEAASDKFIVIVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 6360 - protein, 364 aa, Clostridium perfringens str. 13
MGEVMDIIGSINTRFLSKSEQSKKEIFNKIDNIVKGGGNIIRMNLSHGKHRDVECCIDYIRSNHKNVKILLDLQGNKIRVANNIYGTFKVNSGDLVYFCSEETYDAYLKNIDRNKLIPLNIKNKFIYNNTFKKIYMKDATMEFIVISNNNGLIKTKVKLGGVVRKEKGCNLPNLDRKNWGVSEKDLEDIKFAIDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKRV

SEQ ID NO: 6361 - protein, 197 aa, Magnetospirillum magnetotacticum MS-1
MPARIQPVILCGGSGTRLWPTSRTSLPKQFVPLLGPHSTFQQTLLRLQSPLFARPIIVANRDHRHLVEKQAAAIDAPISLLLEPERRDSGPAILAACTLVAQDEPEAVVLVLPSDHIVTEPRAFRRAVASALPAARAGRLVTFGIEADHASTEYGWIRPGERVEARCHAVCKFAEKPTRCGRPPTCRTGGCGIPATS

SEQ ID NO: 6362 - protein, 471 aa, Bacillus cereus ATCC 10987
  misc_feature (25)..(25): Xaa can be any naturally occurring amino acid
  unsure (1)..(471): unsure at all Xaa locations
MKQIFQKKPIAKLMQESKQKTLARXLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLKGFGIHIPTILSSAPGTGKGGIIDLPAVLIILVMTVLLSRGVRESARVNNIMVFIKLAVVLIFIFAGFNYVKPENWTPFMPFGLDGVMAGAATVFFAFIGFDAVSTAAEEVKRPQRDLPIGIIASLLICTALYIIVSLILTGIVPYGQLNISDPVAFALQFIGQDSLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGVWMIIGIAVYFLYSRKHSALNNSKEEDDAANL

SEQ ID NO: 6363 - protein, 93 aa, Salmonella enterica subsp. enterica serovar Typhi
MAKMAAALHILVKEEKLALDLLEQIKNGGDFEKLAKKHSICPSGKKGGHLGEFRQGQMVPAFDKVVFSCPVLEPTGPLHTQFGYHIIKVLYRK

SEQ ID NO: 6364 - protein, 534 aa, Porphyra yezoensis
MKKKIVHPIVLAILDGWGHTNIQQGNAIKIAKTPTIDSLIQAYPSTLLAASGQEVGLPKGQMGNSEVGHTTIGGGRVIQQELVKIGNSIVDNSFFNNLELNEACEYANNNKASLHLIGLCSNGGVHSHIDHLLALIDLADSKQVTNLYLHLITDGRDTSSNSAKYFIKIVADHIEHKQFATISTISGRYYAMDRDFRWSRTQAAYNILTSNNSIKLNASVNYGDLIDHYYNKGISDEFIPPSRINLGSIKDNDAIVFFNFRPDRMRQIVQAFVQKPFNCFATKPLYNLRVVTFTNYDTSLNTTIAFHPHILNNFLGEVLYKYGLKQFRVSETEKYAHVTYFFNGGAEEPFPGEDRELVSSPDVTTYDLSPDMSAELVTQKSISAIKKAIYSCIVINYANADMLGHTGKLKETIQSIETVDRCITELLDAVSKLNGTLIITADHGNAECMFTDEGNPCTAHTTNLVPLILIEGEQEAISGHGGQVKLRNNGSLADIAPTILDILHLKKPPEMTGKSLIINSRYETRNIEKTSIEL

SEQ ID NO: 6365 - protein, 249 aa, Pseudoalteromonas tunicata D2
MKLRKQMVAGNWKMNGSVELVNQIANAISAVELDKVDVVVFPPYPLLNNALQNELVVGAQSVSEHEAGAYTGEIDAQLLAELGCKYTLVGHSERRSIYGESDEVVASKFQRAQCQGLIPVLCVGESEQEREQNLTESVVSRQIDAVINKLGVVSLVKSVIAYEPVWAIGTGKTATPEQAQQVHKFIRDKIASLDDAVSQSLILLYGGSVNEKNSELLFAQPDIDGGLVGGASLNPDSFVNICKSAQGNV

SEQ ID NO: 6366 - protein, 105 aa, Zea mays
THRRRGGEEAMGVTKEDVEAAITSALSPSNLVVTDTSGGCGASYEIEVVSEKFEGKRLLERHRMVNTALASHMAEIHAVSIKKALTPAQAQPQAQPEPAADKPQA

SEQ ID NO: 6367 - protein, 695 aa, Oryza sativa (japonica cultivar-group)
MANSKRLPYSTAGGGGGGGGGGGRRGGASGSGVVAPLVVLVFLFVLAPSIFFVARNGGHVHVASDPKDREGNQETDWQKQLATNNLKSILSKEMIDALASSQQEAGTLSVDFFRKRASPSWKTDDLVNDLSNASLDVDDKVKSENSSAEHELSLTDKTPKDDTAEHQVDAPAKNARRKLREKRREKRAMDLVRKDDEARVKLENAAIERSKAVDSAVLGKYSIWRKENENENSDSTVRLMRDQIIMARVYSVLAKSKNKNDLYQELQTRIKESQRAVGEATADSDLHHSAPEKVRVMGQLLSKAREDVYDCKAVTQRLRAMLQSADEQVRSLKKQSTFLSQLAAKTIPNSIHCLSMRLTIDYYLLPLEKRKFPRSENLENPELYHYALFSDNVLAASVVVNSTIMNAKEPEKHVFHLVTDKLNFGAMNMWFLLNPPGKATIHVENVDEFKWLNSSYCPVLRQLESAAMKEYYFKADRPTTLSAGSSNLKYRNPKYLSMLNHLRFYLPQVYPKLDKILFLDDDIVVQKDLTGLWDVDLNGKVNGAVETCGESFHRFDKYLNFSNPHIARNFDPNACGWAYGMNIFDLKEWKKKDITGIYHKWQSMNEDRVLWKLGTLPPGLLTFYKLTHPLDKSWHVLGLGYNPSIDRSEIDNAAVVHYNGNMKPWLELAMTKYRPYWTRYIKYDHPYIRGCNLAE

SEQ ID NO: 6368 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTNFLQQTWEGMEKAATLGLIRNIGLSNYDLFLIRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 6369 - protein, 478 aa, Bradyrhizobium japonicum USDA 110
MTFVARHALWSDEQKDAAQRMRRIVEEKNLEVIRLAFPDQHGILRGKTIIAAEAIASLESGCSITTTMLAKDTSHRTVFPVFTSGGGFGMKEMEGAADVLMVADPTTFRVLPWAPTTGWVLCDLHFNDGRPVPFATRGLYRKVLDELAGRGHDFVAGLEVEFHIFKLDDPHMRAEDAGQPGTPPSVSLLSHGYQYLTEQRFDQMEPVLEILRRDVVALGLPLRSVEVEFGPSQCEFTFAPRKGLEPADNMVLFRSAVKQIARRHGYHATFMCRPKLPNLFASGWHLHQSIVSRTSGENQFMAQAGGEPLSAFGRAYLAGLLDHARASAVFTTPTINGYKRYRSYSLAPDRAIWGRDNRGVMIRVLGAAGDAATRLENRIGEPAANPYLYMASQILSGLDGVDRKLDPGPSADTPYETKAPLLPKSLRDAVAALKEDPFFREKFGAEFVDYYTHIKNAEIDRFLAEVTDWEHREYFEMF

SEQ ID NO: 6370 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRSKGVDAQVASGGGRMYVTMDRYENDWSVVKRGWDAQVLGEAPHKFKSALEAVKTLRAEPGANDQYLPPFVIVDDSGKAVGPIVDGDAVVTFNFRADLMVMHAKALEYKDFDKFDRVRVPDIRYAGMLQYDGELKLPSHYLVSPPLIDRTSGEYLAHNGVRTFACSETVKFGHVTFFWNGNRSGYFNEKLEEYVEIPSDSGISFNVQPKMKALEIAEKARNAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 6371 - protein, 355 aa, Oryza sativa
RPRNAAFLAPLRTSSAVCTKAVSNSDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 6372 - protein, 265 aa, Gillenia stipulata
AHYKSEADVGEVLAEAFKTGLVKREELFITTKIWNSDHGHVVEACKNSLEKLQLDYLDLYLVHYPMPTKHNGVGKTASLLGEDKVLDIDVTISLQQTWEGMEKTVSLGLVRSIGLSNYELFLTRDCLAYSKIKPAVSQFETHPYFQRDSLVKFCLKHGVLPTAHTPLGGAAANKDMFGSVSPLDDPVLNDVANKYGKSVAQICLRWGIQRKTAVIPKSSKIQRLKENLEVLEFQLSEEDMQLIYSIDRKYRISLPSKTWGLDVYA

SEQ ID NO: 6373 - protein, 102 aa, Triticum aestivum
EPGTPQPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 6374 - protein, 528 aa, Mycobacterium tuberculosis CDC1551
MSLPVVLIADKLAPSTVAALGDQVEVRWVDGPDRDKLLAAVPEADALLVRSATTVDAEVLAAAPKLKIVARAGVGLDNVDVDAATARGVLVVNAPTSNIHSAAEHALALLLAASRQIPAADASLREHTWKRSSFSGTEIFGKTVGVVGLGRIGQLVAQRIAAFGAYVVAYDPYVSPARAAQLGIELLSLDDLLARADFISVHLPKTPETAGLIDKEALAKTKPGVIIVNAARGGLVDEAALADAITGGHVRAAGLDVFATEPCTDSPLFELAQVVVTPHLGASTAEAQDRAGTDVAESVRLALAGEFVPDAVNVGGGVVNEEVAPWLDLVRKLGVLAGVLSDELPVSLSVQVRGELAAEEVEVLRLSALRGLFSAVIEDAVTFVNAPALAAERGVTAEICKASESPNHRSVVDVRAVGADGSVVTVSGTLYGPQLSQKIVQINGRHFDLRAQGINLIIHYVDRPGALGKIGTLLGTAGVNIQAAQLSEDAEGPGATILLRLDQDVPDDVRTAIAAAVDAYKLEVVDLS

SEQ ID NO: 6375 - protein, 166 aa, Triticum aestivum
  misc_feature (92)..(92): Xaa can be any naturally occurring amino acid
  misc_feature (102)..(102): Xaa can be any naturally occurring amino acid
  misc_feature (116)..(116): Xaa can be any naturally occurring amino acid
  misc_feature (146)..(146): Xaa can be any naturally occurring amino acid
  misc_feature (148)..(148): Xaa can be any naturally occurring amino acid
  unsure (1)..(166): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREXHNASPGYYDGRYWXTMWKLPMFGCTDATQVINEVEEVKKEYPDXYXRIIGFDNIRQVQCVSSSP

SEQ ID NO: 6376 - protein, 478 aa, Brucella suis 1330
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVVTDDAHDLEDMVNHACEIVFHEEFGKAGDRVIITAGVPFGTPGATNMLRIAYIGADGKSGI

SEQ ID NO: 6377 - protein, 478 aa, Nocardia farcinica IFM 10152
MTFSTADEVIQYIKEQDIEYIDIRFSDLPGVQQHFSIPAKAFTADLAEEGLAFDGSSVRGFQSIDESDMLLLPDYSTARIDPFRAAKTLNMNFFVHDPFTREAYSRDPRNIARKAEEYLRSTGIADTAFFGPEAEFYIFDSIRYESNMNGAFYEIESISGSWNTGAEFNPDGTLNRGYKVRNKGGYFPVAPYDHYVDLRDKISTKLQDAGFELERGHHEVGTAGQAEINYRFNTLLHAADDLQLFKYIVKNTAWQEGKTVTFMPKPLFGDNGSGMHVHQSLWKDGKPLFHDEAGYGGLSDLARHYIGGILHHAPSLLAFTNPTVNSYHRLVPGYEAPINLVYSQRNRSAAVRIPVTGNNPKAKRIEFRAPDSSGNPYLAFAAMLMAGLDGIKKKIEPLAPVDKDLYELPPEEAKNIPQAPTSLASVIDRLEQDHEYLTEGNVFTEDLIETWIQLKRDNEIAPVNLRPHPYEFELYFDV

SEQ ID NO: 6378 - protein, 413 aa, Xanthomonas axonopodis pv. citri str. 306
MSPKKTSFPKQDIRVLLLEGISPTAVDVFRAAGYSQIELHAKSLPEDELIARIADAHIVGIRSRTQLSADVLAHAKRLIAVGCFCIGTNQVDLDAAELAGIPVFNAPYSNTRSVAELVIAEAILLLRGIPQKNAQCHRGGWSKSAAGSHETRGKVLGIVGYGHIGTQVGVLAESLGMQVIFHDIETKLSLGNARAAIDLDDLLARADVVTLHVPETPSTKDMIGAPEIARMKPGAHLINASRGTVIDIDALDAALTSGQIGGAAVDVFPIEPKGNGDAFESPLTAHDNVILTPHVGGSTLEAQDNIGIEVAAKLVRYSDNGSTLSAVNFPEVTLPEHAESLRLLHIHRNVPGVLSQINELFSRHNVNIDGQFLRTDPKVGYVVIDVGASEELAGVLKDELGQITGTLRTRILY

SEQ ID NO: 6379 - protein, 568 aa, Debaryomyces hansenii CBS767
MAEKRLFKEYNQLKKTPAHEANPQIVSLLPVDMSNILEWEAVVSKPDKSGSRYYYNGKWRLNITVPTTYPLTPPKIEFDKSTPICHPNINIDTGEICLDILKQEGWSPAWNLQYLVVAILMLIDDPEPDSPLNIDLANLFRQDKTAFESVVQYYMWKYDTFCTSDGGDKDITGVKGKGVEIVVESDLDIESMEVSNDASKAIHEIKNQAQEIVNETNSVLVGSPSHDENHTFSYRLTRPIVPTDTQSDIKSKLDLKLSKIDSLKDRLNMAKSLESTGTDQHVPNYKVIHDVGEEVTKQFIAKVDEIGHSSSSSQGSIEDPHADDDLQGVKQKVTANVTKQVEILCLKSVSPDTTEFQESIKNNNNTNYGNGELERVRQNFMRQVDDKIKKHEEYIRRLQSNSPSPANPLYETQMNQTSKLEPYLSSTSNRPRSPLVETYSQEKHTISEPEGGFIDNYDIEGHTHKNAPIAQQPESGNLRSETPPPRKSSSSAGLSATPKSVLSQELDAGVDTPLQRTDSGSSTRSSFSSLKKSLSRKNSKSKTSSQDDSDISKKKRFLNLLKSKPGDR

SEQ ID NO: 6380 - protein, 185 aa, Arabidopsis thaliana
  misc_feature (21)..(21): Xaa can be any naturally occurring amino acid
  misc_feature (107)..(107): Xaa can be any naturally occurring amino acid
  misc_feature (140)..(140): Xaa can be any naturally occurring amino acid
  misc_feature (152)..(152): Xaa can be any naturally occurring amino acid
  unsure (1)..(185): unsure at all Xaa locations
MVSSMLSSADVDTSPAQATMXINCTGLNSSAAFPGTRRTNKDITSIAYNGGICSCMNVWPPIGKITFETLSYLPDLSDVELAKEVDYLLRNKWIPCVEFELQHGFVXREHGNTPGYYYGRYWTMCKLPLFGCTDSAQVLXEVEDCQKEPPGXFLRIIGFDHTRKVQWISSIAYKPPSYTEAKFLF

SEQ ID NO: 6381 - protein, 248 aa, Saccharomyces cerevisiae
  misc_feature (168)..(168): Xaa can be any naturally occurring amino acid
  unsure (1)..(248): unsure at all Xaa locations
MARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 6382 - protein, 358 aa, Ustilago maydis 521
MGRAEAGSLKAISNAIKAKGLTKLRFYCQLCQKACRDENGYRSHLESEAHFRQVDALAASGGAQKVIDGFSATFQKEFVQLLSRRFGTRRIRANQVYQEYIADRHHTHMNATQWTSLSDFVKHLGREGVVQAEDTDQGWYITWIDNSPAALARQDALQKMERAKMDDEQRQRRLLQEQIDRASQVSSAAVTSSASSAAHSRDTQNCEGLQRTGTGPIRIGLSLGPIAKKTGPKAEDITAEEGTSGCSSTVPISGVSTTTVTPAEASSPTPAKMGFTVLKSTSRPANPLKQASQARRNGPLNSMAQISSSTGKSKPPNSMTMAEKIMHEELERKKRKANPSLERSTGPKMQPGMKRSRF

SEQ ID NO: 6383 - protein, 402 aa, Solibacter usitatus Ellin6076
MHATAMVVGIIIGASIFVQPSEINRHVPTIPGVLSVWTVAGILTLFGALVCAQLSTVFPRTGGVYVFLKETLSPAFGFLWGWAMFWSAHSGIIAASSVVLARYVAYFVPLGDTGIRAVAIAGILVLSFVNYLGVRQGSLLQTIVTATKLVAILLLLILVLLWGKPAGLSSAPPAPAAPFREFVLAVSAALFAFGGWHMVTYTAGETRDPVRNIPRALLIGTLTVTGVYLLLNAAYLYLLPIDRVIASTRVAADAAQAVAGPPGASLISALVILSATGVLNGVILAGPRTYYAMAREKLAFQWLGSMRHAIVLQAAWSCILVATGTYRALFTRVIYTEWLFFALMAIGLMRLRRRIAFVPAVFAFAAVVVAVIQIAADPLQAGTGLLIVVLGLPVYHYWHAHH

SEQ ID NO: 6384 - protein, 325 aa, Schizosaccharomyces pombe
MSIKEFAKNAREAYFTLPNGDKIPSIGLGTWRSGKDETKNAVCAALKAGYRHIDTAHIYGNEKEIGEGIRESGVPRTDIWVTSKLWCNAHRAGLVPLALEKTLQDLNLEYIDAYLIHWPFALLSGPEELPRNEKGELIYEDVPIEETWQAMEELLETGKVRYIGISNFNNEYLDRVLKIAKVKPTIHQMELHPYLPQTEYLEKHKKLQIHVSAYSPLANQNDAYNSDISKLIEHKTLVDIANARGEGITPANIAISWAVKRGTSVLPKSVNESRIVSNFLYIPLTDKEMEAINNIGVVRRFSHGKFAPKPMFVGLQDGTPKQTHA

SEQ ID NO: 6385 - protein, 401 aa, Zea mays
MCRNHPACLPKRISATSKGVWKAAALSARPLTSRSEKSAASPRASEAHTTMQGGSSGIVYGGLKYQARCIADVRADASSTTFLAGTLSLKEENEVHLIRLSPAESELVCDGVFYHPNEIWDLKSCPFDHRVFSTVYTSGEGFGASVWKIPELNGQSNSPQLEQLFELSGHTGKIRRVIWWPLGKHDKLISIDDRNIFLWNVDMSNKSAKVISQGSADMLPNLSGGAWDPHNHNSIASISDSSLHLWDLRSMEKSSAIEHAHIRDVDYNPKKQHIIATTEDDFGIRLWDLRMLKLPLKDLPGHSHWTWAIQHNPEYDELLLSAGTDSTVNLWLAKVSNNDSEPDSPSGSPNRQEEPLLNSYTDYEDSIYGIAWSSHDPSLFASLSYDGRVVLESVKPYLQRK

SEQ ID NO: 6386 - protein, 506 aa, Wolbachia endosymbiont of Drosophila melanogaster
MNIKSVVLCILDGWGNGIENNKYNAISNANPPCWQYISSNYPKCSLSACGADVGLPGGQIGNSEVGHMNIGSGRVVIQSLQRINQEIGTIENNVNLQSFINDLKSKNGVCHIMGLVSDGGVHSHQKHISTLANKISQHGIKVVIHAFLDGRDTLPNSGKKCIQEFTKSIKGNDTRIATVSGRYYAMDRDNRWKRTIEAYEAIAFAKAPCHDNAVSLIENNYQNNITDEFIRPAVIGDYQGIKPEDGVLLANFRADRMIQLASILLGKTDYAKVAKFSSILSMMKYKEDLKIPYIFPPTSFADTLGQTIEDNKLRQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLNAVKKSSNTALIVTADHGNVECMFDEENNTPHTAHTLNKVPFIVSCDNLKLRDGRLSDIAPTILQLLGIKKPNEMTGSSLISCITLCHSS

SEQ ID NO: 6387 - protein, 467 aa, Staphylococcus epidermidis ATCC 12228
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 6388 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 6389 - protein, 351 aa, Streptococcus agalactiae NEM316
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGAIGLSALLTAQFYSPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 6390 - protein, 423 aa, Xanthomonas campestris pv. campestris str. ATCC 33913
MSTAPQKPLAIRERLSEVRYEIRGELARRARELEAQGRKLIKLNIGNPGAFGFRAPEHLQRAIADDMGRTDPYTHQQGLPEAREAIAAAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIAVKHNLLLMVDEIYDQVLYDGAAFVPVAPLAGEHPCITFSGLSKVHRACGWRVGWALLSGEQSRINDLRNAMDLLGALRLCANVPGQYAIDAAVNGPDTISALCAPGGRLYETRRAVIEACAASSHLSLVAPAGALYAFPAVVGPAARAFDDHTFALDLMNDEGVLVVPGSSFNVPYRHHFRVTLMPEAAVMRDVFARIDRALTRRAEAVTKVVPLKSRSVA

SEQ ID NO: 6391 - protein, 758 aa, Arabidopsis thaliana
  misc_feature (220)..(220): Xaa can be any naturally occurring amino acid
  unsure (1)..(758): unsure at all Xaa locations
MAVSLPLFQFILFLLLLLLSRTVYAYLIGVGSYDITGPAADVNMMGYANSDQIASGIHFRLRARAFIVAEPQGNRVVFVNLDACMASQIVTIKVLERLKARYGELYTEKNVAISGIHTHAGPGGYLQYVTYIVTSLGFVRQSFDVVVNGIEQSIVQAHESLRPGSAFVNKGDLLDAGVNRSPSSYLNNPAAERSKYKYDVDKEMTLVKFVDSQLGPTGSXFNWFATHGTSMSRTNSLISGDNKGAAARFMEDWFENGQKNSVSSRNIPRRVSTIVSDFSRNQSRLLDIAATYKSSRGHSVDKSLDVKTRVRNGSKRKFVSAFCQSNCGDVSPNTLGTFCIDTGLPCDFNHSTCNGQNELCYGRGPGYPDEFESTRIIGEKQFKMAVELFNKATEKLQGKIGYQHAYLDFSNLDVTVPKAGGGSETVKTCPAAMGFGFAAGTTDGPGAFDFKQGDDQGNVFWRLVRNVLRTPGPEQVQCQKPKPILLDTGEMKEPYDWAPSILPIQILRIGQLVILSVPGEFTTMAGRRLRDAIKSFLISSDPKEFSNNMHVVIAGLTNTYSQYIATFEEYEVQRYEGASTLYGRHTLTAYIQEFKKLATALVNGLTLPRGPQPPDLLDKQISLLSPVVVDSTPLGVKFGDVKADVPPKSTFRRGQQVNATFWSGCPRNDLMTEGSFAVVETLREGGKWAPVYDDDDFSLKFKWSRPAKLSSESQATIEWRVPESAVAGVYRIRHYGASKSLFGSISSFSGSSSAFVVV

SEQ ID NO: 6392 - protein, 478 aa, Acidovorax sp. JS42
MTYPDTRLFIAGQWQDAESGKTIAVHNPATGQEIGRVAHAGIADLDRALAAAQKGFEVWRDTPAIERAKTMRRAAALMRERADAIAAILTQEQGKPRAEARVEAMAAADIIEWFADEGMRVYGRIVPSRNLAVRQMVVKDPVGVVAAFTPWNFPINQVVRKLGAALAAGCAVLVKAPEETPASPAELIRAFADAGVPAGAVGLVYGNPAEISNYLIPHPIVRKVTFTGSTPVGKQLAGLAGQHMKRVTMELGGHAPVIVCEDADIELAVKASGGAKFRNAGQVCISPTRFLVHESVRADFVAALTRHAQGLKVGDGLAEGTQMGPLANPRRVAAMADLLADAVQQGATVRTGGERLGEVGNFFAPTVLDNVPTHARIFNEEPFGPVAAVQGFTQLEAAIAEANRLAYGLAGYAFTRSLKNAHLLSQRVEVGMLWINQPATPSAELPFGGIKDSGYGSEGGPEALEACLNTRAISITHV

SEQ ID NO: 6393 - protein, 141 aa, Xylella fastidiosa Temecula1
MVLERTLSIIKPDAVAKNVIGDIYSRFEKAGLKIVAAKYKQLSRREAEGFYAVHRDRPFFNALVEFMISGPVMIQVLESENAVARHRELLGATNPKDAAPGTIRADFAESIEANAAHGSDSVENAAIEVAYFFAATEIILR

SEQ ID NO: 6394 - protein, 336 aa, Xylella fastidiosa Temecula1
MNMAIKVGINGFGRIGRNILRSAVQNFGSNIDIVAINDLLEADYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 6395 - protein, 139 aa, Solibacter usitatus Ellin6076
MSVERTFSIIKPDAVKAGQAGEILAMIQKAGFKIIGLRMTRLTELQAGGFYAVHKERPFYQGLVKFMTEGPIIVMALEREDAVKGLREVMGATNPANAAEGTIRKKFAENIERNCIHGSDAPETAAVELAFFFSSAELL

SEQ ID NO: 6396 - protein, 135 aa, Glycine max
  misc_feature (25)..(25): Xaa can be any naturally occurring amino acid
  unsure (1)..(135): unsure at all Xaa locations
MEQAGKQGIMVASQSQNPIEQIQAXFKELETGFRLWLSKQSLPVEAAVVTTTSAAQGAAIGAFMGTLTADASSTFPTPPPNASLNPQAMASLKQAQALAGGPLIQARNFAVMTGVNAGISCVLKRIRGKEDVQSR

SEQ ID NO: 6397 - protein, 150 aa, Triticum aestivum
MFLRRILSGGGGLAALRSARAVKETTGIVGLDVVPEARNVLIGLYTRTLKEIEAVPKDEGYRKAVESFTRHRLQICQEEDELKLIGKMIEWDPWGVPDDYECEVIEDDAPIPKHVPQHRPVALPEEFFKTLDAIKSDPALQGDSPPQVKS

SEQ ID NO: 6398 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 6399 - protein, 261 aa, Aspergillus nidulans FGSC A4
MGHEDAVYLAKLAEQAERYEEMVENMKVVAASDVELTVEERNLLSVAYKNVIGARRASWRIVTSIEQKEESKGNESQVALIKEYRQKIEGELAKICQDILDVLDQHLIKSAQSGESKVFYHKMKGDYHRYLAEFAVGDNRKAAADASLEAYKSATEVAQTDLAPTHPIRLGLALNFSVFYYEILNSPDQACHLAKLAFDDAIAELDTLSEESYKDSTLIMQLLRDNLTLWTSSEAEPAAENAPAEKKEEAPAAEGEEKPAE

SEQ ID NO: 6400 - protein, 331 aa, Candida albicans
MSGPVNSVSKQMNVDTDIITLTRFILQEQQTVAPTATGELSLLLNALQFAFKFIAHNIRRAELVNLIGVSGSANSTGDVQKKLDVIGDEIFINAMRSSNNVKVLVSEEQEDLIVFPGGGTYAVCTDPIDGSSNIDAGVSVGTIFGVYKLQEGSTGGISDVLRPGKEMVAAGYTMYGASAHLALTTGHGVNLFTLDTQLGEFILTHPNLKLPDTKNIYSLNEGYSNKFPEYVQDYLKDIKKEGYSLRYIGSMVADVHRTLLYGGIFAYPTLKLRVLYECFPMALLMEQAGGSAVTIKGERILDILPKGIHDKSSIVLGSKGEVEKYLKHVPK

SEQ ID NO: 6401 - protein, 392 aa, Mycoplasma arthritidis
MKDDACLLKKGSIVTIKTDENSYKNLVGDDKVITVSYRMDKDMHVGAKVLLDDGKLVTIVKEIKPEIILVEVQNDHVLKTNKRVNIPGIDFSMPFMSPKDREDIIWGAKYGVDFIAASFVNSAKNVHEIREILKQANAEHIQICSKIESQTGIDNIDEIIEASDSIMIARGDLGLEIPYYEVPYWEKKIIAKCRKANKEVIVATQMLDSMEKTPLPTRAEISDVYWATELGASATMTSGETASGQYPVEAIKTMATINHRAEQEYFNEIATSCNCQCQPKCELGHVAKELKEKTKTGDFPYTIAISEDGKLLKKIAKYKPNTTVIALVSDPKIETAFGITFGIFCEKNGAKAIEKVIKDPKYLNEILASHFDIKKGQKFLVIKDGLISENSL

SEQ ID NO: 6402 - protein, 410 aa, Thermobifida fusca YX
MNRTASPIPLDDIDEALKAIAAGRPVVVVDDADRENEGDLVFAADAATPELLAFMIRHTSGVVCVPMLGEDLDRLNLPLMTPRNEDRLHTAYTVTVDARTGVHTGISAADRARTIRLLADEASEPGDFVRPGHIFPLRYRPGGVLVRRGHTEAAVDLARLAGRRPAGVIAEIVNDDGTMARLPELRAFADEHGLALVSIEQLVAYRRRTETLIERVVETRIPNRYGEWRAVGYRSVVDDSEHVALVYGDLGTGERALVRLHSECLTGDAFGSYRCDCGDQLDAAMARIAQTGAGVIVYQRGHEGRGIGLLHKLRAYRLQDQGADTVDANLQLGLPADAREFGTGAQILLDLGVRSVRLLSNNPDKAAGLAAHGVVVDERIPLPAAITPDNLRYLRTKRDRMGHDLPGLAS

SEQ ID NO: 6403 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 6404 - protein, 141 aa, Polaromonas sp. JS666
MAIERTLSIIKPDAVAKNVIGQIYARFEAAGLKVVAAKMAHLSKGEAEAFYAVHKERPFFKDLVSFMISGPVMIQALEGEGAILKNRDLMGATDPKKAAAGTIRADFADSIDANAVHGSDAVETAQAEIAFFFPGMNIYSR

SEQ ID NO: 6405 - protein, 194 aa, Arcanobacterium pyogenes
MNFIPGRVFPRSARVADVRHVEKTTSTQDVLRTLADARHLTTVVAEEQTRGRGRLGRTWESAPGTSLLASTLITLPDTAAMRADLGFLTLLGALSLRSAVSDYTGGSFLVKFPNDVVNPAGQKLAGILGEFFTDLTAKRGWICVALGIGLNIHQHGETLFPGACSLASEGLLARSSVQAAGVADEILSRYLQGI

SEQ ID NO: 6406 - protein, 250 aa, Leptospira interrogans serovar Copenhageni str. Fiocruz L1-130
MRKTIIAGNWKMNLSLKEAVFLAHSIREKIPSISKDKVSMVFPSTLHLENVSKILEGSSVIVGAQNCYHSGLAAFTGETSPDQLKEIGVKVVMVGHSERRQFLGESNFFCNDKIRFLLKNEFTVLYCVGETLSERESGKTLEVLSSQIREGLKGIDSVFFSNLILAYEPVWAIGTGKVATPSQAQEVHSFIRKEISGLFVGASSISESISILYGGSVKPDNIQDLLKEKDIDGGLVGGASQKISSFAGLF

SEQ ID NO: 6407 - protein, 540 aa, Prochlorococcus marinus str. MIT 9313
MPSSSSGNSRHFSRVAPVVLAILDGWGHREEVEHNSIRSAETPIMDALWHAYPHTLIEASGAAVGLPDNQMGNSEVGHLTIGAGRVIRQELVRISETVQAGRLGQTPALIALAERLRKSDGTLHLLGLCSDGGVHSHINHLCGLLHWAAAAGLNKVAVHLITDGRDTPIQSASKYLHQIEDAINASGVGELASLCGRYWAMDRDHRWERTIRAYEVLTDPNQSISRVTAEDVLSASYANGTTDEFLEPTRLSNNYFKDGDGLVMFNFRPDRARQLVQALTLPDFDGFPRANQPSLDVVTFTQYEHDLPVGVAFPAESLDDLLGQVVSEHGLRQYRTAETEKYPHVTYFMNGGIEQPLAGEERHLVPSPRVATYDLAPAMAADTLTESCVNAIESGVYSLVVINYANPDMVGHTGVMGAAQEAISTVDRCIGRLLDSTGRMGGTLLITADHGNAELMQGSDGQAWTAHTTNPVPVILVEGEKRKLAGYGNDIQLREGGGLADIAPTLLQLLDLPKPDAMSGLSLIQAIDSPTPSARLPQPV

SEQ ID NO: 6408 - protein, 313 aa, Yarrowia lipolytica CLIB122
MSLLRTLRPVLGSARPVTPVLARSYSAHHSPQTSDQTRKKVTIPELAKMRRNKEKISMVTAHDYVTGLIADKAGVDMILVGDSLAMVALGYPNTNQIELEEMVYHAKAVSRGVKSAFMVADLPFGSYEESPEKAIRSAIQMIQKGGMEAVKMEGGKELAPTIKRLTEVGIPVLGHIGLTPQRQSSLGGFRVQGKTASGAESILEDAYELQKAGCFAIVLEAVPDKVGEWLSSKLEVPTIGIGAGPGTSGQVLVMLDMLGGFGSFTPKFLKKYSQFLDINVGAVKQYHEEVKGGVFPAQEHCYKMGDEEAAKLK

SEQ ID NO: 6409 - protein, 296 aa, Prochlorococcus marinus str. MIT 9313
MSGAGSAVSTPTIQWYPGHIAKAEQQLSKNLDKIDLVIEVRDARIPIATAHPQLQRWIKGKQHLLVINRRDMISSAARQSWDRWFRDQAQTPWWCDAKAGTGVKQVQQAAIRAGDQLNQRRRSRGMRPRPVRALTLGFPNVGKSALINRLVRQKVVESARRAGVTRTLRWVRLGQDLDLLDAPGVLPPRLDDQQAALHLALCDDIGQAAYDVELVALALLETLTVLEKQAAAGVVAGILKQRYGINLAGDQADAHAWLMTVAERHTSGDTERMAQRLLDDFRRALLGPIALELPLP

SEQ ID NO: 6410 - protein, 74 aa, Populus alba x Populus tremula
CMPGMTGYELLKKIKESSSFREIPVVIMSSENVMARIDRCLEEGAEEFIAKPVKLSDVKRLRDYYMASREVRSV

SEQ ID NO: 6411 - protein, 806 aa, Emericella nidulans
MTPSTSHISSQLRQLIYYHLDNNLARNALFLAGRLHAYEPRTSEASYLLALCYLQNGQVKAAWETSKHFGSRGAHLGCSYVYAQACLDLGKYTDGINALERSKGQWTSRNHWNKHSETRRQHLPDAAAVLCLQGKLWQAHKEHNKAVECYAAALKLNPFMWDAFLNLCETGVDLRVSNIYKMSPELYSMVSSAALEDVESQVLPPDGPLQTQVNPNPSLDPFTAGTTRSDSTSTHGSSALWEKLNGSTVSVASSGTGPHLPREGMETPGGQSSESDDPRVTNGNGTDVFEPPLAPAKKNRTIQTIGGDHPMDPPPKMRPTGIRPRTRTKFESDEGHTERDAGMGHRLGDRKRTVSGQVAHPSVPHSTDQGVGQRRSVRLFNQIKPSTNKISSTALGVKEGREVKKVRTTGNKARTTTSSNVGRVVSGNNRRHAGEIHDGDSKEYRGTSSTSNGSQNASSKLAISERTKSVEALAWILDLFFKIASGYFCLSRYKCSDAIQIFSSLSQGQRETPWVLAQIGRAYYEQAMYTEAEKYFVRVKAMAPSRLEDMEIYSTVLWHLKNDVELAYLAHELMDVDRLSPEAWCAVGNSFSHQRDHDQALKCFKRATQLDPHFAYGFTLQGHEYVANEEYDKALDAYRSGINADSRHYNAWYGLGTVYDKMGKLDFAEQHFRNAAKINPSNAVLICCIGLVLEKMNNPKSALIQYNRACTLAPHSVLARFRKARALMKLQDLKSALTELKVLKDMAPDEANVHYLLGKLYKMLRDKGNAIKHFTTALNLDPKAAQYIKDAMEALDDDEEDEEDMA

SEQ ID NO: 6412 - protein, 439 aa, Mycobacterium sp. MCS
MTRLDSVERAIADIAAGKAVVVIDDEDRENEGDLIFAAEKATPELVAFMVRYTSGYLCVPLDGAICDRLGLLPMYAVNQDKHGTAYTVTVDAKHGVGTGISASDRATTMRLLADPTSNADEFTKPGHVVPLRAKDGGVLRRPGHTEAAVDLARLAGLQPAGTICEIVSQKDEGAMAQTDELRIFADEHDLALISIADLIEWRRKHERHIERIAEARIPTRHGEFRAVGYTSIYDDVEHVALVRGDVAGPHGDGHDVLVRVHSECLTGDVFGSRRCDCGPQLDAAMAMVAREGRGIVLYMRGHEGRGIGLMHKLQAYQLQDAGDDTVDANLKLGLPADARDYGIGAQILVDLGVRSMRLLTNNPAKRVGLDGYGLHVIERVPLPVRANAENIRYLMTKRDRMGHDLTGLDEYDEANSMDDYDEGVYLLGERRPTDLGGSR

SEQ ID NO: 6413 - protein, 254 aa, Agrobacterium tumefaciens str. C58
MIRDVIMTHTPPTALVTGANKGIGLAIARQLGAAGHTVWLGCRDMSRGEMAAFELRENGVDARAVQLDVTDDASASSAAKTIESEVGHLDVLVNNAGLMFGSPPSLAEESIDEIQQMFNTNVFGVMRVTQAFLPLLRKSKAARIVMMSSGLSSLTDALDMRSETWTVGFGGYCASKTALNMLTVKLAKELDREGIKVNAVDPGLTSTDMTGNGPGHSPEDGARPAFALATTHAYGPTAGFYACAPSGELVQKSW

SEQ ID NO: 6414 - protein, 1003 aa, Arabidopsis thaliana
MKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLTQLRHLHLGGNYFAGKIPPSYGSWPVIEYLAVSGNELVGKIPPEIGNLTTLRELYIGYYNAFEDGLPPEIGNLSELVRFDGANCGLTGEIPPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGENGKLNLVDLSSNKLTGTLPPNMCSGNKLETLITLGNFLFGSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSISSMQSLTSLDFSYNNLSGLVPGTGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGFNAEIQTLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 6415 - protein, 264 aa, Candidatus Protochlamydia amoebophila UWE25
MSPSHRPVVITGNWKMYKTVKEACTFAKALLPVVEVSPIQVWIAVPFTAIYPVKQEIRNSRLVIGAQNMNDASEGAFTGEIAGKMVKEAGASFVLLGHSERRHLYKEDNAFINRKVKKALEIGLTPVLCVGETFEERKSGETQQIIRTQIQECLAGLTAEDLKTLIIAYEPVWAIGNGQNAKPEGAQEIHQFCRKIIKEIFSEELAEQIVIQYGGSVNPSNAISLLKQPDIDGLLIGGASLSLETFVEIVNDGGSIFNLKAKLL

SEQ ID NO: 6416 - protein, 67 aa, Arabidopsis thaliana
  misc_feature (41)..(41): Xaa can be any naturally occurring amino acid
  misc_feature (43)..(43): Xaa can be any naturally occurring amino acid
  misc_feature (46)..(46): Xaa can be any naturally occurring amino acid
  misc_feature (55)..(55): Xaa can be any naturally occurring amino acid
  misc_feature (57)..(58): Xaa can be any naturally occurring amino acid
  misc_feature (66)..(66): Xaa can be any naturally occurring amino acid
  unsure (1)..(67): unsure at all Xaa locations
MASSMLSSATMVASPAQATMVAPFNGLKSSAAFQATRKVTXAXTSXTSNGGRVNXMXXWPPFGKRXF

SEQ ID NO: 6417 - protein, 406 aa, Pseudoalteromonas tunicata D2
MPIIKKSNKLEGVCYDIRGPVLKQARRMEDEGQKVLKLNIGNPAAFGFDMPEDMHKDIIRNLSSAQGYCDAKGLYSARVAIYQHYQQKNFFNLDVDNIYIGNGVSELIQLSTQALLNDGDEVLIPAPDYPLWTAAVRLASGTPVHYLCDEQQDWFPDINDIRSKITSKTKAIVLINPNNPTGAVYDVAMIQDLIGVAREHKLLIFSDEIYEKILYDGVTFTSVGSLCDDLPIITFNGLAKTYRAAGLRMGWMVLSGKLASMHDYIQGLDMLASMRLCANVPAQYAIQQALGGVQSIDDLIRPTGRLYQQRDIVYQGLNAIDGISCVKPKGALYAFAKFDRAKFNVHDDEKLIYDLLMQEKILLVHGRAFNWPEPDHFRLVFLPHQDQLKPALAQMARFFDNYKQDR

SEQ ID NO: 6418 - protein, 479 aa, Erwinia carotovora subsp. atroseptica SCRI1043
MSTTQKRMYINGEFVENRSGKWIDVVNPATEQVISQVPEGSADDAKRAIDAAEAAQPSWEALPAVERGVWLHKIAAGIREREAELTDTIIAEGGKTHGLAQTEVLFTADYLDYMAEWARRYEGEIIQSDRPNENIFVFRKAIGVTTGILPWNFPFFLIARKAAPALITGNTIVIKPSEITPNNAVIFAEIIHKIGLPKGVINFVTGYGPTVGQELAGNPKVGMVSLTGSVAAGIATMTAAAQNVTKVSLELGGKAPAIVMDDADLDLAVKAIVSSRVINSGQVCNCAERVYVQKGIYDEFIIRIKAAMEQVTFGNTAEKKTLDMGPLISAAALQRVEDKVAKAVSQGAKVLLGGKSESGTGYFYPPTLLVNVTQEMPIMHEEVFGPVLPVATFDTLEDAIAMANDSEYGLTSSIYTQNINTAMKALKGLKFGETYINRENFEAMQGFHAGWRKSGVGGADGKHGLQEYLQTHVAYLQFH

SEQ ID NO: 6419 - protein, 139 aa, Brassica napus
  misc_feature (7)..(7): Xaa can be any naturally occurring amino acid
  misc_feature (9)..(10): Xaa can be any naturally occurring amino acid
  misc_feature (12)..(12): Xaa can be any naturally occurring amino acid
  misc_feature (16)..(18): Xaa can be any naturally occurring amino acid
  misc_feature (21)..(22): Xaa can be any naturally occurring amino acid
  misc_feature (29)..(29): Xaa can be any naturally occurring amino acid
  misc_feature (34)..(38): Xaa can be any naturally occurring amino acid
  misc_feature (45)..(49): Xaa can be any naturally occurring amino acid
  misc_feature (51)..(52): Xaa can be any naturally occurring amino acid
  misc_feature (54)..(54): Xaa can be any naturally occurring amino acid
  misc_feature (58)..(60): Xaa can be any naturally occurring amino acid
  misc_feature (62)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(87): Xaa can be any naturally occurring amino acid
  misc_feature (91)..(91): Xaa can be any naturally occurring amino acid
  misc_feature (101)..(101): Xaa can be any naturally occurring amino acid
  misc_feature (111)..(111): Xaa can be any naturally occurring amino acid
  misc_feature (115)..(115): Xaa can be any naturally occurring amino acid
  misc_feature (118)..(119): Xaa can be any naturally occurring amino acid
  misc_feature (121)..(122): Xaa can be any naturally occurring amino acid
  misc_feature (127)..(127): Xaa can be any naturally occurring amino acid
  misc_feature (131)..(131): Xaa can be any naturally occurring amino acid
  misc_feature (133)..(133): Xaa can be any naturally occurring amino acid
  unsure (1)..(139): unsure at all Xaa locations
MASSMLXSXXGXTSPXXXTMXXPFSGLKXSAAFXXXXXGNNDITXXXXXGXXVXCMKXXXPXXKXKFETLSYLPDLTEVELXKEXXXLLRXKWIPCVEFEXQHGFAYREHXSTPXYYXXRXXTMWKXPLFXCXDSAQVL

SEQ ID NO: 6420 - protein, 469 aa, Thiobacillus denitrificans ATCC 25259
MAVADVLKRIQDDEVKFVDLRFTDTRGKEQHVSIPARIVTEDWFEDGHPFDGSSIAGWKGIQASDMLLKADPDSAYMDPFFDEPTLILTCDVIEPSDGKGYERDPRSVARRAEAYLKSTGLADTAYFGPEPEFFIFDSITWHDDMSGSGVKINSEEAAWSSAEKFENGNTGHRPGIKGGYFPVPPVDSLQDIRAAMVVALEEAGVPVEVFHHEVATAGQCEIGTQFSTLTKRADWTQVLKYIVHNVAHAYGKTATFMPKPIVGDNGSGMHVHMSLWKDGKNTFAGNGYAGLSETALYYIGGIIKHAKALNAITNPGTNSYKRLVPGFEAPVMLAYSARNRSASIRIPIAASEKARRIEVRFPDPLANPYLAFSALMMAGLDGIQNKIHPGDPGDKDLYDLPPEEDAKIPKVCHSLEMALDELDKDREFLTRGGVFTNDMIDAYITLKMEEVTKFRMTTHPVEFAMYYSL

SEQ ID NO: 6421 - protein, 542 aa, Streptococcus mutans
MTLDKRKVVYQIYPKSYKDTSGNGVGDLQGIIEKLPYLEELGIDVIWLNPFYPSPQRDNGYDVSDYTAVNPLFGSMADFEELVRKGKEHGIEIMLDMVLNHCSIEHEWFQKALAGDKYYQDFFILRDRPTDWVSKFGGNAWAPFGETGKYYLHLYDVTQADLNWRNPHVREELFKVVNFWRNRGVKGFRFDVINVIGKDEVLKDNPHFDGKPEYTDRPINHDYLKMLNKASFGQDENGMTVGEMSFTDIPNCIQYSNPDNHELDMVFNFHHLKVDYENGQKWTRKTFDFEELKHLFHTWGEGMSQGNGWSALFWNNHDQPRALNRFVDIKQFRNEGATMLAASIHLSRGTPYIYMGEEIGMIDPDYGSMADYVDVESLNAYQELIDKGKSSEEAFHIIRAKSRDNARTPMQWDTSENAGFSTGRPWLKVGKSYPQINVANEKQGKIFPFYQKLIRLRKEMPLIAQGSYQAALTDSDKIYAFEREYEGQKLLVLNNFFAETVELDLPSLYQAGTVLISNYDDVILDKRISLKPYQTVAILAEV

SEQ ID NO: 6422 - protein, 480 aa, Arabidopsis thaliana
  misc_feature (137)..(137): Xaa can be any naturally occurring amino acid
  misc_feature (145)..(145): Xaa can be any naturally occurring amino acid
  misc_feature (164)..(164): Xaa can be any naturally occurring amino acid
  misc_feature (408)..(408): Xaa can be any naturally occurring amino acid
  unsure (1)..(480): unsure at all Xaa locations
MGKKNGSSSWLTAVKRAFRSPTKKDHSNDVEEDEEKKREKRRWFRKPATQESPVKSSGISPPAPQEDSLNVNSKPSPETAPSYATTTPPSNAGKPPSAVVPIATSASKTLAPRRVYYARENYAAAAVQTFFRGYLVXRALGALKXGLVKLQALVRGHNVRKKLXMTLRCMQALVRVQSRVLDQRKRLSHDGSRKSAFSDSHAVFESRYLQDLSDRQSMSREGSSAAEDWDDRPHTIDAVKVMLQRRRDTALRHDKTNLSQAFSQKMWRTVGNQSTEGHHEVELEEERPKWLDRWMATRPWDKRASSRASVDQRVSVKTVEIDTSQPYSRTGAGSPSRGQRPSSPSRTSHHYQSRNNFSATPSPAKSRPILIRSASPRCQRDPREDRDRAAYSYTSNTPSLRSNYSFTXRSGCSISTTMVNNASLLPNYMASTESAKARIRSHSAPRQRPSTPERDRAGLVKKRLSYPVPPPAEYEDNNSL

SEQ ID NO: 6423 - protein, 184 aa, Triticum aestivum
ARGCCYDIFCLFQGHIENIANLKQHYGLSKTANEVTILIEAYRTLRDRGPVPASQVVRDLSGKFAFILYDTLSKSTFVAADADGSIPFFWGVDSENHLVFSDDAGLLKTGCGNSYAPFPKGCFYTTSGGLQSFEHPLHEVKAVPRVDSQGQMCGSTFKVDSESKKKQDASIPRVGSAADWSNQF

SEQ ID NO: 6424 - protein, 287 aa, Staphylococcus epidermidis ATCC 12228
MAIQWYPGHMAKAKRQVSEQLKKVDVVFELVDARIPYSSRNPMIDDVIKQKPRVVILNKKDMTNLKELEKWEIYFKNEGFYPVAVDAKHGKNLKNVEVEAIKATQEKFDREKAKGLKPRAIRAMIVGIPNVGKSTLINKLAKRSIAETGNKPGVTKQQQWIKVGKSLQLLDTPGILWPKFEDEEVGKKLSLTGAIKDSIVHLDEVAIYGLNFMIKHDVSALKRHYNIDTHEDAEILDWFDAIGRRRGLLQKGNEVDYESVIELIINDMRNAKIGTYCFDILKEMKSE

SEQ ID NO: 6425 - protein, 186 aa, Zea mays
  misc_feature (101)..(101): Xaa can be any naturally occurring amino acid
  unsure (1)..(186): unsure at all Xaa locations
MAAGAGAGASAPVAWLLAAAVAAAALAASASAQSGCTTTLISLYPCLNYISGNVSTPPPSCCSQLASVVQTSPQCLCAALSSDSSSLGGVTIDRTRALQAXLPQACSVKTPPASKCNSVGGGSAPGAATPAAPSSGVPATAAAGTGSGSKATPTAPFLTSGGASVRGAVSLALAFAAVTVYAISAM

SEQ ID NO: 6426 - protein, 121 aa, Triticum aestivum
  misc_feature (102)..(102): Xaa can be any naturally occurring amino acid
  unsure (1)..(121): unsure at all Xaa locations
MSAYCGKYKDELIKNAAYIGTPGKGILAADESTGTIGKRFASINVENVEDNRRALRELLFCTPGALQYLSGVILFEETLYQEHQGWQAFVDILKEGNVLPGXKVDKGTVELAGTTVRHTKV

SEQ ID NO: 6427 - protein, 169 aa, Oryza sativa
MASSATTVAPFQGLKSTAGMPVARRSNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 6428 - protein, 135 aa, Brassica napus
  misc_feature (2)..(2): Xaa can be any naturally occurring amino acid
  misc_feature (12)..(12): Xaa can be any naturally occurring amino acid
  misc_feature (26)..(28): Xaa can be any naturally occurring amino acid
  misc_feature (33)..(33): Xaa can be any naturally occurring amino acid
  misc_feature (43)..(43): Xaa can be any naturally occurring amino acid
  misc_feature (45)..(45): Xaa can be any naturally occurring amino acid
  misc_feature (49)..(50): Xaa can be any naturally occurring amino acid
  misc_feature (55)..(55): Xaa can be any naturally occurring amino acid
  misc_feature (58)..(60): Xaa can be any naturally occurring amino acid
  misc_feature (62)..(62): Xaa can be any naturally occurring amino acid
  misc_feature (64)..(64): Xaa can be any naturally occurring amino acid
  misc_feature (67)..(67): Xaa can be any naturally occurring amino acid
  misc_feature (71)..(73): Xaa can be any naturally occurring amino acid
  misc_feature (79)..(80): Xaa can be any naturally occurring amino acid
  misc_feature (82)..(83): Xaa can be any naturally occurring amino acid
  misc_feature (85)..(85): Xaa can be any naturally occurring amino acid
  misc_feature (93)..(93): Xaa can be any naturally occurring amino acid
  misc_feature (99)..(100): Xaa can be any naturally occurring amino acid
  misc_feature (104)..(104): Xaa can be any naturally occurring amino acid
  misc_feature (107)..(109): Xaa can be any naturally occurring amino acid
  misc_feature (122)..(122): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(134): Xaa can be any naturally occurring amino acid
  unsure (1)..(135): unsure at all Xaa locations
MXSSMLSSAAVXTSPAQATMVAPFTXXXSSAAXPVTRKANNDXTXIASXXGRVSXMKXXXPXAXKKXETLXXXPDLTEXXLXXEXDYLLRNKXIPCVEXXLEHXLVXXXHGSTPGYYDGRDXTMXKLPLXFGXXD

SEQ ID NO: 6429 - protein, 391 aa, Lactobacillus acidophilus NCFM
MPELASDLGLSKKIQDVRASGIRIFDNKVSTIPGIIKLTLGEPDMNTPEHVKKAAIKSIEENDSHYAPQKGKLELRKAISNYLNKVTGIDYNPETEIIVTVGATEAINATLFALTNPGDKVAIPTPVFSLYWPVATLADADYVLINTAEDDFKLTPQKLEKAVEENPAIKTVILNYPTNPTGVEYTEDEIRALAKVIEEKHLYVITDEIYSSLTYGVKHFSIASLIPERAIYISGLSKSHAMTGYRLGYVAGPAKIMEQIGKVHGLMVTTTTDSSQAAAIEALENGLDDPDEYRRVYQKRRDFVLKALEEMGMHAVKPDGAFYIFAKIPAKYGKDDMQFALDLAFKEKVGITPGSAFGPGGEGYVRLSYASSDENLHEAMKRIKQFLQEDK

SEQ ID NO: 6430 - protein, 266 aa, Clostridium perfringens ATCC 13124
MNKKIGFIGCGNMGSAMVLGILKSGIVCKENIIASCSRESSAERIKNELGINTTLDNKEVCNNSDIIFLAVKPYMYEKVIKEIRDCVDLNKTIVTIAAGINLSDVEKWFKKETKIVKTMPNTPALIGEAMSAICPNELVNEEELKEVMDIFNAFGKSEVLSEKDFHGFIALCGSSPAYVYMFIEAMADAAVREGISRDKAYKLAAQSVLGSAKMVLETGEHPAKLKDNVCSPGGTTIEAVLELEETGFRSSVMSAMKKCSKKSKKM

SEQ ID NO: 6431 - protein, 471 aa, Rhodococcus sp. RHA1
MSGTTDPQLQHTLKKRHLSMIAIAGVIGAGLFVGSGVAIRETGPGVLVAYALAGIVVILVMRMLGEMSTANPETGSFSAYADRAIGRWAGFSIGWLYAWFWIIVLGIEATAGAVIMNRWIPDVPQWSWALILMVLLTLTNIASVKSFGEFEFWFASIKVAAIVIFLVLGVLAICGALPGVEAPGLTNLTGHGGFFPNGAGAVFAAVLVVVFSFFGAEIATIAAGESANPVAAVRNAVRSVVWRILIFYIGSIAVVVTLLPWDDASVALSPYVAVMDSFGIPAAGNIMDVVVLTSVLSCLNSGLYTASRMIFSLSRRGDAPASLSKIGSSGVPRQAVLVSTVVGFLTVGLNYLYPDTVFLFLVNSSGAIALFVWLAISVSQLRMRRSLEAEGKDLSLKMWLFPYLTWCTIAAIIALCVGMLVLSETRSQMYVSMGLAVVVVGIGIYRQHTRGTTDETPDPSPSGEEVDALRP

SEQ ID NO: 6432 - protein, 342 aa, Candidatus Protochlamydia amoebophila UWE25
MKGLVKKISAPGLWMENLPIPSHVKDDEVLIKTIKTSICGTDVHIYKWDAWAQKNVPVPLVIGHEFIGEIAEFGKNVKGFKIGERVCGEGHIVCNQCPNCRMGRKHVCMHTKGLGYHISGCFAEYFVLPAENVFSLPPSISDDLGAIFDPYGNAVHTTLAFNLIGEDVLITGAGPIGIMAAAIAKQAGARHIVITDVNDYRLDLARTMGVSHAINVNRESLDNFMQSLGIKYGFTVGLEMSGHPDGLKTLTEKIRHGGNIALLGILPPATSIDWNLVIFKMLTLKGIYGREIFSTWYQMVHLLEIGLNLAPIITHHFSVDNFEKGFEVMLSGQSGKVILDWV

SEQ ID NO: 6433 - protein, 482 aa, Shewanella sp. MR-7
MLLKDPSLLRQQCYINGQWCDAQSKETVAIANPATGAVIASVPVMGQAETQAAIAAAEAALPAWRALTAKERGAKLRRWFELLNENSDDLALMMTTEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPVVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGITEGVTTGPLINRAAVEKVQSHLEDALSKGATVVAGGKPHSLGGNFFEPTVLTHVDSSMRVAREETFGPLAPLFKFTDVDDVIKQANYTEFGLAAYFYGRDISLVWKVAEALEYGMVGINTGLISTEVAPFGGMKSSGLGREGSKFGIEEYLEIKYICMSV

SEQ ID NO: 6434 - protein, 736 aa, Ustilago maydis 521
MVVVKGGPSKNNTKSTGIKRVKGENFYRDAKKAKVVKLLSKDGIASKAIRDKNGKIIQAAEFQSSEAKPGRVQPDKRWFGNTRVISQDALDHFRTSLGSRVNDPYSVLLRRNKLPMSLIQDPGNGKAPSLTTLEPYSDTFGPGAQRKRPRLDGGMSSFEELAMSSEQAGRAAEEKQAALEAKAAGVGLVPSDYEVGSSAQRSANGFTADADELYEIPVTRGRSEPIYSKGQSRRIWGELYKVIDSSDVIIHVLDARDPLGTRCRSVEKHIRDEKPHKHLIFLLNKVDLVPTWVTARWVKILSKEYPTIAFHASINNSFGKGSLIQLLRQFSVLHSDKKQISVGFVGYPNTGKSSIINTLKKKKVCNVAPIPGETKVWQYITLMRRIYLIDCPGIVPVSAHDSETGTVLKGVVRVENLETPAEHIPALLSRVKPEYIRRTYNLEKWTNSEDFLGQIAKRMGKLLKGGEPDLETVAKMVLNDWIRGKIPFFVAPALPEDAKSSKGKAKATAEEVKSAETSDIADAAAAAEADTATDKLLKRKKVKGVEQPLKQIAVATKFTREDIEAGRPEDYVMERDEDEPVPEVAVDEDATFDSDDVAEDDDDDDEDEDGDALEDLNWDDVFQGGSDAEEGDEEQDDDADATVNTATSSPGKRAAAAAAAAADDDDDDDDDDERRKQKKAPRMTTSKRKAENYYTHANVKNKSRRGKPDAAEPKSKERGPKVGANGKGATQPRRRK

SEQ ID NO: 6435 - protein, 737 aa, Aspergillus nidulans FGSC A4
MSPAHGHCDAAFQPLRDLFDQLLSNESELGASICVNIDGRNVVDLWGGYSNEERTKAWEQDTITTIWSTTKVITALAANILIERGLLDPSKKVSTYWPEFAANGKENVLVSHVLSHSSGLPSWESPNTIKDIYNAEKAAEKIAAQAPWWTPGEQLGYHLVTQGCLVGELVRRTTGQSLAQFIADEITEPLGADYRLGVPEPEWPRTADIIPPPPPEPTPALDPESVAAKAYAGVPIPADAVMTASFRNAELGASNAFTNARALARIASIVALGGTVDGKQYLSPAAIDQMLQEQIRGQDQVLFVNLRWGLGVGLPVPETVPWLPSNSRLCFWGGWGGSVMIMDLDRRMSIALKVNRMFESRTSDAGENAVGLLSGGFFVDTAGPGFSSTRSSYYDAIMQIIKSLWVQTFPSKPTLTAATLPPQTGKVIIITGATSGLGFELARILYKSGATVYIGARNESKAKATIETITASASSTALAASAGKLHFLPLDLADLRTIKPFVESFLSRESRLDILFNNAGVASIPLSNRTAQNLEPHLGTNCAGPYLLTQLLSPILVSTAQKHSTAPNTVRVVWSSSMLVDALAPRSGIRPSDLDPPSPNMNLNYALSKTGNWFLADRLAKQLGERGVVSITQNPGNIYTPIFDNAPRLTVWLSKPIYYKPEQGVNTMLWAGFSDGVTVERGGGYVIPFGRWHPYPRKDLLEAIMDKEEDGNEAENRGRGYAKAFEEWCDLVTREFR

SEQ ID NO: 6436 - protein, 389 aa, Rhodopirellula baltica SH 1
MKAVCWHGRNDIRVDNVDDPKILDPRDAIIRITASGICGSDLHLMAGAAPAMEAGDIIGHEPMGEVVEVGNAVSNLSVGDRVVVPFTISCGECFFCQSTLYSLCDQSNRNAEQAEKIMGHSPAGLFGYTHMLGGYAGGQAEYLRVPYADVGPIKVPDGLPDEQVVFLSDIFPTGYMAAENCEITPNDTVAVWGCGPVGQFAIQSAWMLGAKRVIAIDNVPERLEMARSVSKAEVIDYEKSDVYETLQEWTKGRGPDCCIDAVGAENHAAGNLQSVLDDAKTALHLGSDRPHVLNEIFKCCRKGGRVSVPGVYFSSVNLQWGTAMNKALQIRLGQTHMQRYLTPLMEKITDGEIDPSFVITHVEPLDNAPEAYKKFRDKEDGCIKVVLKP

SEQ ID NO: 6437 - protein, 465 aa, Aspergillus oryzae
MADVGDRMFCHACGGVWLRRDHGLECPHCHSEFTEIIEIPPDTEEEVPDPPTSVPEDRSAPPRNPWADHNPWDHDNMNTDTPDWGSGNGFRHHTYRSPDGRFTFSSTTYTRRGSSGQQMPVDPLMPMVRGLDTIFHGLADTYRQTEYRQPNERDSSPGLWRTDRQNQGFGPNGSRIYSTSFDIDMNTRSNGGVGSEFHTTGGLHPRDADGPQPMGTPLRTLGEYVLSLGCGEIEKVTDLYSILELFRADFGNNGPPGGGPGVRVMTGPNPIAILSTLLNLDRHGDAVYSQEELDRVISQLIDQNARGTAPPPAAPNEIQSLPKKKVDQEMLGSEGKAECSICMDPVELGTEVTVLPCKHWFHYNCIEMWLSQHNTCPHCRRGINIPAGPEGSSDNPVVINSSPETSPRRPSGAAPEHSGQSPPRWNGPGPETGGQEQDQGQSSRNDNQGGGFAGWVRSHFGGGNQ

SEQ ID NO: 6438 - protein, 348 aa, Pyrococcus abyssi GE5
MSEKMVAIMKTKPAYGAELVEVDVPKPGPGEVLIKVIATSICGTDLHIYEWNEWAQSRIKPPQIMGHEVAGEVVEVGPGVEGIEVGDYVSVETHIVCGKCYACRRGQYHVCQNTKIFGVDTDGVFAEYAVVPAQNVWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVSIDFNNLIIFKALTVYGITGRHLWETWYTVSRLLQSGKLNLDPIITHKYKGFDKYEEAFELMRAGKTGKVVFMLK

SEQ ID NO: 6439 - protein, 449 aa, Frankia sp. EAN1pec
MVVPSTAPASDDLFRRAQRVVPGGVNSPVRAFRAVGGTPRFMTSGSGPRLVDADGRTYVDLVCSWGPMILGHAHPDVVQAITAAAARGTSFGTPTPGEVELAELIVERVAPVEQVRLVNSGTEATMSAIRLARGFTGRPTIVKFAGCYHGHVDALLASAGSGVATLGLPDTPGVTGAATADTIVLPYNDLALVEATFAERGDTIAAVITESVAANMGVVPPLPGFNAGLRRLCDAHGALLVFDEVMTGFRVSRTGWWGLEGAVEGWAPDLFTFGKVMGGGLPAAAFGGRADVMARLAPAGPVYQAGTLSGNPLAVAAGLATLRACTDEVYATVDARAADVAGIVSTALNEQGVPHLLNSAGSLFSVFFTDATAVIDYAGAKRQASERYAAFFHSMLDAGVYLPPSAFEAWFVSAAHDDEAVERIAAAAPAAARAAAAVGAPVAVGGGAV

SEQ ID NO: 6440 - protein, 514 aa, Arabidopsis thaliana
MASILEPSKSSFFPALTKIVGTLGPKSRSVEALSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 6441 - protein, 425 aa, Chlamydomonas reinhardtii
MLGQSLRGDVGRSASVRSSQPTASIAPISSRSASRRVACASAQSTDVASEAVATTSAGAARSAAREVYQLSDAACCSTSAPTASTTFAGVDPTVLAAVAGLGLSLFALKRILDTPSRKYDNNVGQEYDAWTEEGVLEYYWGEHIHLGYYSDEELARGYLKKDFKQAKFDFVDEMLRFSGAKNPATILDVGCGFGGTSRHLAKKFRDANVTGITLSPKQVQRGTELAKEQGVGNVKFQVMDALAMEFPDNSFDLVWACESGEHMPDKRKYIEEMTRVLKPGGTLVIACWCQREEGDKPFTPQDKEDLQFLYDEWAHPYFISIAEFGRLMNGTGKLDGVKLEDWNKNTISSWRHSIWVGVFDPWVVVFKGPRIWYKTVREIVTLERMHQAFEKGLMEYGMMTATKKLAPASESAANTQDRVPVGAKA

SEQ ID NO: 6442 - protein, 327 aa, Triticum aestivum
MASRTAAVPEVALRSGDARPMPAIGMGTAQSPVVPDTTVKAVLEAVEVGYRHFDTASMYATERPLGEALAEAVRRGLLASREEVFVTSKLWCTQCHPHLVLPSLQESLQNLQMEYVDLYLIHWPISLKPGPVVFPVKREDAVPFDLEGVWRAMEECHRLGLAKAIGVSNFTTRHLDKLLPAATVPPAVNQVEMNPVWQQRKLREYCAEKGIHVAAYSPLGGQNWSGDGNAVLDSEVLAEIAKARGKSVAQVALRWIYEQGVTPIVKSFSKERLKENLGIFDWGLTDDDLRKIGQIPQKKIVKAETVLFSAEGEFTSADLADMEIVED

SEQ ID NO: 6443 - protein, 139 aa, Brassica napus
MGLQGQLSDVSSDSIPLMLVALLATLFKHVRSFFLRFSASNPHLSVVDEAAASASVTSGLANLAVLADQLKLNRLFSYSYVDNAASDCIVCLSTLKTGEEVRKLDCRHVFHKHCLEGWLQHLNFNCPLCRSTLLAMAME

SEQ ID NO: 6444 - protein, 136 aa, Glycine max
MKGSSKRKTEKEKIEDEVEEMLRAAQDQILLNLTQAHIAARPSPDHDHDLDLDLDLERRFQALKMKTKSQPQDDLSARFDALKAKSSSSVVTASNSNAQFDYAEEDPEAQVQKLIQWAKDAARLDPSPPSDHDQDI

SEQ ID NO: 6445 - protein, 474 aa, Propionibacterium acnes KPA171202
MDGELKRGLSSRHMNMIAIGGAIGTGLFVASGATISQAGPGGALVAYFAMGLMVFLLMQSLGEMSSYLPVPGAFETYATRFVSPSFGFALGWNYWFNWAITVAAELAAASIVMAYWWPGVPAWMWSVGFLALLFLLNVLSARAYGESEFWFAIIKVTAVIVFLVLGILMIAGVMGTSPGLSHWRRGDAPFVHGFGGILTVFLIAGFSFQGTELIGIAAGESKDPRMTIPKATRQIFWRIMIFYIGAIAVIGLLLPYTDPHLLAGEVTDVAVSPFTLVLKRAGVAAAAAVMNAVILTSVLSAGNSGLYASTRMLYALAREGKAPRILGRTSRRGVPVPALIVTTLVGAACFATSLVGSGQAYTWLVNISGLCGFIAWIGIAICHIQFRRAFQAQGHDLSELPYRARWYPAGPIVAGVLCVIVTLGQGRDAVLSGDVTDMIVAYISIPVFLALWVGHKIVTKAPHADLSTADLHHD

SEQ ID NO: 6446 - protein, 261 aa, Mycobacterium sp. MCS
MARKPLIAGNWKMNLNHFEAIALVQKIAFSLPDKYFDKVDVTVIPPFTDLRSVQTLVDGDKLRLSYGAQDVSQHDSGAYTGEISGAFLAKLGCSFAVVGHSERRTYHHEDDALVAAKAAAAFRHGITPIVCIGEHLKVREAGNHVEHNVEQLRGSLAGLTSEQIGQAVIAYEPVWAIGTGRVAGAADAQEVCKAIRDELGKLSSPQLAAGIRVLYGGSVNAKNVGEIVAQEDVDGALVGGASLDGEQFATLSAIAAGGPLP

SEQ ID NO: 6447 - protein, 128 aa, Medicago truncatula
MSWAAPDELLLSTSLATYLDKKLLVLLRDGRKLLGLLRSFDQFANVVLEGACERVIVGDLYCDVPLGLYVIRGENVVLIGELDLGKEELPPHMTCVSEADIRKAQKAERDASDLKGTMRKRMEFLDFD

SEQ ID NO: 6448 - protein, 481 aa, Burkholderia sp. 383
MANVTYTDTQLLIDGEWVDAASGKTIDVVNPATGKPIGKVAHAGIADLDRALAAAQRGFDAWRKVPAHERAATMRKAAALVRERADAIAQLMTQEQGKPLTEARVEVLSAADIIEWFADEGRRVYGRIVPPRNLGAQQTVVKEPVGPVAAFTPWNFPVNQVVRKLSAALATGCSFLVKAPEETPASPAALLRAFVDAGVPAGVIGLVYGDPAEISSYLIPHPVIRKVTFTGSTPVGKQLAAMAGLHMKRATMELGGHAPVIVAEDADVALAVKAAGGAKFRNAGQVCISPTRFLVHNSIRDEFTRALVKHAEGLKVGNGLEEGTALGALANPRRLTAMASVVDNARKVGARIETGGERIGTEGNFFAPTVIADVPLEADVFNNEPFGPVAAIRGFDKLDDAIAEANRLPFGLAGYAFTRSFANVHLLTQRLEVGMLWINQPATPWPEMPFGGVKDSGYGSEGGPEALEPYLVTKSVTVMAV

SEQ ID NO: 6449 - protein, 173 aa, Oryza sativa (japonica cultivar-group)
MFLRRILSGGGGVAALRAARAVKETTGIVGLEVVPNAREVLVGLYTRTLKEIEAVPKDEGYRKAVESFTRHRLQICQEEDDWKRIEDRIGCGQVEELIEEAQDELKLIAKMIEWDPWGVPDDYECEVIEDDTLIPKHVPQHRPVALPEEFFKTLDAVKSDPALQGESPPQVKP

SEQ ID NO: 6450 - protein, 264 aa, Geobacter metallireducens GS-15
MVFFVDILQGIHHMKITILGSGTSTGVPMVGCHCPVCSSSDPKDKRTRSSIMIETAGKYILVDTSPDLRRQALRQRIPYIDAVLLTHPHADHINGIDDLRGFHFIHRRVIPCHGSRTTMEAVQRNFSYIFRGLEVVGYSPLMEAHIVNEPFALFGQSIVPIHLYHGAMPATGYRIDGAAYLTDCSRIPDSSLSLLTGLDILIMDALRYTPHENHFNIEGALRIVEQLKPKRAILTHLTHEVAHGDESRLPEGVEFAYDGMEIAL

SEQ ID NO: 6451 - protein, 113 aa, Arabidopsis thaliana
  misc_feature (38)..(38): Xaa can be any naturally occurring amino acid
  misc_feature (45)..(45): Xaa can be any naturally occurring amino acid
  misc_feature (48)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (75)..(75): Xaa can be any naturally occurring amino acid
  misc_feature (78)..(79): Xaa can be any naturally occurring amino acid
  unsure (1)..(113): unsure at all Xaa locations
MASSMLSSAAVVTSPAQATMVAPFTGLKSSAAFPVTRXTNKDITXILXXGGRXSCMKXWPPXGKXKXFETLSYLXDLXXFIRKSLLVYSFVIILLAFFIFFLFFLLSFYSYYC

SEQ ID NO: 6452 - protein, 137 aa, Triticum aestivum
  misc_feature (80)..(80): Xaa can be any naturally occurring amino acid
  unsure (1)..(137): unsure at all Xaa locations
MEQTFIMIKPDGVQRGLIGDIISRFEKKGFYLKGMKFMNVERSFAQQHYADLSDKPFFPGLVEYIISGPVVAMVWEGKDXVLTGRRIIGATRPWEAAPGTFLGTTRGIRKMSSMERSVENGKKSPLRFPKCAQWKTT

SEQ ID NO: 6453 - protein, 355 aa, Pyrococcus abyssi GE5
MKQKKAWRIVKEVIGEADIVVEVVDARDPIGTRNRKLERMVIESGKKLLIVMNKADLVPKEWAEEYKKRSEIPVIFISARERKGTGILRKELKKMAKTIDKDKVKVALIGYPNVGKSTIINVLKGKHAVGTAPIPGYTKGKHLIRLTKRLWLLDTPGVVPIDDFDELVIKGGFPADKIEEPVKPALKLIRRILETRKEALTEKFDIREFRDEEDILRKIGERRGIIREGGEVDIEETARWFLREWQTGRFTLFSNDEEKKEEYIESFGEILEVIKQENLTEPRIILWKFRDLLEEYVGSEKRFGAIEVGDFTVAIATGFKKCPNAIKFIERITGKNVITSECFGKKWKGVVAILD

SEQ ID NO: 6454 - protein, 607 aa, Nostoc punctiforme PCC 73102
MDDIFKGFEHLLEIAKALEEKVEKGELKTSIQIRSHNLSSIPRQGNIPRTSNSSRVRSNSTVGTTPMDDTDVTPPSARTNSKAAWQGIGGLADVLQEIRELVEIPLKRPDLLVKLGLEPPRGVLLVGPPGTGKTLTARVLAEELELNYIAINGPEVMSKYYGEAEARLRSIFEKATRSAPCLIFIDEIDSLAPDRSQVEGEVEKRLVAQLLGLMDGFAKTEGVLVLAATNRPDYLDPALRRPGRFDREVQFRVPDRDGRLEILTILTSAMPLETSVNLGAIADLAVGFVGADIKALCQKAAYIALRRQVPSLNSPVPENMTIVQQDFLEAIKEIKPSVLRDVAIEVPSVSWDDIGGLDDVKQKLQESVEGALLYPELYEQTKAKPPRGILLWGSPGTGKTLLAKAIASQARANFIAVNGPELLSRWVGAAEQAVRELFRKARQAAPCVVFIDEIDTLAPARGRFTGDSGVSDRVVGQLLTELDGLHECPKVLLVGATNRPEALDPALLRAGRLDLQIKIDLPDRASRLAILRVHNLDRPLVDVDLETWATVTEGWNGADLALLSNQAALSAIRRYRAQGLTDSSLIQITNDDFQVTYQMLANQHQSQ

SEQ ID NO: 6455 - protein, 513 aa, Yarrowia lipolytica CLIB122
MIIIETLIGAVVFVAVYVAFVKLDYYRRKAKFETSDMPVAYNGLLGWKGLRHMLTVFNNDIGPVGWREVFATYGKTLKYYAFPSNTILTYDPDNIKAMLATQFKDFSLGLRKEALAPSLGYGIFTLDGSSWSHSRALLRPQFSREQISRLESVETHVQEMMSCIDRNQGAYFDIQRLFFSLAMDTATDFLLGEAVGNLQEILHPEMPRTGTTFQVAFDRAQRLGSLRIICQEAFWVVGSLFWRRDFNNTNQHIHDYVDRYVDKALLARKEKSEIYTNPDKYIFLYELARETTNKITLRDQVLNILIAGRDTTASTLSWIFMELAKKPDIFHKLREAILNDFGTSCESISFESLKKCDYLRQVLNEGLRLHPVVPVNLRVAVRDTTLPRGGGPQGDKPIFVAKGQKINYAIFWTHRDKEYWGEDAEEFRPERWETTSGGALGKGWEFLPFNGGPRICLGQQFALTEMGYVITRLLQEYSDISIQPSDAAVKVRHSLTMCSAQGINISLTRAKEE

SEQ ID NO: 6456 - protein, 3044 aa, Burkholderia thailandensis E264
MPRPPMNTDNPCRAEPIAIVGMGCVFPGAVGPAAFLDLLRAGRVAVRELPPERWDAAALHDPDPDAPGRVLTRRAATIDGADLFDPDFFGLSRRDAREMDPRQRLMLKTAWWALEDAGMPGWGLGGRSVGVFLGASNGEFGGAHAQLSAIGASTAAGHATSVLANRLSYLLGLTGPSLVVDTACSSSLVAVHLACAALRAGECELAIAGGVSLMLRPDASVAFSRARMLAADGRSKPFSASADGYGRGEGAGAVVLKRLSDARRDGDRIVAVVLGSAVNHNGSSNGITAPSALAQEALIRRALEAAGVAPEQIDVVEAHGTGTLLGDPIEAKALGRVLGAVVGRAAALPVGSVKGNIGHLEAAAGVAGLIKLALALRHREVLASAGFDAPNPHIDFHAWNLTVPTALAPLPDRGRPPIGALSSFGFGGANCHLIAAAPPSDLLAPPDPPARHAGTKTGDPWLPLLVLSAASDEALNRLAAATAERVRGDPPGAWRLARASHAARSPLKQRLAVVAADAGALAAALDRAAAGGLEGVAARGAAPRRRPALAFLYAGQGAQFPGMAAGLLDGDTELRRTLEQACAITGLPIMDWLAAGDETIDRTDVTQPLMVALQVGLTRQWAAWGIEPDIVIGHSLGDYAGAVAAGALSFDAAMRVAALRGRLAATSARPGGMVAVAAARDAVAPHLAPGAAIAVDNGPAQLSVAGDAHALAETVRRLAAAGIATRALPVSAAFHSPAMEPMLDAFRAALADVAMQPLRLPMVCNRTGAVLPAGTVLDAEFWVRHLREPVRFADGVRALATEGIALGLEIGPQAMLSRLAPLSAPTLKVVPSLARGTRDRDALLAAAGALWVAGVTPDWRAIDGPGRVHAELPLYPFDDAPFPLLAEGTVVAGAAATTGAVATRDAQAEPPPVAAVLPATAAHERACDIGAKLRDAIAQALETSPDRIDPTVPFIEMGADSLVLMAAARKIEAAFGVRVPMRAFFDELSTMDALAAYLAAEAPQPPAEPGEPAGAASASSDVIAQVVREQLDLMRRQLDLIEGRRGAGERALPDGAARRPVAEIARAGGMRGAIRAAHPTRRADTARDALSPRRQAHLDRLIGDYTRRTAGSRALAARYRDVMADSRASAGFRPSIKAMLYPIVCRSAAGTTFEDVDGNRYLDISMGFGVHLFGHAPDFVAHALRESLSRGLRLGPQSDRAGKAAAAIARLSGQDRVAFVNSGTEAVMVALRLARTVTGRERVVIFRGAYHGHFDGVLADAADPDDPAAGGTPAVPGVARGAVADTLVFEYGDEACLDTLAALLGQVAAVLVEPVQSRRPDLQPAAFLRRLRALTEQAGALLIFDELITGFRIAAGGAQAHFGVKADLVAYGKILGGGLPIGALAGRADVMAAVDGGAWRYGDDSAPVAETTLFAGTFNKNPLSIDACVAVLTEIERRGDALYAQLNDRAARLHARLAQALAGTPIGIARFGSVFRFVFERNLDLFFYHLLLRGIYVWEGRTCFLSAAHTEADCDRLVAAVSDTVAALRDGGMLDERHGGAAIGAADGIDAAGTAVEAAGDAGALPMIRAQRQLAALAEMDPAGAVAYALPLLLDLDGPLDANRLRDAVERAAARHDGLWAAMDPVSGTLRMMPPGRLALAARAIDAAELDAEVRRGMAVPFDLKTPPLLRATLFEIADGAHALLLVGHHAALDGFSLQVLAADIAACYGGAPLPHAPSLRRVLASHRDAERDGRWAAARDWWRARLQDAPLGLDLDLAAPRPSVRAFRGAREVRRVDAPLARALRARAAAERTSLLAVLLTGFAWLLARHGALDVVIGVPYAGRAAAGDGAERVVGYCAHLLPIRLRIDAVDSACALLAHTRAAVTEALEHADYPFAHIVDDLALKRDPARPLLVPATFNLDRVPPALDFGERVAARLRSPAVGAGRFDLACNVADGGDALMVELDHDEALFGDGRAQRLADEYLQLLGRIAQGGEQPLRDGAEHVARWATVVAAGRAEPLAARWRRHLERAPQHVAVAVDGDARLTRAELDRWSDAAADAIDGAGAAHGPVALLLPRTEALPVAMLACWKAARAWMPIDPATPAERIADMIRRAGCALVLRDAAADADPTLAHGCATLDLPSRAQATRRDARRAWPAPNPEDVAYVLFTSGSTGRPKPVAVPHRAVEWYVQGLLNRLGLPPGLACGLVSTVAADLGLTATLPALFDGGCLCVQSDAAARDPLLLAAVHRKRPVDLLKIVPSHLEALLAGAPDPQLLPRRVLVLGGERARPGLLSRLAECAPPGLRVMNHYGPTETTVGVATGEWTRGAGELRLDAPLAGAALVLLDAGGRPAPAGVCAQLHVGGPQVALGYPGCPDETGARFRPQPSSGVDGPLYATGDLARLNADGTLTIVGRTDDQTKIRGYRVEPGEVAAALEALPGVVSAAVVAADHPARGTVLVAYVVGDGAPGDPASLARALHGRLPDYMVPAQVVRCGRLPLSANGKLDRGALPAPDWSAGAAEAPVSASCDADRVQAALVALWRELFGRADIGVHDEFFALGGDSILGIRMVARLHRDGWRLQASDLYRHPTIAALAPLIRPVDTQAEQGVLSGPVPLLPAQRRWLEIGAGWRAHANLSLLLELDVAVTPDRVADAFVRLMHQHDGLRLRANAGGGEPAQIYGPVAPPPLHRVDAAHATPDALTRLQALADPAVSPLVLGWLDGAPPRLLIVMHHWIADAVSCAILLDDLARLLRDPGAPLGPKTPSLRQWAQTLAERAASPDALAQLEYWTLSTSLPPPALPVKAGGGGGAPASAGLTLSGDETREVIAGPAAQAGAETEDLLLAALTLALGGRTGEPLLYVELEGHGRTPPHGLPEPARTIGWLTARHPAWFDLTGVPEAAAAAAVRAQRLSIPNRGADYGALRHLGPDDARNALAAGHRPAVSLNWLGQLTGIAHAPFRVISWRPGCPLRGAERAADLPQPHALAVEAMLIDGCLRIEFIYDVARFDAAAIDALAADCAASLLRLARESAAPPAAPAASAPPPDPRGELDADDLAALAANR

SEQ ID NO: 6457 - protein, 245 aa, Streptococcus pneumoniae
MNKNIKYSQNFLTSEKVLNQIIKQLNLKETDTVYEIGTGKGHLTTKLAKISKQVTSIELDSHLFNLSSEKLKLNIRVTLIHQDILQFQFPNKQRYKIVGSIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNSYLLFNGRK

SEQ ID NO: 6458 - protein, 245 aa, Streptococcus sanguinis
MKKNIKYSQNFLTNEKVLNQIIKQLNLKETDTVYEIGTGKGHLTTKLAKISKQVTSIELDSHLFNLSSEKLKLNIRVTLIHQDILQFQFPNKQRYKIVGSIPYHLSTQIIKKVVFESHASDIYLIVEEGFYKRTLDIHRSLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 6459 - protein, 178 aa, Triticum aestivum
LAWSRPRSLMVVAGIFIWTLVEYVLHRYLFHIDTKSYWTNTAHYLLHGCHHKHPMDGLRLVFPPTAAAILCYPFWNFVKLFTTTTTTPGVFGGGLLGYVIYDCTHYYLHHAQPSSDPAKYLKKYHLNHHFRIQNKGFGITSTLWDHVFGTLPSTKTPRALELYCLALPDIKNVWLMTG

SEQ ID NO: 6460 - protein, 490 aa, Xanthomonas campestris pv. campestris str. ATCC 33913
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLFGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 6461 - protein, 230 aa, Lactobacillus acidophilus NCFM
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKATAEKYGDEQVHIWRRSYDVLPPAIDDDNEFSQAHDRRYANLDPHIVPKAENLHVTLDRVMPFWEDNIAPDLLDGKNVIIAAHGNSLRALTKYIENISDDDIMDLEMKTGEPVVYTFDENLDVVNKEKLDD

SEQ ID NO: 6462 - protein, 272 aa, Shewanella sp. MR-7
MSQQKICFIGAGNMTRSIISGLVRSGYPAALVQATNPSQGKLDALAADFGVRVSQDNVSAAQDADVIVLSVKPQLMEQVCQALQGIDMSNKLVITIAAGIKAERYSQYLAQPITLVRTMPNTPMQIGVGMTGLYAPQPLSDAQQAITERLMSSGGEIVWVNEESEINQVIALAGSSPAYFFLLMESMIDAGKQMGMDEAKARSLVQQAALGAAMMAKQNPELTLGNLRENVTSKGGTTAQAIATFEAADLRGVVKNAMENCIKRAEEMANTF

SEQ ID NO: 6463 - protein, 421 aa, Nocardioides sp. JS614
MERKAVVCLAGTLDTKGAEYAYVKDCLLAAGVDVHVIDCGVLGEPGFTPDVDAVQVAERAGIRLEDFQSGVEGAGGRVLAVTKMSEGLQQVLEELVSQDRIDAVVGLGGTGGTDLLSGAFKNLGLGFPKLIVSTMASNNTRPYVGHSDLHMANAVTDIAGLNSISKQVLGNAANGVAGMAMGRARIRAQAEASKPLIAVSMFGVTTPGVMRVRSRLEAEGFEVVTFHAVGEGAGMEHLIDQGAIDGLIDYTLPEVLNHWNHGIFDPGCERMEAAIRSGIPQVVVPGAMECFNFGAVDTIPAEFNTPERNVLVHNPNITSLLATPEELVKLGEYLAEHVNQAPGPKAVGLPLGGLDNYFKEGSQWHGVDVTPLFDAVRRTLDPGIELIEMESNINDAEFADAIFDLFMKQWAAREQPAAAVG

SEQ ID NO: 6464 - protein, 138 aa, Brassica napus
  misc_feature (120)..(120): Xaa can be any naturally occurring amino acid
  misc_feature (132)..(132): Xaa can be any naturally occurring amino acid
  unsure (1)..(138): unsure at all Xaa locations
MKLLQASVCLISLILVLPSIFAASSSEDFDFFYFVQQWPGSYCDTQKSCCYPTSGKPAADFGIHGLWPNYKDGTYPSNCDDTKPFDSSTISDLVSSMKRNWPTLACPSGSGEAFWEHEWXEKHGPCSQSVIXQHEYFQ

SEQ ID NO: 6465 - protein, 351 aa, Nocardioides sp. JS614
MTQIMQALVVREPNVLEIAEVPVPEPGRNEVLARVRSVSICGTDAHLINGDYPGFWPPQFPFTPGHEWAGDVVALGEGADTFGWRVGDRVAGTSHSACGACQKCVEGQYNLCENYGRPALHAQYGHNAQGVNATYAVHNVKSIFRLPDEVSFDVGALADPASIALHVARRGNIKPGDTVAVTGAGAIGLLAADAALIDGAARVIVVGRGHRLERAAALGFETVDTRTGDPVAEVRGLTSGLGADVVLECAGVPETLIWGMAMLRRGGRCAMVGIPTEDVSLKCQPLVLDELELVGSRASAGEMRRVLPFIANGRMRAEELITHHFPLSEYDKALATFNDRASGAIKIIVNP

SEQ ID NO: 6466 - protein, 251 aa, Geobacter sulfurreducens PCA
MKITILGSGTSTGVPMVGCTCSVCSSTDPRDKRTRASLLIEAAGRYILVDTSPDLRRQALREHIPHIDAVLLTHSHADHVNGIDDLRGFHFIHRRVIPCYGNRETMDAVLRNFSYIFKGMEAAGYAPLLDPHVIHDPFALFGRTIVPIHLHHGTMPATGYRIDGAAYLTDCSRIPESSLALLGGLDLLVIDALRYTPHENHFNIDGALGVVAELRPKRTIFTHLTHEVAYADGIRLPEGVEFAYDGMTVSL

SEQ ID NO: 6467 - protein, 254 aa, Brassica napus
  misc_feature (98)..(98): Xaa can be any naturally occurring amino acid
  unsure (1)..(254): unsure at all Xaa locations
MATSSAMSLQSISKTSLGNLSHNHHFHRSSFLGFSRSFQNLGISSNGPDFSSQSRSTSKNLSPTRAFFWNWGKSENARPSKVQELNVYELNEGDRNSXPAVLKLGKKPELCLGDLVPFTNKLYTGDLKKRVGITAGLCVLIQHVPEKNGDRFEATYSFYLGDYGHLSVQGPYLTYEDTFLAVTGGSGIFEGAYGQVKLRQLVYPTKLFYTFYLKGIADLPLELTGTAVSPSKDVKPAPEAKATEPGATIKNFTN

SEQ ID NO: 6468 - protein, 569 aa, Salmonella enterica subsp. enterica serovar Typhi
MFEEKLGQQYLAALHQAFPGVVMDEAWQTKDQLTITVKVNYLPEVVEFLYYQQGGWLSVLFGNDERQLCGHYAVYYVLSMEQGTKCWITVRVEVDANKLEFPSVTPRVPAAVWGEREVRDMYGLIPVGLPDERRLVLPDDWPDELYPLRKDSMDYRQRPAPTTDAETYEFINELGDKKNNVVPIGPLHVTSDEPGHFRLFVDGENIIDADYRLFYVHRGMEKLAETRMGYNEVTFLSDRVCGICGFAHSTAYTTSVENAMGIQVPERAQMIRAILLEVERLHSHLLNLGLACHFTGFDSGFMQFFRVRETSMKMAEILTGARKTYGLNLIGGIRRDLLKEDMIQTRQLAQQMRRDVQELVDMLLSTPNMEQRTVGIGRLDPEIARDFSNVGPMVRASGHARDTRADHPFVGYGLLPMEVHSEQGCDVISRLKVRINEVYTSLNMIDFGLDNLPGGPLMVEGFTYIPHRFALGFAEAPRGDDIHWSMTGDNQKLYRWRCRAATYANWPTLRYMLRGNTVSDAPLIIGSLDPCYSCTDRMTVVDVRKKKSKVVPYKELERYSIERKNSPLK

SEQ ID NO: 6469 - protein, 458 aa, Bacillus thuringiensis serovar konkukian str. 97-27
MSTKMTPPVEKNEFIDVVFEDLTHDGAGVAKVKGYPIFVKNGLPGEEAQIKIVKVKKNFAFGRLMKLHTESPYRKEAECPVYNQCGGCQLQHLTYEGQLQAKEKQVRDVMQRIGGLGDVPVHPVLGMKNPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVAWLKLV

SEQ ID NO: 6470 - protein, 339 aa, Mycobacterium sp. KMS
MLPSTVTDRKPSSARLTRSGSTGRVRSVIRVAALTTASRVRFLPRGAGSLPRTGGAEAGRLGGMGAPLVALNDGNSIPQVGLGVWQTPPEDTERAVAAALAAGYRHVDTAAAYGNEEQTGRAIAQSGLDRSQVYLVTKLWNSEQGYDATLAAFEASVDRLGVDYLDLYLIHWPVPEKNLFVDTFKAFARLREDGRIRSIGVSNFEPEHLRVLIDSTGIVPAVNQIELHPLLPQRELRELHAQLGIATEAWSPLGQGSLLAHPTVTGVAESHGKTAAQALIRWHMQLGNIVIPKSVNPQRIESNFDVFDFELSEQDMASISSLEDGSRLGPDPKTFNFTG

SEQ ID NO: 6471 - protein, 373 aa, Oryza sativa (japonica cultivar-group)
MEAAALGVPLVQVRAAVAAYGRGAGKGKGKRRVVGAFHAPPGRRRTALVAALPEPLQPLSPAQDGAVALASTEADGGEEVHGDVASAEISSPSGVLGKTVRVRFVLKRECTFGQSFHLVGDDPALGLWDPSKAVPLDWSEGHDWTVEKDLPANKLIEYKFVLQDLSGKLHWQNGRNRSVQTGETANILVVYEDWGNANSQTVEEEGKVSIGMEEGKLSVGMEEAVVPDDSESRDDIIVADELQVDDNLAVMQNESSVREDDKKSTVGTVTSVQAELMKLHEANQPELIVDEPQIQEALPETADTEPENGGVATCADDRYAESTDDDGVPVGGTDDDGVPVENRWTGAFEHELLWGWKALQQLLMSLGFKMDTS

SEQ ID NO: 6472 - protein, 163 aa, Bacillus cereus G9241
MDKQIGFIGCGNMGMAIVGGMLNKHIVPSNHIICSDLNTTNLENASEKYGISITTDNNEVAKNADILILSIKPDLYPLVINEIKEVIKNDAIIVTIAAGKSIESTENAFNKKLKVVRVMPNTPALVGEGMSALCPNEMVTEKDLEDVLNIFNSFGQSEIVSEK

SEQ ID NO: 6473 - protein, 490 aa, Neisseria gonorrhoeae FA 1090
MNQTSRDLTRISHNTKIVATLGPGSNNVELLEDMIRVGGLNVVRFNFSHGTPEFHQENARIVREAAKRAGQEIAIIADLQGPKIRVGKIAGGGIELNKGETLVLDAALEGEGTREAVGLDYRDLPDDVAAGDVLWLDDGLLTLTVESVEGSRIITRVENSHILKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQTEYPEAVSTNLAIAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 6474 - protein, 478 aa, Pyrococcus abyssi GE5
MIAMRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 6475 - protein, 133 aa, Triticum aestivum
  misc_feature (36)..(36): Xaa can be any naturally occurring amino acid
  misc_feature (40)..(40): Xaa can be any naturally occurring amino acid
  misc_feature (43)..(44): Xaa can be any naturally occurring amino acid
  misc_feature (46)..(46): Xaa can be any naturally occurring amino acid
  misc_feature (50)..(50): Xaa can be any naturally occurring amino acid
  misc_feature (76)..(76): Xaa can be any naturally occurring amino acid
  misc_feature (87)..(88): Xaa can be any naturally occurring amino acid
  misc_feature (92)..(92): Xaa can be any naturally occurring amino acid
  misc_feature (102)..(102): Xaa can be any naturally occurring amino acid
  misc_feature (104)..(104): Xaa can be any naturally occurring amino acid
  misc_feature (107)..(107): Xaa can be any naturally occurring amino acid
  misc_feature (111)..(111): Xaa can be any naturally occurring amino acid
  misc_feature (115)..(115): Xaa can be any naturally occurring amino acid
  misc_feature (120)..(121): Xaa can be any naturally occurring amino acid
  misc_feature (123)..(123): Xaa can be any naturally occurring amino acid
  misc_feature (126)..(131): Xaa can be any naturally occurring amino acid
  unsure (1)..(133): unsure at all Xaa locations
PSSSLVTEISSSAQQQWPRETFIMIKPDGVQRGLIXEVIXRFXXKXFYLXGLKLQNVEKSVAEQQYSDLSSKPFFXGLVEYIVSGPXXRLWXWSGLRAVCLXLXRKXIGGXNPLXSEPGXXRXDFXXXXXXNL

SEQ ID NO: 6476 - protein, 171 aa, Brassica napus
  misc_feature (97)..(97): Xaa can be any naturally occurring amino acid
  misc_feature (168)..(168): Xaa can be any naturally occurring amino acid
  unsure (1)..(171): unsure at all Xaa locations
MSAMTVPNLAVGSDHHLMPVIGFGTAASPPPEPLLLKQAVIDAIKLGYRPFDTSPRYLTEEPLGEALAEAVSLGLIGSRSELFVTSKLWCADAHGGXLVVPAIQRSLKNLKLDYLDLYLIHWPVSSKPGKYKFPIEEDDFLPMDYGAVCSEMEECKRLGLAKSRGLSXPHP

SEQ ID NO: 6477 - protein, 177 aa, Brassica napus
  misc_feature (67)..(67): Xaa can be any naturally occurring amino acid
  misc_feature (116)..(116): Xaa can be any naturally occurring amino acid
  misc_feature (132)..(132): Xaa can be any naturally occurring amino acid
  misc_feature (147)..(147): Xaa can be any naturally occurring amino acid
  misc_feature (172)..(172): Xaa can be any naturally occurring amino acid
  unsure (1)..(177): unsure at all Xaa locations
MGEKEKKSKKKKNKDSKSSPDISFKPSSAVKGLKFGGQIIVKSFTIRRARTLELLKLLSLPSPTSPXPPLLSTAAYLPTNFTILAHQAWHTLTLGLGTRKSKVVVFVFETEAMKTXVAAAEGGLWPSEIPLXDVNKKMIRKLKNWEXARFKFRKGCLTFYVYAVRNAGKEGXAAAED

SEQ ID NO: 6478 - protein, 1387 aa, Aspergillus nidulans FGSC A4
MFQINRELAALGIEWNPRRIYYLETWRYPEVESPTRWNIRDGLLEDFQVEEWLNQRGEFSPPVPPAEVGNGSHGGIRLLACNYHLFPKISVGMSPETFGLAPQKYEIGNYMLSLTYDMSSHWTTALLAGESIVDTASTIFNRSSLPLAPLSPCDVVREYLMSSPTLWDHPLMLPCIVLSHHLRRLQHHCNRDLTPIVMGIEAQLGVTRVGRRNFDARPRSINAIKDGPVARVQSEHLTVTINTQLTRVGFTARNPKWNYEASALLEKIVTELAAYTPALRPEANEEILGVLDHNITLAKSLEDNVLGLQKRLELQLNVLYSFVAQTDNRLSARLAATAGRDSTSMKILAFITTIFLPGSYVASLFSMNMFNWEDGASGSEGPGSGGSTISPQFWIYWTVAAPLTALTLAGWALWWSFEKHRYDEHLEGNRQDTRVKIPPWWRRILETRHTLNPGLADDYLRFAQQRYETSRPRSKAQHQRATSHLPGGNTRSVLHATPFPLCMQAGKGNRLVDVDGYEYIDCMGDMTACLYGHSHPVIMETVDSTMKSIGMNLGSSTSAEAHFAEALCDRFASIDHIRFCTSGTEANLYALSVARQSTNRTKVIVFEGAYHGGVLSFSHGIAPNNVDKDDWILGQYNDIDGAVQLITENKDIAAAVVVEGVQGAGGCIPGSAGFLHAIQDAARENGIIFILDEVMTSRLAPGGLQSILLHPDHGTPLKPDLTTFGKWIGGGLSIGAFGGRRDLMSVYDPRTSIIHHSGTFNNSTLAMNVGCKGLTSVYTPEACTSLNNLGDELRSGLQELAKGTKMVVTGLGAVMNIHFVRASGSRVVARTSDLEVNSGSVEEALRDLLWFYLIERGFWIARRGMISLILGTGVEEVEQLKGVVGDFLEDFRELVSAYLLPVAALATAVSTHPQTPSDLIVATSSGIVHGIYNDTAHKVRAFLGIPYAEPATGDLRFAPPQPRAPSQHPINASSFGAPCPQVYNYDNESIWNVLPYRIRNVEDMSEECLFVNIWTPAEHQTKKSGAGRKGKAVMLFIHGGGFGEGAGSVGFYDGVDLASSEDVVVVTFNYRLNVFGYPNAPGLDPAEQNLGLLDQRLAVQWVHQNIANFGGDPDRILLFGQSAGGASVDAYAYAYPEDPLVSGFVLQSGTVSLFNNADTAHANWNRLSTAVGCSAGDGSLACMRSVSFSRILEVLGNGSYTFTPVADNRTVFSDYIARAKAGGLARLVRIRTPLTRCQPTLAGINAREFSAGFPLSQSSINETAVTEDLFGSFSCPAYQAVKTRLRQHIPTWRYVYHGNFTNLSPKPWLGAYHSGAWVAFAQNRHTGLEDYGWPLFTFNETTLVNLAVDNRPGAVLGSAEDWDRHCRGDVYIGYTIPDSLQLHVYNM

SEQ ID NO: 6479 - protein, 481 aa, Xanthomonas campestris pv. campestris str. 8004
MFPGEPMSSVSIDGAPDAGENTRFIILISCVATIGGFLFGFDSGVINGTVDGLKQTFQSSAAETGFEVASMLLGCAIGAFFAGRLVDRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 6480 - protein, 242 aa, Campylobacter lari RM2100
MSEIYILGNGAMASAIAKGIGDAYEVIIVARDLKKASSLNFKVISYNEFDMDNKNIILAFKPYALEEVAVKLKGKARWLISVLANTTFEQLHCIDAQNYIKIMPNTAAQFKASATAYLMENDLYKDEILSLLSTFGKAISLQNEKEFDIAMVLSGCAPAFLALVAESLANAGVKNGLKNELSYELTRASFESFGALFNHIHPAIIKEKICSPAGVTIRGVEALEKRALRGAFFEAFNASLNK

SEQ ID NO: 6481 - protein, 627 aa, Zea mays
  misc_feature (187)..(188): Xaa can be any naturally occurring amino acid
  misc_feature (227)..(227): Xaa can be any naturally occurring amino acid
  misc_feature (405)..(405): Xaa can be any naturally occurring amino acid
  misc_feature (448)..(448): Xaa can be any naturally occurring amino acid
  misc_feature (470)..(470): Xaa can be any naturally occurring amino acid
  unsure (1)..(627): unsure at all Xaa locations
MSPFQGYRGDAVLSGVRSRKRVFATVAAEPVTAAPKRQKRGDEMPLDALPDECLFEVLRRVQGTRARCASACVSHRWLALLAGIRASEAVLAPAAPAVPDLNQEYLSEDDEADLMDLDGDARERTLEGMEATDARLTAAAVAGRLAAVSVRGSHPARGVTDAGICALARGCPELRSLTLWDVPQVTXXAGLAEVAAECHSLERLDISGCPMITDKGPRVVAQGCPDXVVTIEGCSGVANEGLKAVGRFCAKLQAVSIKNCALVDDQGVSGLVCSATASSLTKVRLQGLNITDASLAVIGYYGKSIKDLTLSRLPAVGERGFWVMANALGLQKLRCMTVVSCPGLTDLALASVAKFSPSLKTVNLKKCSKVSDGCLKEFAESSRVLESLQIEECSKVTLVGILAFXLNCNPKFKALSLSKCIGIKDICSAPAQLPVCKSLRSLTIKDCXGFTDASLAVVGMICPQLESIDXSGLGAVTDNGFLPLMKKGSESGLVRVGLNGCESLTDAAVSALAKAHGASLAHLSLEGCSKITDASLFAISESCSQLAELDLSNCMVSDYSVAVLAAAMQLKRRVLSLSGCMKVTQKSVPFLGSMSSSLEALNLQFNFIGNHNIASLEKQLWRCDILA

SEQ ID NO: 6482 - protein, 185 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKGLNSSLTTGHI

SEQ ID NO: 6483 - protein, 374 aa, Burkholderia sp. 383
MTLAGTLEIVDELRAGRMVLLVDEEDRENEGDLVIAADHVTPDAINFMARFGRGLICLTLTAERCEQLKLPPMADHNGTPFGTAFTVSIEAAEGVTTGISAADRAHTIRAAVRAGARPDDLVQPGHVFPIAARPGGVLVRAGHTEAGCDLAALAGLTPASVICEVMNDDGTMARLPELKVFAAQHGLKIGTIADLIHYRREHESLVERVGERPLHTPWGRFRAIEYRDTVHGAPHLALVRGEPDPSTPVLTRVHECHSLLDLLDAEPSAHSWPLHAALQRIDAAGCGVAVLLDCDMRGDPMRAPASHARRDGRVTGIGSQILRELGVRRLNVLSSPFRLPALSGHDLEIMAFIPLGDDDPESARGALASPLRVA

SEQ ID NO: 6484 - protein, 393 aa, Staphylococcus aureus subsp. aureus MSSA476
MQFDNIDSALMALKNGETIIVVDDENRENEGDLVAVTEWMNDNTINFMAKEARGLICAPVSKDIAQRLDLVQMVDDNSDIFGTQFTVSIDHVDTTTGISAYERTLTAKKLIDPSSEAKDFNRPGHLFPLVAQDKGVLARNGHTEAAVDLAKLTGAKPAGVICEIMNDDGTMAKGQDLQKFKEKHQLKMITIDDLIEYRKKLEPEIEFKAKVKMPTDFGTFDMYGFKATYTDEEIVVLTKGAIRQHENVRLHSACLTGDIFHSQRCDCGAQLESSMKYINEHGGMIIYLPQEGRGIGLLNKLRAYELIEQGYDTVTANLALGFDEDLRDYHIAAQILKYFNIEHINLLSNNPSKFEGLKQYGIDIAERIEVIVPETVHNHDYMETKKIKMGHLI

SEQ ID NO: 6485 - protein, 510 aa, Desulfitobacterium hafniense Y51
MKPLLLMILDGWGYNPQSAGNAVAKAPKPHFDRLLEEYPHTLIVASGEEVGLPPGQMGNSEVGHLNIGAGRVVYQEFTRISQAIRTGEFARNRVLQEAMERVKDGPNALHLMGLLSDGGVHSHSEHLFALLAMAKTMGVKKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGKPLQLHYVCMTEYDDKLKGAAVAFPAQNLDNTLGEVLAKHQKKQLRIAETEKYAHVTFFFNGGVEEPCPGETRCLIPSPQVATYNLLPEMSAYGITEELLKRLEREEDEVIILNFANADMVGHTGEFEATVKAIAAVDQCIGQIVPRVLERQGTVIITADHGNAEAKVDLQTGQPLTAHTTNPVPLILVNDQLKGKTLREGGALRDVAPTMLRLLEIPQPQEMTGKSLI

SEQ ID NO: 6486 - protein, 261 aa, Desulfitobacterium hafniense Y51
MKGAHFMAKRHPIIAGNWKMNKSLRETQEYAVKLLGVLGEVTAIDVVVCAPFTALNVLKNELEESVIHIGAQDMFYAPDGAYTGEISAAMLVDVACTYVILGHSERREILRETDEEIAKKVKAALKAGLTPILCVGENLANREEGKAFAIVRGQVEKDLTDLAPDDLKRVVIAYEPIWAIGTGKTASSEDAQEMCAMIRSTLAGIAGVVADEVNILYGGSVKADNIGELMSQPDVDGALVGGASLEAEGFAQLVQNAVAVL

SEQ ID NO: 6487 - protein, 272 aa, Bacillus thuringiensis serovar konkukian str. 97-27
MNKQIGFIGCGNMGIAMIGGMINKNIVSPNQIICSDLNVSNLKNASDKYGITITTNNNEVANSADILILSIKPDLYTSVINQIKDQIKNDVIVVTIAAGKSIKSTENEFDRKLKVIRIMPNTPVLVGEGMSALSFNEMVTEKDIKEVLTIFNIFGQTEVVNEKLMDVVTSISGSSPAYVYMFIEAMADAAVLDGMPRKQAYKFAAQAVLGSAKMVLETGIHPGELKDMVCSPGGTTIEAVATLEEKGLRTAIISAMKRCTKKSMEMSSLTSK

SEQ ID NO: 6488 - protein, 480 aa, Geobacter metallireducens GS-15
MDKSSRKTKIVATLGPASSSPEMISKLMEAGADLFRLNFSHGANDQRRETIATIRRLSAARGKEIGILADLQGPKIRTGRMENGAISLRKGDPLDIVTDEVLGTPTLISTIYKALPHDVKPGSRILMDDGLIELKVHSVEGNLVRCTVVEGGTLKDLKGINLPGVHVSAPSLSEKDLRDLEFCLAEGVDYIALSFVRSAEDVEGLKRILFERGIHIPVVAKIEKPEALRNFKSILKAADGVMVARGDLGVEISAEKVPLFQKKIIRACNEAGKPVITATQMLESMISHPRPTRAETSDVANAILDGTDAVMLSGETASGQFPLEAVRTMAKVALDVERYAQMEDTLPQRRHNPSIAEAVAEAACRAAVTVDARAISVMTQSGSTAALISKFRPPLPIIAFTQSLETRRRLSLYWGVKPLPIGPMTGTDEQIAAVESTFLSAGYRKGDVIVITMGVPVEARGSTNLMKVHKLGTGKFFEIF

SEQ ID NO: 6489 - protein, 578 aa, Alicyclobacillus acidocaldarius
MELVWQHRWAADAYPLDLSTMVLVLRVARCTPAQRVRVHFGDRYEPDFQNSSEARRYGSDGTFDWFTCRVAAPTRRLKYAFEVLSSTGRAVYLGEGGLADTLDAVQPFQYPYIHPSRVLAVPDWVGHAVAYQIFPDRFAVGEQQLVRPTDPWDARPTPDSVFGGNLRGIVDKLPYLSDLGVNLMYLTPIFQAPSNHKYDTQDYFAVDPAFGTLGDLQLLVREAHRLGIRVVLDAVFNHSGFQFAPFQDVIARGTASPYWSWFFVQGDRVDVESVNYETFATRLRHMPKLNLAEPAAEEYFLQVAKHYVLECDIDGWRFDVANEIDPHFWSRLRSELRALKPDILLIGEIWHDSLPWLMGDAFDGVMNYPLRELVMRYAMDESIDEPAFAEAWVRLYLQYPRPAWRAMWNLLGSHDTERALTRARGHVPSVVLAFAMLFTLPGIPMVYYGDEIGMEGGTDPDCRRGMIWDANLWQLDLREAVRQLAWLKRTHPALAGDTMEIRDANSGVLHYVRLNGTGPHLHIAVCKRRDFGAEVDSPLFAWDVPSRTSGEERKILIWECDSTEGCGHDSRADGFHNQ

SEQ ID NO: 6490 - protein, 270 aa, Streptomyces rochei
MTSGAQAPEDRVEDKVVDFYDNFTEVFREIWGDNLHVGYWHDDADDAPIEKATDQLTDQLIARLAPAPGQRILDVGCGVGEPAFRLARTADVEVVGVSISAYQVGRAGERARDFGLADRVSFRHADAAELPFPDASFDGGWAFESLIHMPDKEKVLREIKRVLRPGATLVLADMFSQPDTELTFQDIITTPEMADYRAVIESAGLVVREFTDITAHTLAPPAVRESVAADLLARKDDVIAMTGPEEFARMVDGVRVPKAYGYLLATVTTD

SEQ ID NO: 6491 - protein, 384 aa, Enterococcus faecalis V583
MDRKNIATRYQQPTENLLMDIATLAKKTPNLIDLSIGDPDLITDERIIEQAANDAKNGHTKYTASDGSEAFIEAVIQFYQSHYQLSFQPNQVRATVGALHGMYLALQVILNPGDEVIIHEPYFSPYKDQVLLADGVPVFLPTYEEDGFQIDVALLKEKITPKTKAIILNSPNNPTGAVFSEETFREIAQVAIEHNLYILSDEVYEAFCFQETFTPMATFAPENTITFGSFSKAFAMTGWRIGYMIAPDYINEVAKLINEGVTYSAPTLSQQAGIYALQHFDEFVDPIVEVFQTRLEYVAQRVAKIPFLSLHPVKGSIYAFINIQKTGLTSVPFVEKLLKETQVLVIPGKAFGETTGDEYIRLAATQNLDLLKEAFDRIERMTFE

SEQ ID NO: 6492 - protein, 218 aa, Zea mays
MILFPLPTTEKPVQANIKQARPSFSSPLTLDASPPLLPHPSIAPSLRSALPQPHPCAPADSRRPLLEGTMEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 6493 - protein, 230 aa, Bordetella pertussis Tohama I
MSNVVPTPVFPLFAQPFATRLERALQHLRIGRPVILMDDFDRENEADLIVAADKLTVPVMAQLIRDGSGIVCLCLPGETLDRLELPPMVDSNRSRYSTAFTVSIEAREGVTTGVSAVDRVTTIRAAIAPGARSGDVVSPGHVFPLRAQPGGVLTRRGHTEGSVDLAALAGLRPAGVLCELMNADGTMMRGASLERYAAKEGLVALAIDELAAHLQARGATGAPAELAVAA

SEQ ID NO: 6494 - protein, 445 aa, Acidobacteria bacterium Ellin345
MSKAQQLVRSVGLFDATMLVMGGIVGSGIFINPYVVAQQVHTAPLILGAWLAGGVIATLGAFIYAELAGRQPSVGGQYAYLRDAIHPLAGFLYGWVLLLVIQTGGMAAVTVTFARYFLVLTHWAVPERVVAVVTLSLLTLINCLGVKFGSRVQSALMILKIGAIAFLVVAGFLYIREPFAVGGTVLDRPLSPGLLSSFGAAMVPVLFAFGGWQTANFVAGEVRDPRKNLARALLLGVAGVIVLYLAVNFVCVRALGPVGLAATRVPATDVMRLAMAQRGATIVTLGITVSTLGFLSQSILTAPRVYFAMAEDGVFFRAVAKVNEKTHVPILAIVLQSVWTIVVALTGRYEQILNYVVSMDFVFFGLTACTLFVFRKRSSLENGASGGFQVPGHPWTTLVFIAASWLVVTNTIYKYPANSLLGFAILLVGMPVYWLWRRKGKVLSQ

SEQ ID NO: 6495 - protein, 322 aa, Candida tenuis
MSASIPDIKLSSGHLMPSIGFGCWKLANATAGEQVYQAIKAGYRLFDGAEDYGNEKEVGDGVKRAIDEGLVKREEIFLTSKLWNNYHDPKNVETALNKTLADLKVDYVDLFLIHFPIAFKFVPIEEKYPPGFYCGDGNNFVYEDVPILETWKALEKLVAAGKIKSIGVSNFPGALLLDLLRGATIKPAVLQVEHHPYLQQPKLIEFAQKAGVTITAYSSFGPQSFVEMNQGRALNTPTLFAHDTIKAIAAKYNKTPAEVLLRWAAQRGIAVIPRSNLPERLVQNRSFNTFDLTKEDFEEIAKLDIGLRFNDPWDWDNIPIFV

SEQ ID NO: 6496 - protein, 349 aa, Streptococcus pyogenes MGAS8232
MKAATYLSTGNLQLIDKPKPVIIKPTDAIVQLVKTTICGTDLHILGGDVPACKEGTILGHEGIGIVKEIGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTAQFFSPANIIMVDLSQNRLEAAKTFGATHTICSGSSEEVKTIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 6497 - protein, 280 aa, Acidobacteria bacterium Ellin345
MTSKAKSTSKLSQQTVAILGLGKIGSILLQAMLREGLLSPKRVRATVNHADKTAKLTQEFGIQVGTDNAAAIKGADIILVALKPQQIGTVLTSLRDEIKPNQLLISVAASVPTAYMEERLAAKVPIIRAMPNTPSMLGAGMTGICKGAHATAAQLDLAQAMFNTVGRTAIVEEKHMDAVTGLSASGPAFIYIIIESLAEAGVKVGLPRDLATLLAAQTTMGAAQVVLETGQHPAQLKDAVTTPAGCTIDGILELEEGKLRVTLIKAVVKAAQRAKELVFS

SEQ ID NO: 6498 - protein, 273 aa, Nostoc punctiforme PCC 73102
MLEDLQIAFIGGGTMGEMIISRLLLTKIVPKADLIIVSDPVSARCLHLEREYGVRTTTSNIEAVLGASIVILAVKPQVLAEVLGMLKDKIPPNALVISIVSGANISSLCQGLNHPAVVRTMPNIAVQVGHGTTVWSASSSVTEIQRSHTQVILQALGKEFTTQNEHYLDMATALSSAGTGFVFLYIEAMIDAGVQMGLTRTQAQELTLHTIAGSVELMFQTHEHPAVLRNKVTSPGGVTAAGLYELEKGGMRTVISNAVLAALSRNQQLGNIS

SEQ ID NO: 6499 - protein, 263 aa, Neisseria gonorrhoeae FA 1090
MNVYFLGGGNMAAAVAGGLVKQGGYRIHIANRGAEKRERLGKELGVETSATLPELHSDDVLILAVKPQDMEAACKNIRTNGALVLSVAAGLSVGTLSRYLGGSRRIVRVMPNTPGKIGLGVSGMYAEAEVSETDRRIADRIMKSVGLTVWLEDEAQMHSITGISGSGPAYVFYLLDALQNAAIRQGFDMAEARALSLATFKGAVALAEQTGEDFEKLQKNVTSKGGTTHEAVEAFRRHRVAEAISEGVCACVCRSQEMERQYQ

SEQ ID NO: 6500 - protein, 740 aa, Vitis vinifera
MNGAVLVAIAAAIGNFLQGWDNATIAGAIVYIKKELDLESTVEGLVVAMSLIGATLVTTCSGAISDWIGRRPMLIVSSMLYFISGLIMLWSPNVYVLLIARLLDGFGIGLAVTLVPIYISETAPADIRGSLNTLPQFTGSGGMFLSYCMVFGMSLLSSPSWRLMLGILSIPSLLYFTLTVFYLPESPRWLVSKGRMVEAKKVLQRLRGREDVSAEMALLVEGLGIGGETSIEEYIIGPTGELTEDQDPDAVKDQIKLYGPEAGLSWVAKPVPGGQSTLSLVPRQGSLATQTLPLMDPLVTLFGSVHEKPPETGSMRSMLFPNFGSMFSTADPQIKTEQWDEESLQQEGEDYASDGGGDSDHDLQSPLISRQTSSMEKDMVPPPSHSSIMSMRRHSSLMQGTAGEAAGGMGIGGGWQLAWKWSEREGEDGKKEGGFKRIYLHEEGVPGSRRGSLVSLPGGDVPAEGDYIQAAALVSQPALYSKELMDQDPVGPAMVHPAETASRGPMWAALLEPGVKHALFVGAGIQILQQFSGINGVLYYTPQILEEAGVEVLLESLGLGTESASFLISAFTTLLMLPSIVVAMKLMDIVGRRRMLLTTIPVLIVTLLVLVIGDLVTTTTVIHAAISTACVIIYFCCFVTAYGPIPNILCSEIFPTRVRGLCIAICALVYWIGDIIVTYTLPVMLTSIGLTGIFGIYAVVCVISWVFVFLKVPETKGMPLEVIAEFFAVGARQVTAAKND

SEQ ID NO: 6501 - protein, 290 aa, Arabidopsis thaliana
MEKNQSDDDGTALIFLGTGCSGAVPDFRCLLQPSDPPCHVCSQSLSLLPHLNPNYRCNTSLLIDYCSKEEDGRHKYILIDVGKSFREQIILTHEHADAVHGLDEIRSLQPRGATIVDTDPLPVFLSQFTMESIATRFPYLVEKKVKEVPRRVSLLDWKNIEENCDEPFAASGLSFTPLPVMHGEDYIALGFLFGDKSKVAYISDVSRIPPSTEYAISKAGAGQLDLLILDTNIPWKRGPHPTHICFTEALEILKRLCPKRALLTGMTHEFDHHEYNEILAEWSLRDYVDF

SEQ ID NO: 6502 - protein, 476 aa, Haemophilus ducreyi 35000HP
MSVNRVLDLIKENDIKFVMLKFTDIKGKEHGVSLPVSLVVDDLEALFEEGKMFDGSSVEGWKAINKADMLLMPISETAVVDPFAQIPTMTIRCSIYEPNTMQPYDRDPRSIATRAENFLKSTGIADSVMFGPEPEFFLFDDVRYATEANNVSYKIDDIEAMWNTNRKYEDGNNAYRPLKKGGYCAVAPLDSAHDIRSEMCLIMEQMGLIIEAHHHEVATAGQNEIATKFNSLTLKADETQIYKYVVQNVAIAHAKTACFMPKPFAGDNGSGMHCNMSLSKAGKNIFMGDKYAGLSETALYYIGGIIKHAKALNAFTNPTTNSYKRLVPGFEAPVLLAYSASNRSASIRIPAVTTPKATRIEARFPDPMANPYLCFAALLMAGLDGIINKIHPGDAMDKNLYDLPPEELQDIPAVASSLAEALDALSTDFTFLTQGNVFSKAFIDAYIAIRRKEVERLNMTPHPVEFEMYYAYSGLK

SEQ ID NO: 6503 - protein, 610 aa, Ustilago maydis 521
MVRIMKSLGFLSCLAALLSSNVTAAARIDSANRQIKMAVGARTNGSWDSAPAPAPAPARPGSYLETQDGYAASTSTATGSSAQAQIDGVLTTSSGIGGPARIELPLDAISSAAFGSADVEQIIASANGEFTVLSHRDFPSVSVRIKQLYSPRPASQLREHEVDPDAFCDPTVTSWSGYIDTAYGGKSLWFYFFESRSNPAKDPVILWTNGGPGCSSSLGLFMELGPCRVPERGGKLTPGPPINGTKWHAQSWTNRANVFFIDQPVGVGYSYSKTDQKVYTTEEAAKDVYAFLRVFFSAFDRFKKNEFYMAGESYGGRYIPIFASEVADRNHDVERKALKAGKQVDHDQLINLKGVLIGNGLTDVSKQISGYYDMTCTRRGGVEPILSIETCKRMHTYVPVCREQLGKHCVESYNPDLCDLWLAKCSDEIEAPYFYTGQNPYNIKDDCKSGLEPNLCYDVTDDIRKYLDRDDVRELVGAASKDQIGKFASCNNDVASGFSRMLDMAHDNGFNVAGLLERGIKALVYVGTLDWICNFNGNFEWVKTLDWSGSQSFSEAKNYEWVVDGEKAGRTQSGGGLTWVTVYEAGHMVPYDQPDAALAMLNRWIDGQDL

SEQ ID NO: 6504 - protein, 358 aa, Zea mays
MAAGGADQRGNNAATTTFVVPAVALSLGKPMPRVGFGTATATLGQAEGRAGVTEAILRALDAGYRHFDTAAVYNTEASLGDAVVEAVRAGTVASRDDLYVTSKLWITDAHPGRVLPALHRTLQNLQMSYVDLFLIHHPVSMRAPADDEAEGAGPAVVVKKDLVAMDMEGVWEEMEECHRRGLARAIGVSNFSCKKLEHLLSVAKIPPAVNQVEVNPYCRQEKVRNFCRANGIQLCGYSAMGASGTAWANNSVMDSPVLKQIAHARGKTVAQVCIRWVYEQGDCVIVKSFNQSRMRETLHIFDWELTDDDHRKISELPESRGNYDFLIHESGPYKTAQELWDGEITAGQSNQTPLVSDD

SEQ ID NO: 6505 - protein, 617 aa, Arabidopsis thaliana
MEFNCLPPTFITLRLMRRKLPFSMCCGYCLQASYSCLYFRKFLEVTPVLGYLAAGILIGPYGLSIIRNVHGTKAIAEFGVVFLLFNIGLELSVERLSSMKKYVFGLGSAQVLVTAAVIGLITHYVAGQAGPAAIVIGNGLALSSTAVVLQVLQERGESTSRHGRATFSVLLFQDLAVVVLLILIPLISPNSSKGGIGFQAIAEALGLAAIKAAVAITGIIAGGRLLLRPIYKQIAENRNAEIFSANTLLVILGTSLLTARAGLSMALGAFLAGLLLAETEFSLQVESDIAPYRGLLLGLFFMTVGMSIDPKLLLANFPLIMGTLGLLLVGKTILVVIIGKLFGISIISAVRVGLLLAPGGEFAFVAFGEAVNQVIIYMMISVFCFFTMGLVTAVFLGELDWYFFQGIMTPQLSSLLFLVVGISMALTPWLAAGGQLIASRFELQDVRSLLPVESETDDLQGHIIICGFGRIGQVLHKIGADRACAAAIALDTPGANYRCVWALSKYFPNVKTFVRAHDVDHGLNLEKAGATAVVPETLEPSLQLAAAVLAQAKLPTSEIATTINEFRSRHLSELAELCEASGSSLGYGFSRSTSKPKPPSPSETSDDNQIIEGTLAI

SEQ ID NO: 6506 - protein, 220 aa, Brassica napus
GRVGKKVQVSLDQRLYPENPLITWENSRSPAPQEGFEIKRKGNQEFAATIRLEMNYVPEKFKLSTALMDVLGIEVETRPRIIAAIWHYVKARKLQSPNDPSFFNCDAALQKVFGEQKLKFTMVSQKLSHHLHEHRRRHALHWDSVSGSSPAVSACYDVLVDVPVTIQRDLSNLLANAEKNKEIEACDEAICAAIRKIHEHRRRRAFFLGFSQSPAEFETR

SEQ ID NO: 6507 - protein, 400 aa, Sinorhizobium meliloti
MAFLADALSRVKPSATIAVSQKARELKAKGRDVIGLGAGEPDFDTPDNIKKAAIDAIDRGETKYTPVSGIPELREAIAKKFKRENNLDYTAAQTIVGTGGKQILFNAFMATLNPGDEVVIPAPYWVSYPEMVALCGGTPVFVPTRQENNFKLKAEDLDRAITPKTKWFVFNSPSNPSGAAYSHEELKALTDVLMKHPHVWVLTDDMYEHLTYGDFRFATPVEVEPGLYERTLTMNGVSKAYAMTGWRIGYAAGPLHLIKAMDMIQGQQTSGAASIAQWAAVEALNGPQDFIGRNKEIFQGRRDLVVSMLNQAKGISCPTPEGAFYVYPSCAGLIGKTAPSGKVIETDEDFVSELLETEGVAVVHGSAFGLGPNFRISYATSEALLEEACRRIQRFCAACR

SEQ ID NO: 6508 - protein, 586 aa, Lactobacillus sakei
MKKTKIVSTLGPASNSVEIITKLIEAGANVFRFNFSHGDHEEHLSRMNMVREAEKATGKTVGIMLDTKGAEIRTTVQQGKKFELHTGEVVRISMDDTLEGTPEKIAVTYPGLYDDTHVGGHVLIDDGLVDLKIIEKDEANKELVTEVQNDGMVGSRKGVNAPGVSINLPGITEKDASDIRFGLDNDINFIAASFVRKPQDVLDIRELLEEKHMEHVQIFPKIESQEGIDNIDDIMKVSDGLMIARGDMGVEIPFENVPFVQKNLIKKCNAIGKPVITATQMLDSMQENPRPTRAEVNDVANAVIDGTDATMLSGESANGDYPVEAVATMARIDERTEKSLTDRDAYALKAYSKTNLTESIGQAVAHTARNLGIKTIVAATESGSTARMISKYRPQADILAVTFDERTRRGLTVNYGVYPVMAKKPANTDDMFNLATQTAQEHGFAKEGDLILITAGVPVGERGTTNVMKIQLIGSKLTQGQGVGDETIVGKAVVASNAKEAAEKAVDGGILVVKATDKDYLPAIEKSSAIVVENGGLTSHAAVVGIAMGIPVVVGAKDATEAIKDGEVVTVDSRRGIVYRGATNAL

SEQ ID NO: 6509 - protein, 265 aa, Acinetobacter sp. ADP1
MSGSTIIPWVVGNWKMNPKQSDAIQLVQQFKDLLKQQPISEQYCHVGVAPIAIALTTIQSELATANRQVATVAQDVSRFAGTGAYTGEISAELLTDSQIRYVLIGHSERRDLLGDHVEILKAKLSHALNAGMTVIYCVGESLEQREQGLAEQIVLQQICDIAPVVSAEQWQHQIVIAYEPIWAIGTGRTASPEDAQAIHAKIREGLCQITPAGSQIALLYGGSVKPENAVELAACPDINGALVGGASLNAESFYKIAQAFAQTQQ

SEQ ID NO: 6510 - protein, 232 aa, Wolinella succinogenes
MILAANFKTNHTRKSTRHYLERLSNFLFETSCEHDIFLFPPPLALDFFDDIGGVCIGTQNAYPAPSGAFTGEVGSEQLEELAIQTILIGHSERRGILGESQAFCAEKFRYYASLGYTIFYCIGESLEVRRAGIEATIRHNLSQLEGIDLSYPKLIIAYEPIWAIGTGVSASLEQIQETHAALKAHLSCPLLYGGSVNLSNIAEILALPEVDGALIGSASLKVEDFCQMIQKI

SEQ ID NO: 6511 - protein, 266 aa, Rhodopirellula baltica SH 1
MKRILITGATDGIGLETAKALVSRGHHVLIHGRNADKLKQVEQSLNSLSSEASIESHLADLSDINEVESLAGSVAAKHDHLDALINNAGVLSTSDPMTPDGLDVRFVVNTIAPYVLAKRLRSRMDSSGRIVNVSSAAQKPVDMAAFRGELQLDDLEAYSQSKLALTMWSRGLADKLGTDGPAIIAVNPGSLLSSKMVHQAFGVPGKDITIGANILVRAALDEEFADASGQYFNNDAGEFGTPHADALDAEKNAAIIDHLESVLATV

SEQ ID NO: 6512 - protein, 361 aa, Zea mays
VSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQVRWSFTGAFEARQSLIVRGLFPMLADPRHPAESTSNTNESVLKVALDHGKACGVIKSHDRVVVCQKVGDSSVVKIIELDD

SEQ ID NO: 6513 - protein, 271 aa, Clostridium thermocellum ATCC 27405
MSNRIGFIGAGNMGGAMITSIAQSGIIPAENILVFDVDRDKLSVLREKTGITITDSALETVRKSDIIILAVKPNMVKAVLNDIKPAVDNNKILVSVAVGIPIKFYKEMLGENIKFIRTMPNTPALVGEGMTLMCCDKNVDEKEAEQVKKIFECFGKVEFLEEKLMSEVTAVTSSSPAYVFMFIEAMADAAVLSGIPRNLAYKLSAQAVLGAAKMVLETGKHPGELKDQVCSPAGTTIEAVRSLEKNRFRYAIIEAMSECTKKALEIGKMYD

SEQ ID NO: 6514 - protein, 154 aa, Arabidopsis thaliana
MGNHCTRIPCCKKVCSCICCCNRRNKTQARSQKGSYFIKGKVHPVSRMEKWEEKITEANSHGKILVVNFKASWCLPSGTILPIYQELASTYTSMIFVTIDVEELAEFSHEWNVDATPTVVFLKDGRQMDKLVGGDAAELQKKTAAAPNLLLRQS

SEQ ID NO: 6515 - protein, 728 aa, Poa pratensis
MVRYGRRKIGRSIFQTRYFVLESKLLAYYKKKPKDSMVPLKSLLIDGNCRVEDRGLKTHHGQMIYVLCVYNKKEKEHQITMGAYDIEDALAWKKKIEQIIDQQDTMTAENRKAFASMDFDAELGGQFSFSDHDSAAEDEEERPTLTRRTTIGNGPPESIHDWTNEPDIGLSNQSDPAQSFSKKNWRLLRCQNGLRIFEELLEVDYLARSCSRAMRAVGVVEATCEAIFGLVMSMDMTRYEWDCSFRYGSLVEEVDGHTAILYHKLQLHWCPMLVWPKDLCYVRYWRRNDDGSYVVLFRSIEHPNCGRQRGYVRAFIESGGFKISPLKCRNGRPRTQVQHLMQIDLRGWFLNYSPSFQYHSLLQIQNCVAGLREYFSQTDECHITPRIPVMENMVDPSMPKSQKLHEMESKTKPAHGGQADNKSMSIIDEESDEDDDYQVPEANIEEDSNKSDNDAKRTEEPPEKIDLSCFSGILHRDTDEKSRNYWTVPDSTLFKVRSKNFPTDKSKIPAPSYLMELAAIDWFKDTKRMDNVGRQKGCVAQVAAEKGMHTFVANIQIPGSTHYSLVMYFVTSCMKKGSLLQRFFDGDDEFRNSRLKLIPAVPKGSWIVRQSVGSTPCLLGKAVDCSYVRGPGYLEVDVDIGSSAVANGVLGLVFGVVTTLVVDMAFLIQANTYDELPEQVIGAARLAHVEPAAAVVPDLDNNSDSKDSSNDDNNNNTSSDDDSSKKTN

SEQ ID NO: 6516 - protein, 1065 aa, Bacillus thuringiensis serovar konkukian str. 97-27
MDKKVSAIPQPKTYGPLGNLPLIDKDKPTLSFIKLAEEYGPIFQIQTLSDTIIVVSGHELVAEVCDETRFDKSIEGALAKVRAFAGDGLFTSETDEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDDVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKKHEIKKQVQKTPSIIGADNLSLLVLYGSDTGVAEGIARELADTASLEGVQTEVVALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKQSMWSDAMKAFGLELNKNMEKERSTLSLQFVSRLGGSPLARTYEAVYASILENRELQSSSSERSTRHIEISLPEGATYKEGDHLGVLPINNEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMKVGEAHLYFGCRHPEKDYLYRTELENDERDGLISLHTAFSRLEGHPKTYVQHVIKEDRIHLISLLDNGAHLYICGDGSKMAPDVEDTLCQAYQEIHEVSEQEARNWLDRLQEEGRYGKDVWAGI

SEQ ID NO: 6517 - protein, 328 aa, Roseovarius nubinhibens ISM
MSTYQAVGIGNAVVDVISQCEDAFLQEMGIEKGVMTLIDQDRAEALYAAMQNRTQAPGGSVANTVAGMGALGLTTGFIGRVNDDALGRYYAKAMSDVGSHFVNAPVPGGDQTSSRSMIFVSPDGERSMNTYLGISTELGPEDVDDSVAGECDLLLLEGYLYDKPRGKAAFTEAARICREAGGLAGISLSDPFCVDRHRSDFRALLRELDYVIGNDHEWRALYQTEDLDAALTQASRDTRLVVCTRSGDAVTIHRGEDVTEVPVTPIKPLDTTGAGDQFAAGFLFGLVSGVPMAVAGRMGCIAAAEVITHYGARPEADVLEMFRAEGLV

SEQ ID NO: 6518 - protein, 316 aa, Arabidopsis thaliana
MGFLRCLQLLLLLFLSLRLQKLSAQSSSPNASSSSSLDALLQDYSFRALLRPRTGILYEATTVPSNLTGIKLAAMRLRSGSFRKRGVTPFNEFSIPSGFIVKPYVTRLVLVYQNLANFSHLYYPLSGYDYVAPVLGLLAYDAKNLSALNLPQLDLRVSNDPIRIDFSDLERIPQGSSAKCVRFDSKGEASFSDSIQPGNTCETEHQGHFSVVVKSVASAPSLAPPGIESKKKKKSSDSNSKTWIIVGSVVGGLILLGLLLFLVLRCRNYKKQEKMREMERAGETGEALRMTQVGETRAPTATTTRTQPMLETEYAA

SEQ ID NO: 6519 - protein, 284 aa, Aspergillus oryzae
MPSLQESKLAFIGGGNMASAIIGGLVNKGVQKQNIWVSEPWDVNREKMAALGVQTTTANVEAAKDADLVIIAVKPQVTKGVCEELGAAWSQRTTLPVVVSIAAGITLDSLVQWLRTSDGRNAHVVRVMPNTPALVGEGASGLYASKDVTSEEKELVNAVLGSVSKATEWVDKEELLDVVTGLSGSGPAYFFAMVEHLVASATALGLSEEQATRLAAQTCLGAGKMLVESSDSPSQLRKNVTSPNGTTYAALQTFESLGFKETVDKAVNSATSRAAELGNTLGKQ

SEQ ID NO: 6520 - protein, 424 aa, Aquifex aeolicus VF5
MKNEKLYREALQVMPGGVNSPVRAFKAVGGKPIFLVKGRGPRVWDAEGNEYIDFLASWGAIILGHAPKKVVKAVQEEAEKGLSFGLTNPHEVTLAKLVVEMVPSVEKVRFVNSGTEATMSAVRLARGVTGRKYIVKFEGCYHGHYDSLLVSAGSGVATFGIPGTPGIPEEIAKLTIVLPYNDVQALEEAFKEYGSEIAGVIVEPIAGNMGVVPPKKEFLIRLRELTKEYGSLLMFDEVITGFRLSKGGAQELFGIEPDITCLGKILGGGLPVGAYGGRREIMERVAPEGEVYQAGTLAGNPLAMVSGSETLKDLRDKEPYKELEEKMEKLARGVKDILTEKGIQHTINKVGSMMTVFFTDKKVVDFQTAKTSDTELFAKFFRALLNKGVLIPPSQFEAWFLTTAHEEEVIDEALERIRDAVKEL

SEQ ID NO: 6521 - protein, 1108 aa, Acidobacteria bacterium Ellin345
MDLISTQTWFKDAIIYEVHVRAFYDSVTDGIGDFGGITQKLDYLEDLGVTAVWLLPFYPSPLKDDGYDIADYNNVHPSYGSLREFQRFLREAHRRGIRVITELVLNHTSDQHIWFQRSRRAEPGSRWRNFYVWSDTPDRYQDARIIFKDFETSNWTWDPIAKAYFWHRFYSHQPDLNWENPEVREAMFDAMDFWFDMGVDGMRLDAVPYLYEREGTNCENLIETHGALRELRKHLDEKYKDKMLLAEANQWPEDAVAYFGKGDECHMAFHFPLMPRLFMSLRMEDRYPVTDILRLTPPIPETCQWALFLRNHDELTLEMVTDEERDYMYRTYAHDRTARINLGIRRRLAPLLENDRRKIELMNALLFSLPGTPVVYYGDEIGMGDNIYLGDRNGVRTPMQWSADRNAGFSKANPQKLYLPVNIDPEYHYEAVNVESQQNNPHSLLWWMKRVIAQRTQFKAFGRGTLEFLYPSNRKVVAYIRQYEDETILVVANLSRFTQCAELDLSRFNGLAPVEIFGRARFPNITEQPYFFSLGPHAYYWFHLQPREVTHESLTTNAAAPSVPTILVESTADVFAPATRDAFFRLLPAMLVSRPWFQGKSKTIRSLDLGDAIPLPQTGAYVVLLNVDYADGDPETYLTPLSIASGEKADAILRDRPDAVLAKLDDGKRQVLLYAGVYDREFADSLLRAIVKRKRFKGEIGELVAGHTRSFRKAWENQRAGLEPNTQPGERNTVTITYGENFNLKLYRKLDAGPNPDREMEEFLTEETSFTQIPRALGWLEYRRGEEESLEQTTIGLLVGYARNATNGWTYALDTLGIFFERALAIPQNDPRLKDLTDGSVLAMANQPLPPIMGELLGSLADNMRLLGQRTADLHVALASRPDIPTFAPEPFTEFYRHSLYHGMLGQSSRAMDTLRARLRSLPTASQDDAQALINRENELRARLLRLRDTRISGTRIRHHADYQLSNIQYTGSDFLVSNFEGNPERPIGERRIKRSPLRDIASMVRSFHYVSHAVLFDQVPGIVLSRDAYPQLERWATAWYQWVSALFLKGYLERAGTAAFLPRSQEERAVLLESYTLEKALIEIEYELTHRPNWVRIPVHGILEQLH

SEQ ID NO: 6522 - protein, 408 aa, Solanum tuberosum
MAASAATATATTSYLSALDKKTPFLFALDKKTPFLCPKSSTKRRSFNGGVKCMAIETTSGFTATKKRSGYELQTLTSWLLRQEQAGVIDAELTIVISSISMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYNPNDECLADHGDDSTLDNIEQKCIVNVCQPGTNLLAAGYCMYSSSVIFVLTLGNGVFSFNLDPMYGEFVLTQENVQIPKSGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHQRVLDIQPTEVHQRVPLYIGSTEEVEKLEKYLS

SEQ ID NO: 6523 - protein, 344 aa, Sulfolobus solfataricus P2
MKAVRIHEYNKPLSLDEVNKPRVSGPYDIVVRIRGAGVCRTDLHIIEGVWKDVLNPKLPFTIGHENVGIIEEKGNAVDWLDVGDQVILHPYITCRHCRACRSGNDMHCPYGKFPGLDGTDGGYAEYLRTSAFSAIKIPKGIDIIPMAPLADAGITAYHAVKKISQYLYPGSIVGVIGVGGLGHIGIQALKAITPARVIAIDISEEKTKLAKELGADEVVIAGKDSGVSDVLKLTDNIGVDAIIDFVGEHSTPQNALRMIRKGGIYSIVGYGGEFKNSTLDFINREIMVVGNLVGTYNELSELVTLYVQNKVKLKVKTFPLEEANSALEELKAGRILGRAVLVPS

SEQ ID NO: 6524 - protein, 463 aa, Bacillus cereus G9241
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPCWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIIATAIVLLVGVILNYLVPAKVFTWLTSISTFGAIWTWGIILVAQIKFRKSLPAQNKQKLSYKMPLYPISSYFSLAFLALVLCIMAYSEDTRIALIVGPIWLIGLAIVYYMKGFHKIDETPNSKIS

SEQ ID NO: 6525 - protein, 425 aa, Thiobacillus denitrificans ATCC 25259
MSRNEALFEASQKVIPGGVNSPVRAFRSVGGTPVFFSRARGSRVWDADGREYIDYVGSWGPAILGHAHPGTVKAVQDAAANGLSFGAPSEAELTIATRITELLPSVEKVRLVSSGTEATMSAIRLARGFTGRSKFIKFEGCYHGHADFLLVKAGSGALTFGNPTSAGVPPEVAAQTIVLDYNDVAGLERTFAEIGDEIACIIVEPFAGNMNLVKPSAEFMAAMRRLCDEHGALLIFDEVMTGFRVDLGCAQKLLGIRPDLTTLGKVIGGGMPVGAFGGRADVMDALAPVGPVYQAGTLSGNPVAVAAGLATLASVSEPGFYPALAARTEKLVKGLTAAAREAGVTFCADSVGGMFGLYFAAEPPASFAEVMRCDKEKFNRFFHAMLDHGVYLAPSAFEAGFVSAAHSDADIDATVAAAREVFRTL

SEQ ID NO: 6526 - protein, 490 aa, Staphylococcus aureus subsp. aureus COL
MTSKSSPLIFERSREGRYAYSLPKSDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVNIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSKHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 6527 - protein, 462 aa, Ralstonia metallidurans CH34
MHAPDNQGTLKRGLKNRHIQLIALGGAIGTGLFLGIAQTIKLAGPSVLLGYALAGVVAFFIMRQLGEMVVDEPVAGSFSYFANKYCGHFAGFMSGWNYWVLYILVSMAELSAVGIYVQYWWPGIPTWISALAFFLIINAINLASVKSFGEMEFWFSIIKVAAIVGMIGFGGYLLATGTAGPDASIANLWQHGGFFPNGFSGLVMAMAVIMFSFGGLELVGITAAEADSPEKSIPKATNQVIYRILIFYVGALAVLLSLYPWEKVVTGGSPFVLIFHAMNSNVVATVLNIVVLTAALSVYNSGVYCNSRMLLGLAQQGNAPRSLMRVNRRGIPLTALAVSAIATGICVVINYFMPGEAFELLMGLVVSALIINWAMISIIHLMFRRAKAAAGKTTRFQSLGYPLTNYVTLAFLAGILVVMFLTPGLRISVYLIPVWLGVLGVSYRLRQKKAGSAMPAASAQIQ

SEQ ID NO: 6528 - protein, 448 aa, Staphylococcus aureus subsp. aureus COL
MSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLKKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 6529 - protein, 238 aa, Prochlorococcus marinus str. MIT 9313
MADLQTQMKQAVAAAAVEQIKDGMVLGLGSGSTAALMIQALGAKLASGELRDIVGVTTSFQGEVMAAELGIPLRNLTAVDRIDLAIDGADEVDPSFQLIKGGGACHVQEKLVASRADRFVVVVDSTKIVDRLNLGFLLPVEVLPGAWRQVQGRLAELGGIADLRMAQCKAGPVVTDQGNLVLDVSMAGGIGDPEDLECRINNLPGVLENGLFVNLTDEVLVGQISDGVAGVRRLQRRE

SEQ ID NO: 6530 - protein, 417 aa, Acidovorax sp. JS42
MAEIKNYSLNFGPQHPAAHGVLRLVLELDGEVVQRADPHIGLLHRATEKLAEHKTYIQSLPYMDRLDYVSMMCNEQAYCLAIEKMLGIEVPLRAKYIRTMFGEITRLLNHLMWLGSHGNDCGSSTILIYTFREREDLFDMYEAVSGARMHAAYFRPGGVYRDLPDSMAQYKVSKIKNAKAIEELNRNRQGSLLDFIDDFTQRFPKCVDEYETLLTDNRIWKQRTVGIGVVPAERALNLGMTGPMLRGSGIAWDLRKKQPYDAYDRVDFDVPVGVTGDSYDRYLVRVQEMRESNRIIKQCVDWLRANPGPVITDNHKIAPPSREAMKSNMEELIHHFKLFTEGFRVPAGEAYAAVEHPKGEFGIYMVSDGANKPYRLKIRAPGFAHLATLDEMARGHMLADAVAIIGTMDIVFGEIDR

SEQ ID NO: 6531 - protein, 256 aa, Haemophilus ducreyi 35000HP
MARRPLVMGNWKLNGSKAFTQQLIAELKTELAEITGCDVAIAPPVMYLSEAEIALAGQSTIRLGAQNVDINTQGAFTGDISTAMLQEFCAKYIIIGHSERRTYHAESDQFIAKKFAALKTAGLTPVLCIGETEAENEAGQTQQVCARQIDAIINSLGVEAFNQAVIAYEPIWAIGTGKSATPAQAQAVHAFIRQHIAEKSQAVADQLIIQYGGSVNDTNAAELFSQPDIDGALVGGASLKATAFAEIVKAAEKAKA

SEQ ID NO: 6532 - protein, 105 aa, Zea mays
MASGSGKAKASSWAAAMSVGTVEALKDQAGLCRWNYAFRQAAQQQKQRARRPAAGASGSVGPGSAHAPPASAPSGCAAAARRRARQQQEEELRTVMYLSNWGPNN

SEQ ID NO: 6533 - protein, 253 aa, Acidovorax sp. JS42
MDDMTQKKKLIAGNWKMNGSLQANAALLQALRDGLGAPGCGVAVAVPAPYLAQVQALVAGSEIALAAQDVSQHERGAFTGEVSVGMLRDFDARYALVGHSERRQYHGETDAVVAAKAQRALSGGVTPIVCVGETLAEREAGQTETVVKRQLAAVIHAVGHCVSEIVVAYEPVWAIGTGRTATPEQAQQVHAVLRAQLAAATESADRVLILYGGSLNAANAAELLAQPDIDGGLVGGASLKAADFLKIIAAAHS

SEQ ID NO: 6534 - protein, 294 aa, Lactobacillus acidophilus NCFM
MANNIPIGSPVRTKAIINRYFVKAKKNLGQNFLVDQDAILGIVEAADIQPGDQVIEIGPGIGSLTEQLLLAGAKVFAYEVDDSLPEILHNELPKKIGEQSLNDRFKLLLKDVLKADFQNDLAGFFDMKQPIKVVANLPYYITTPIIFALSESDLHFSSLTLMMQKEVAERLEAKPGNKEYGPLTISVQTEMNVKIALEVKSTSFMPRPKVDSSVVVLTPLQERPKIENRKHFIWVVKMCFSQRRKTLNNNLKALIPNAKEREALISKLGVDPRVRPEDLTIDQFIEIARNIPAK

SEQ ID NO: 6535 - protein, 277 aa, Staphylococcus aureus subsp. aureus MSSA476
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKVKNIGVSNFEPEHLEALLAQVSIKPVINQVEYHPYLTQHKLKLYLAAQHIVMESWSPLMNAQILNDETIKDIAQELGKSPAQVVLRWNVQHGVVTIPKSVTPNRISENFQIFDFELSDEQMTRIDGLNQDKRIGPDPKTFEG

SEQ ID NO: 6536 - protein, 628 aa, Neisseria polysaccharea
SPNSQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLYLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSQAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 6537 - protein, 728 aa, Poa pratensis
MVRYGRRKIGRSFFHTRYFVLEGKLLAYYKKKPKDSMVPLKSLLIDGNCRVEDRGLKTHHGQMIYVLCVYNKKEKEHQITMGAYDIEDALAWKKKIEQIIDQQDIMTAKNRKAFASMDFDAELGGQFSFSDHDSAAEDEEERPTLTRRTTIGNGPPESIHDWTNEPDIGLSNQSDPAQSFSKKNWRLLRCQNGLRIFEELLEVDYLARNCSRAMRAVGVMEATCEAIFGLVMSMDVTRYEWDCSFRYGSLVEEVDGHTAILYHKLQLHWCPMLVWPKDLCYVRYWRRNDDGSYVVLFRSIEHPNCGRQRGYVRAFIESGGFKISPLKCRNGRPRTQVQHLMQIDLRGWFLNYSPSFRYHSLLQIQNCVAGLREYFSQTDECHITPRIPVMENMVDPSMPKSQKLHEMESKTKPAHGGQADNKSMSIIDEESDEDDDYQVPEANIEEDSNKSDNDAKRTEEPPEKIDLSCFSGILHRDTDEKSRNCWTVPDSTLFKVRSKNFPTDKSKIPAPSYLMELAAIDWFKDTKRMDNVGRQKGCVAQVAAEKGMHTFVANIQIPGSTHYSLVMYFVTSSMKKGSLLQRFFDGDDEFRNSRLKLIPAVPKGSWIVRQSVGSTPCLLGKAVDCSYVRGPGYLEVDVDIGSSAVANGVLGLVFGVVTTLVVDMAFLIQANTYDELPEQVIGAARLAHVEPAAAVVPDLDNNSDSKDSSNADNNNNTSSEDDSSKKTN

SEQ ID NO: 6538 - protein, 152 aa, Blastopirellula marina DSM 3645
MERSLILLKPDCVQRRLIGRIISRFEDKGLNIVGMKLMQVTPDLAKQHYAEHVAKPFYPGLEAFITASPVVALVLEGLEAIRVIRDILGATSGLKAAAGTIRGDFSSSRQMNLVHASDGPEAAAREIGLYFTESELCDCTLSLTPWLRADDE

SEQ ID NO: 6539 - protein, 388 aa, Phormidium lapideum
MKLAARVESVSPSMTLIIDAKAKAMKAEGIDVCSFSAGEPDFNTPKHIVEAAKAALEQGKTRYGPAAGEPRLREAIAQKLQRDNGLCYGADNILVTNGGKQSIFNLMLAMIEPGDEVIIPAPFWVSYPEMVKLAEGTPVILPTTVETQFKVSPEQIRQAITPKTKLLVFNTPSNPTGMVYTPDEVRAIAQVAVEAGLWVLSDEIYEKILYDDAQHLSIGAASPEAYERSVVCSGFAKTYAMTGWRVGFLAGPVPLVKAATKIQGHSTSNVCTFAQYGAIAAYENSQDCVQEMLAAFAERRRYMLDALNAMPGLECPKPDGAFYMFPSIAKTGRSSLDFCSELLDQHQVATVPGAAFGADDCIRLSYATDLDTIKRGMERLEKFLHGIL

SEQ ID NO: 6540 - protein, 470 aa, Geobacter sulfurreducens PCA
MTPQEVVSFAKENGALMVDYKFMDFVGIWQHVSVPISEFGEDTFEEGQGFDGSSIRGWQPIHASDMILLPDPATAKMDPFIAVPTLSLICNVFDPITKEDYTRDPRNIARKAEAYLKSTGLGDTAFFGPEAEFFIFDDVRYDSTSNQSFYMVDSVEGAWNTGREEFPNLGYKPRHKEGYFPVSPTDSQNDLRNEMVMELQKVGIRVECQHHEVASGGQAEIDMRFSSLVDMADQLQWFKYVIKNVAYRNGKTVTFMPKPLYGDNGSGMHCHMSIWKDGQNLFAGDKYGGLSQMALWYIGGIIKHAKALCALTNPTTNSYKRLVPGFEAPVNMAYSSRNRSASIRIPMMSTNPKAKRIEYRTPDPSCNGYLAFAAMLMAGLDGIENKIDPGQPLDKDIYGLSPEELKNIPSAPGSLEEALKALEADHEFLLKGDVFTPDVVEKWIEYKMEAEVNPVRMRPVPLEFALYYDI

SEQ ID NO: 6541 - protein, 315 aa, Magnaporthe grisea 70-15
MFGFFETKFNPTKDIPDLSGKVILVTGGNIGLGQSSVLELARHNPKHIFLAARNEEKARKAIESVSWELGTDKASVVSFLPLDLSSFDSIRKAAETVNSKTDELHILLNNAGIMMTPATTTKEGYEEQFGTNHMGHALLTRLLLPVLEKTAQGGKVDVRIVNLSSAGEGLAPTNAFDDLSRYKSPMEDVASHTRYGVSKLANIYHAQMLARKYPSIKAVSVHPGVVNTNLTRGLKETYPWIVPYVAPIAGALFFKTPAEGAKNQLWASTNEKVISGEFYWPVGLLGKGSEKSKDTEAAEKLWDWTEKELDAYLKQ

SEQ ID NO: 6542 - protein, 139 aa, Pasteurella multocida subsp. multocida str. Pm70
MAVERTLSLIKPDAVKRHLIGAILSRFEQAGFRVVAAKMLHLTQAQAEGFYAEHQDKAFFPELVAYMISAPVLALVLEKENAVKDYRTLIGATNPAVAAEGTIRRDFAIDGRHNSVHGSDSLDSAKREIAYFFVESEIF

SEQ ID NO: 6543 - protein, 576 aa, Zea mays
FPIVEPDHGHTKLRLSEQGLEAIRRIETPIAVVGVIGPYRSGKSFLLNQLLSLSCDKGIWIWGTPVEMDVDGSKVSVIYLDTEGFESVGKSNVYDDRIFALATVLSSVLIYNLPETVREADISRLSFAIEIAEEFYGRVKGQDVAFEPAKLLWLIQRDFLRDKYIDEVNQIRDSLAVMGNNSTAFSLPQPHLQRTKLCDMEDKELEPLYVKRREQLKQLVSSIVKPKIVQGRTLNGKDFVSFLQQILEALNKGEIPSTGSLVEIFNKAILDRCLKVYREKMDGLGLPVPVDKLQKLHEMANGDARILFDKQHFGKHHAAQSALKLEDDIKKVYRNLLLANEYQSSKLCEARFSECEDKMDHLQVLKLPSMAKFNAGFTHCNQSFVKECVGPSKESYERRMSKIDRFVLVRVTNLADAAEHIGEVLRRVKKEHLQRAYKIQDWSDDNDFLVQLCRTTGKLLKGGEPDLTTAAKMILHDWQRGKIPFFVPPPQQSDGGASESAEPIGITKEDGVSSDRTAAAMKAIAGIISSQQNMNVPCHKENNADNEDTTENADNEDIESSDNEDNDDIEPAERSE

SEQ ID NO: 6544 - protein, 394 aa, Brassica napus
MTTRKRQIKNFTLNFGPQHPAAHGVLRLVLEMNGEVVERAEPHIGLLHRGTEKLIEYKTYLQALPYFDRLDYVSMMAQEHAYSLAVEKLLNCEVPLRAQYIRVLFCEITRILNHLLALTTHAMDVGALTPFLWAFEEREKLLEFYERVSGARMHASFIRPGGVAQDLPLGLCRDIDSFTQQFASRIDELEEMLTGNRIWKQRLVDIGTVTAQQAKDWGFSGVMLRGSGVCWDLRRAAPYDVYDQLDFDVPVGTRGDCYDRYCIRIEEMRQSLRIIVQCLNQMPSGMIKADDRKLCPPSRCRMKLSMESLIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 6545 - protein, 338 aa, Zea mays
DDASRIIGATDSDSRNRTGPTQKAMSLPSSPHEYRGQDTQKGDDFISKEKMALAWNKVFQSSPFLNKPLLPFEEWNIDFSEITIGTRVGIGFFGEVFRGIWNGTDVAIKVFLEQDLTTENMEDFCNEIYILSRLRHPNVILFLGACITPPHLSMVTEYMEMGSLYYLIHMSGQKKKLSWRRRLKIIRDICRGLMCIHRMKIVHRDLKSANCLVNKHWTVKICDFGLSRVMIDSPMTDNSSAGTPEWMAPELIRNEPFTEKCDIFSLGVIMWELCTLSRPWEGISPVQVVYAVANEGSRLEIPEGPLGRLIADCWAEPENRPSCQEILTRLLDCEYTVS

SEQ ID NO: 6546 - protein, 336 aa, Streptomyces rochei
MRIAVSGSIAIDHLTVFPGRFTDQLIPGQLDHVSLSFLVDDLEVRYGGAAANIAFGLGGLGLAPLLIGAAGADFGPYEVWLKDHGVDTGGVLVSGERQTARFMCTTDADANQIASFCTGAMAEARDIDLAALIGEDPAAGPDLVLIGPDDPEAMLRHTRQCRQLGIPFAADPSQQLARLDGAQARDLVTGARWLFANEYESALLLEHTGWTRAEVLERVGTWITTLGERGVRAERADGSTLTVPAVPGVPVADPTGVGDAFRAGFLAALARGLGLTAAARLGCAVASEAIRTVGSQAYEAAPARLLAALTTAYGADAAAEIAPALPATVSEGGEAS

SEQ ID NO: 6547 - protein, 510 aa, Ralstonia metallidurans CH34
MSNTNTTPAVPVPGLRRELRARHLTMIAIGGSIGTGLFVASGATIAQAGPGGALAAYILIGAMVYFLMTSLGELAAYMPVSGSFATYGALYVDEGFGFALGWNYWYNWAVTIAVELAAAQLVMQYWFPDTPGVLWSALFLGLMFALNAISVRGFGEAEYWCALIKVLTVIAFIVIGTLMIFGIMRGDFSHAGGLANLTTGDAPFVGGLPAMIGVAMIAGFSFQGTELIGVAAGESDEPAKNIPRAVRQVFWRILLFYVLAILIIGILIPYTDPSLLKTDVETVGVSPFTLVFRHAGLAFAAGVMNAVILTAVLSAGNSGMYASTRMLYNLATEGRAPRIFAQLTRNGVPLVALLATTAVGGLCFLTSLFESKSVYLWLLNLSGMTGFIAWLGIAVSHYRFRRGFMAQSLDLNRLPYRSPFFPYGPIFAFVLCMIVTLGQNYQAFSEGKIDWVAVTATYVGIPIFLLIWLGYRLVRKSRFVPYAEMKFPALPEIEKDDSPVTRPLAPASAE

SEQ ID NO: 6548 - protein, 214 aa, Glycine max
  misc_feature (78)..(78): Xaa can be any naturally occurring amino acid
  misc_feature (153)..(153): Xaa can be any naturally occurring amino acid
  misc_feature (201)..(201): Xaa can be any naturally occurring amino acid
  misc_feature (206)..(206): Xaa can be any naturally occurring amino acid
  unsure (1)..(214): unsure at all Xaa locations
MAVSAITGARLTLGIGLAIPLSSPTRSRTVAMAVSVDPKTDNKLTLTKSEEAFAAAKVRMTSLFLPSFLLSILIFDFXFQELMPGGVNSPVRAFKSVGGQPIVIDSVKGSRMWDIDGNEYIDYVGSWGPAIIGHADDQVLSALVETMKKGTSXGAPCLLENTLAELGINAVPSIEMVRFVNSGTEACIGAQRLARAYTGRXKIIKXEGCYMAML

SEQ ID NO: 6549 - protein, 188 aa, Zea mays
GAMKLGRLAKSLAGDVNGKRREKGLLPRPVRAGIIGYPNVGKSSLINRLLKRKICAAAPRPGVTREMKWVKLGDGLDLLDSPGMLPMRIDDQAAAIKLAICDDIGEKAYDFIDVAGILVQMLARIPEVGSRALYSRYKIQLDGGCGKKFVKTLGLDLFGGDSHQAAFRILSDFRKGKFGYISLERPPL

SEQ ID NO: 6550 - protein, 1626 aa, Nostoc punctiforme PCC 73102
MMNQPNAFDSLDEIAIVGMNGRFPRAKNIEQFWQNLRDGVESISFFSDEELLSSRIDPATLSQPQYVKAGSVLEDIELFDASFFDFSAKEAQITDPQHRLFLECAWEALESAGYNSEIYAGRIGVYAGASLNTYFLTNLYTQPKIIESVGSYRISIGNSPNFLPTYVSYKLNLKGPSLNVQTACSTSLVAVHLACQSLLNGESDIALAGGVSIQVPHKTGYRYQQGGIMSPDGHCRAFDAKAQGIISGNGVGIVVLKRLEDALADGDCIHAVIKGSAINNDGSLKVGFTAPSVDGQAKVIAEALAMARVESETISYVETHGTGTVLGDPIEIASLTQAFRPTDKKNFCAIASVKTNIGHLDAAAGVAGLIKTVLALKHQQIPPSLHFEQPNPQIDFANSPFYVNDKLSEWKSNGTPRRAGVSSFGIGGTNAHVILEEAPVWEQGRQRRQGRKYHLLVISAKTKSALETATANLANHLKQHLELNLADIAYTLGVGRRGFSDRRILVCQNLNDAVTVLETPVSERVFTKFTEPSGQQIAFMFPGQGTQYVNMGRELYETEIIFRKQVDYCCEFLKSYLKLDLRTLLYPHQQTEALTQQLQQTHITQSAVFVVEYALAQLWMAWGVRPNAMIGHSIGEYVAACIAGVFSLEEALILVANRGQLMQQLPSGTMMAVSLPEKKIQPMLGKKLSLAAINAPDMCVVSGLEEAVDDLQKRLIDQGVDCHRLHTSHAFHSSMMDSILLPFQEQVSKISLNSPKIPFVSNVTGTWITPAQATDPKYWARHLRQTVRFSEAIAELLQQPKRILLEVGPGRTLSTLANKQKAAQQVILSSLRHPQNQQSDVAFLLNTLGRLWLEGINVDWSEFYADEERHRIPLPTYPFERKRYWIEPILANDDNLSPKNEILVSQPEDIITNSIKVPDTQIVNQPIANTAIEQIISQHLQVMSKLVDLLPQGSLAREVLPSLGAIHQDGQIAQTSTNGSAFSGNQSTFTKAESEQQIKDRKINPTPKAASQQIEKESMMLSPRQQRHLDSLIAHFVKRTQESKRLTQAYRSCHANSRAVSGFFPFIKEMIYPIHAERGEGARLWDVDGNEYVDISMGFGTLLFGHSPSFAIAAIQEQSKQGILNGPQSRFAGQLAELICELTGAERTAFCNDGTEAVMAAVRIARSVTGRSKIALFAGSYHGGSDGVLVKGVRTNDGTLRSVPMTSGIPSSLAEDVMVLEYGTPESLNILKDNAHNLAAILVEPIQSSRPDFQPKEFLFQLRQLTQETGTVLIFDEVVTGFRMHPGGVQALWGIQADITTYGKAVAAGIPIGVVAGKAVFMDALDGGMWNYGDESYPQVKTTFFAGTFFKHPLIMGVAWATLNHIKNSGSKLQEELNQRTTQLAETLNSYFEQKQVPIRVVNFGSLFRFNCQTQLGNLFFYHLLAKGIYVWEGRTLYLSTAHTDKDVEQVISAVKESVVEMQAGGFFTSEQTSKNSGQTSANQTLTGSSLNLATESLSVTSNVKSADELFENLIEQIPNALGNTYAASRKKIEKTIADIWQELFGFDNVNIHDNFFELGGDSLTALQAISLLNKKLDLDIPIESIYEAPTINSLTNIVCPEQNEILSAKQSISRGQRRREKRNQR

SEQ ID NO: 6551 - protein, 184 aa, Zea mays
  misc_feature (108)..(108): Xaa can be any naturally occurring amino acid
  misc_feature (120)..(120): Xaa can be any naturally occurring amino acid
  misc_feature (156)..(156): Xaa can be any naturally occurring amino acid
  unsure (1)..(184): unsure at all Xaa locations
YPCAAHLPFPAWPSHSLAPFFPSPDLPIPEITPDTPHPRTPRPHLAMGSAAASPPPSGKLTQDELKRVAAHRAVEFVEPGMTLGLGTGSTAAHALDRLGDLLRAGALXGVAGVPTSLKTXEAHAARVGIPSLPLPGGRIALLIDGREEDEQDLNLXKGRGGSVLQKKMIDGGQEPVSLLMNEEP

SEQ ID NO: 6552 - protein, 248 aa, Zygosaccharomyces bailii
MARTFFVGGNFKLNGTKSSIKEIVERLNNAKLDPKVEVVLCPPAPYLDYTVSLVKKSQVSVGAQNAYLKASGAFTGENSVDQIKDVGAKWVILGHSERRQYFREDDQLIAEKTAFALSQGVGVILCIGETLDQKKAGTTLQVVERQLQAVIDKVKDWSNVVIAYEPVWAIGTGLAATPEDAQEIHHSIREFLAKKLGEKTAQETRILYGGSANGKNAVTFKDKPDVDGFLVGGASLKPEFVDIINSRS

SEQ ID NO: 6553 - protein, 471 aa, Bacillus cereus G9241
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVVFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQQTIPQEIN

SEQ ID NO: 6554 - protein, 282 aa, Leccinum variicolor
  misc_feature (136)..(153): Xaa can be any naturally occurring amino acid
  unsure (1)..(282): unsure at all Xaa locations
AVNDPFIDLDYMVYMFKYDSVHGRFKGDVHAKDGKLYINGKAITVYAERNPSDIKWGSVGAEYIVESTGVFTTIEKAAAHLKGGAKKVIISAPSADAPMFVCGVNLDKYDSKYTVISNASCTTNCLAPLAKVINDXXXXXXXXXXXXXXXXXXQKTVDGPSAKDWRGGRAVNGNIIPSSTGAAKAVGKVIPALNGKLTGLAFRVPTNDVSVVDLVVRLEKSASYDDIKAAFKEASESPELKGIIDYTDEAVVSTDFTGNPASSIFDASGGIMLNPNFVKLIA

SEQ ID NO: 6555 - protein, 372 aa, Coccidioides immitis RS
MSQERKDDRPAASSEQDKHHEPGTPVAPSGFQGLLSLATPLTRFVLYPMDQLKLVGSNLRQMVSKKFDPEKDIIDQDGKVILITGGNAGLGKETVLQLAKHNPLRIYLAARNSSKAQAAIDDIQKQLPQHADIRHLPLDLSSFTSIRAAAREFTSSNERLDTLILNAGVMDPLPNRTEDGFEVDFGTNHLGHFLFTKLLLPTLTKTAQETKSAGKPADVRIIVVASMAWQMSPPLSTMLSTDSLLALNPPTRYGASKAANIAFASELARRYPELSCVSLHPGVIITGLYDSLMATNPVARVGLRIAKSITVDEKQGSLNHLWTAGSERGALRSGEYYTPVGVGGWKNKWAEDRELGRTLWEWSEEAIRDQKK

SEQ ID NO: 6556 - protein, 591 aa, Gibberella zeae PH-1
MSPSATFDAPSGGQSNRFQILVPEKVSPDGLALLTPHFDVDIRKGLSAAELVNLIPNYHGLIVRSETQVTAEVVQAGRKLRVVARAGVGVDNIDVPAASTQGVIVVNSPSGNILAAAEHTIALLLSAARNVGQADGSVKEGRWERSKLVGVEVGRKTLGIIGLGRVGLNVARMAKGLGMIVKAVDPYASADMARQTGVELVPGLEDLLPVVDFLTIHTPLLATTLDLVSEAEFKKMKKTARVLNVARGGVYNEEALIKALDEGWIAGAGIDVWSSEPLVADSAAARLSKHPKVVATPHLGASTVEAQENVSMDVCKQVLEILQGGLPTSAVNAPIIMPEEYRKLQPSVQLVEKMGRLYTEHFVRSRGGMLGGRRFELIYHGDLASMPNTKPLFAALVKGLVSTFSDSHINMVNAALIAKEKGIVISETRAGDSPSTYSNLVTLRSYKAGGNGSEQVIEGYASDERVFISKLDRFNGVFTPEGTLIILHNYDEPGKIGGVGMVLGKHGINIKFMQVASLDPEATKGADTPPDPNGNEALMILGVLGPVSDEVLEGLNNSEGVLDVVEIEIERQSIAWSIESISCDDSLMIYS

SEQ ID NO: 6557 - protein, 483 aa, delta proteobacterium MLMS-1
MSEQKESGTGPLVPTILCGGVGSRLWPVSRAHYPKPFIRLADGQSLLQKALLRGAGLPGVAEIQTVTNRELFFNTVDEYTAVAAGADLPATSFILEPCGRNTAAAVAVAALRAARVYGEAAILLVLAADHLIADQDAFAEAVARARALAAQGRLVTFGIAPDRPETGYGYIEAAGDRVLRFIEKPSREQAESYLAAGRFYWNSGMFAFAAGVVLEEMARCSPAILAACRQTLEHSAAEVIEGDRHRLVLDAESFAAVPADSIDYAVMERSDRLAVVPCSIGWSDIGSWTALAELDQPDAAGNRCRGEVVARESRDCVIHGQDRLIGTLGIDNLIVVDTPDALLVANRQRAQEVKALYGELVARRHPAAHFHSTVHRPWGTYTVLEQGEGFKIKRIEVKPGATLSLQMHHHRSEHWVVVSGMARVINGEREYFVNTNESTYIPAGCRHRLENPGMLKLVMIEVQSGAYLGEDDIVRFEDDYGRL

SEQ ID NO: 6558 - protein, 272 aa, Sinorhizobium meliloti
MSIAVSGPIVLVGAGNMGGAMLAGWLKSGVRGSDVLVIDPGPSPAMAKLLADSGVQHATSAPAGGKAGAIFLAVKPQVMETVLPPLKGLVGPQTVIVSVAAGKTLGFIERHLGEAATVRAMPNTPAMIGRGVTGAFANARVSEAQRALVHDLLKVSGPVEWVGSEADIDAVTAVSGSGPAYVFYLVECMAEAGRKAGLEADLAMRLARETVAGAGELLHQSPDDAARLRQNVTSPGGTTAAALAVLMADDGMQPLFDRAIAAARKRAEELAG

SEQ ID NO: 6559 - protein, 291 aa, Nocardia farcinica IFM 10152
MAWNPTQIPDQTGRTFVITGANGGLGAETTKVLADKGATVVMACRNVAKAQQVADGIPGDVRVAELDLADLASVRAFAERAEEFDVLINNAGLMYIPFSRTADGFETQFGVNHLGHFALTGLLLDKIRDRVVTLASIAHRQTPKLWIDDLNYERRRYYRNLAYAQSKLANLMFARELQRRLAEAGSPKRSYAVHPGVSATELFARTETPLDRIAKPIIRLVGHPPAKAAHSTLFAATMPDADPGTYWGPNRLFQSQGPVEPSPSTRLSKNPELMRRLWAESERMTGVTYPV

SEQ ID NO: 6560 - protein, 460 aa, Burkholderia sp. 383
MNQPEDQLHRGLEERHINLMALGATIGVGLFLGSASAIRVAGPAILLTYLLGGIAIFLIMRALGEMAIANPVAGAFSRYARDYLGPLAGYLTGWTYWFVWIVTCMAEITAVGVYMHMWFPGVPNWIWALAALMAMGSVNFIAVKLYGEFEFWFALIKIVTIVLMIIGGGLMIAFGIGNGGVAIGLSNLWAHGGFMPNGINGVIAALPIVMFAYLGVEMLGLTAGEARNPEKSLTKAVNSVFWRVLIFYIGALFVIMSLYPWDQIGTQGSPFVMTFSRLGIPAAAGIINFVVLTAALSSCNSGLFSTARMLYNLAQQGQAPSKLGKVNRNGVPVYGVIVSVALLLIGVLLNYLAPQHVFTWLTSVSTFGAIWTWCVILIAQMRFRRTLSADKIARLPIRVPFYPLGSFVALGFLVLVVVLMAFTPDTRVALVIGPVWIVLLGITYALFYANRPAASVPTKS

SEQ ID NO: 6561 - protein, 510 aa, Petunia x hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 6562 - protein, 148 aa, Brassica rapa
MEQTFIMIKPDGVQRGLVGEIICRFEKKGFTLKGLKLITVDRPFAEKHYQDLSAKPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 6563 - protein, 469 aa, Xylella fastidiosa Temecula1
MSLENVEKLVKDKKIEFVDLRFVDMRGVQQHVTFPVNILEQSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGSVMSDDFINGYIALKMQEVTQFRAATHPLEYQMYYAN

SEQ ID NO: 6564 - protein, 156 aa, Brassica napus
MKLQTQSFALNLLPSPKFCKPIVKRDPISSLRCSVSTPLTATNHQLSASSHKPFPAEVSRSIMELSSVGTLSTLTRDGWPLGVGVRFAVDGDGTPVLCLNRALSPDKRSALHVQLEQCGLRTPQCTIQGSIARPGDDLALKRLSATFPVKRLCSPP

SEQ ID NO: 6565 - protein, 454 aa, Lactobacillus acidophilus NCFM
MARFKSEKLKNEVVLRDPVHGYIHIEDKVILDIVKSKEFQRMRRIKQLGPVSYVFPGATHTRFEHNLGVYELTRRICDIFVKKYPSVTPGDGLWDDDNRLLVECAGLLHDIGHGPYSHTFEHLFNTNHEKIGQKIITDPNTEINQALKQVDPHFPELVASVIAKTYPNPQVVKMISSQADADRMDYLQRDAYFTGVNYGRFDLSRILRVIRPYQDGICFTNNGMHAVEDYIVSRYQMYQQVYFHRVGRSMEVILHHLLERAQYIYQNDHLQVTPSLAKFLDGNWTLNDYLKLDDGIMETNFSMWTSSKDPILSDLAKRYLYRKPLASVRIDKETKNLLPKLKSLIKEAGFNPDYYTATNSAFDEPYDAYKPSGKNANSQIEIMQDDGSLIELSQLSPLVRALNGTFQGDERFFFPKTMLSHDEDEPQIFAPLYEEFQKYVKNGSLRYLRKPKKK

SEQ ID NO: 6566 - protein, 188 aa, Gibberella zeae PH-1
MRRDYVDRGYYSVETVTLLVALKIRYPQRITILRGNHESRQITQVYGFYDECLRKYGNANVWKYFTDLFDYLPLTALIDNQIFCLHGGLSPSIDTLDNIRALDRIQEVPHEGPMCDLLWSDPDDRCGWGISPRGAGYTFGQDISEAFNHNNGLTLIARAHQLNNSLQFDPCPRAGEPMVSRRTPDYFL

SEQ ID NO: 6567 - protein, 307 aa, Aspergillus oryzae
MSVIDWGVVAPWTRCSFVLTGASEGGLGGATALALASARPSHLVLLARTENKVRTVISTIKEISPETQPAFVHIELEDLDSVRRAAADVLSLTSKIDVLINNAGVMAIPWSKSKSGLEKTLAINHIGHFLLTKLLMPSILAAGPGSRIVNVTSAAYRMAPFFFDDWNFSDGQTYHPLAAYGQSKTANILFTVGLAQRYKEHGILSFAAHPGYIPGTSLLLHGPDLDPSAMDEVARKNTGFPFGPDPPKSLEQGISTTLVAALSPELTDASGAYMEDCQVCEAREYARDPKLADRLWSLSEELASEAF

SEQ ID NO: 6568 - protein, 427 aa, Pasteurella multocida subsp. multocida str. Pm70
MTTSLSLFQRAQHRIPGGVNSPVRAFKGVGGTPIFIEKAQGAYLYDTEGNQYIDYVGSWGPMILGHNHPTILDAVISTAQNGLSFGAPTALEIELAELVCSLVPSIDMVRMVSSGTEATMSAIRLARGYTKRDKIIKFEGCYHGHADSLLVKAGSGALTLGQPSSPGVPADFAKHTLTCTYNDLDSVKHAFEQYPNEIACLIVEPVAGNMNCIPPQEGFLQGLRALCDQYGAVFIIDEVMTGFRVALGGAQTYYGVTPDLTCLGKVIGGGMPVGAFGGKKAIMQHIAPLGPVYQAGTLSGNPIAMAAGLACLTELKKAGNAQRLAQQTEKLALGLKALADKHHVPFVVNYVGGMFGIFFTEQKTVSSYQAVMACDTEKFNRFFHAMLAQGIYLAPSAFEAGFMSLAHSDQDIERTLQAADQVFSQLA

SEQ ID NO: 6569 - protein, 368 aa, Glycine max
MEKELVELYEAAKKAADAAISGDGKHEESRCIDALEQLKKFPVNYKILVNTQVGKHLKVLTKHPRLKIKAFAIDLIEIWKGIIIKETSKNKNGGSDSKVESANGEKSKAGKMQKSPSVKVEKGETVKVEKIDRNGTTKSSSENMKKVQNDVKNEKTDRSASVKVEKIAKEEKPVSGAKKMSSSSAAPPKLKTMIKSNDATRDKIREILHEALSKVTGEADEDLVDVVNNSDPIRVAVTVESVLFEKWGPSNGAQKVKYRSLMFNLKDSNNPDFRRKVLLGVIEPEQLINMSTAEMASEQRKQEYQKITEKALFECERGGPPKATTDQFKCGRCGQRKTTYYQMQTRSADEPMTTYVTCVVCNNRWKFC

SEQ ID NO: 6570 - protein, 482 aa, Ralstonia metallidurans CH34
MQLKDPSLFKQLAYVDGQWISADSGATFDVTDPATGEVIARVADLGAAETTRAVAAAEVAQKAWAAKTGKERANILRRWFDLMLANTDDLAYLMTREQGKPLAEAKGEIAYAASFIEWFAEEAKRVDGEVLATPAADKRLVTLRQPVGVCAAITPWNFPAAMITRKVAPALAAGCAIVIKPAELTPLSAFALAELAHRAGVPAGVLQVVTGDARNIGGVLTASPIVRKLSFTGSTEVGRILMAQSAPTIKRLSLELGGNAPFIVFDDADVDAAVEGAIVAKYRNGGQTCVCANRFYIQDGIYDAFAAKFAERTAQLRVGNGLEAGVVIGPLIEDAAIEKVNSLVEDATSKGGKVLAGGGKHPLGGTYYTPTVIGNATADMRMAREEIFGPVAPLFRFKQDDEAVAAANATEYGLAAYLYTRDISRAWRTAEALEYGMVGLNTGLISNEVAPFGGIKQSGVGREGSRHGIEEYLEIKYLCLQM

SEQ ID NO: 6571 - protein, 174 aa, Prunus armeniaca
YFQFVQQWPPTTCRLSSKPSNQHRPLQIFTIHGLWPSNYSNPRLPSNCIGSQFKGILVSPQLRSKLKTSWPDVEGGNDTKFWEGEWNKHGTCSEHTLNQMQYFERSYAMWMSYNITGVLKNASIVPSATQTWTYSDIVSAIKTATQRTPLLRCKRDPARNKSLPNYQLLHEVVF

SEQ ID NO: 6572 - protein, 426 aa, Thermococcus kodakarensis KOD1
MTEKVEYWVKIPFGPIHPGLEEPEKFILTLDGERIVDVDVKLGYNLRGIQWIALRRNYIQIMYLAERMCGICSFSHNHTYTRAVEEAGGIEVPERAEYIRVIIGELERIHSHLLNLGVLAHDIGYDTLLHLTWLAREKVMDTLEAVSGNRVNYSMVTIGGVRRDIDEKKRRIIEEMIKYYREVFPQIEEAFLHDPTIEARFRDTAVISKRVALEQGAVGPTGRGSGIRDDARWSEGLGVYPDLGIKPVMPQDVTGERPRGDVFDRMAVRIGELWQSLELIEHALDAMPDGPIKTFPKDNVLYAKLRLMVDGEGIGRYEAPRGELVHYVRGKKGSDKPLRWKPREPTFPNLFAVARGVIGDQVADFVVAVASIDPCLSCTDRVAVVQDGKKKILTEKDLLRESIKRTREINPDIKGDPSPLGVGCVR

SEQ ID NO: 6573 - protein, 86 aa, Brassica napus
  misc_feature (60)..(60): Xaa can be any naturally occurring amino acid
  misc_feature (69)..(69): Xaa can be any naturally occurring amino acid
  unsure (1)..(86): unsure at all Xaa locations
MGNRCARTPCCRKLWSCICCSSNKDEAQARSQHGPKGKVHPVTKIEKWEEKITEANNNGXFLVVYFSAXWCVPCKKIEPVFKKLAS

SEQ ID NO: 6574 - protein, 337 aa, Thiobacillus denitrificans ATCC 25259
MHTGTTLTQFIIEEQRRTAGATGDFTSLLNDVVTACKAISNAVNKGALLGVMGALESENVQGETQKKLDVITNDIMIRSNEWAGHLAGMASEEMDDVYAIPGQYPLGKYLLVFDPLDGSSNVDVNISVGTIFSILKAPVAGRAAKAEDFLQAGTKQVCAGYAIYGSSTMLVLTFGHGTNGFTLDRDVGEFVLTHPAMKIPTETKEFAINASNMRFWEKPVQRYVDECLAGKTGPRGKDFNMRWVASMVAEVHRILTRGGIFMYPKDTKDPSKAGKLRLMYEANPMAFIVEQAGGAATTGYQRILDIAPEGLHQRVPVILGSKTEVDTVTGYHHEKAA

SEQ ID NO: 6575 - protein, 327 aa, Thermotoga maritima MSB8
MKKILIVTRTFGKYSQEPVEFLRKEGFEIIRSDTIDPDILKEVDALIVGTHPVTAEMVENSSLKIIAKHGVGVDNIDLEAATKKGIPVTITAGANSLSVAELTIAFIFALSRGLVWAHNKLFLERRWEGTVGQEVSGKTLGVVGFGSIGREVVKKAVCLGMNVLVYDPYVSKDSVRLLEATPVDDLEQLLKESDFVSLHVPLNESTKNMIGERELSLMKKSAFLINTSRGELVDEEALVKALKEGRIAGAALDVFSEEPPDANSPLFECPNLITTAHIGAHTKEAIFRMNMMAAQSIVDFFKGRIPRYVVNKEVIRILKEKGYQEIS

SEQ ID NO: 6576 - protein, 957 aa, Erwinia carotovora subsp. atroseptica SCRI1043
MTQTLSQLEHDGAFIERHIGPSVSQQQHMLSVVGATSLDALIRQIVPADIQLPSPPAVGEAVTEHEALAELKAIAGRNQRYKSYIGMGYSAVLMPPVILRNVLENPGWYTAYTPYQPEVSQGRLEALLNFQQVTQDLTGLDLASASLLDEATAAAEAMAMAKRISKLKQAERFFVADDVHPQTLDVVRTRAETFGFEIVVGKAEEALKDDAVFGVLLQQAGTTGELHDYSDLMAALKARKVVSCVASDIMALVLLTAPGKQGADIVFGSAQRFGVPMGYGGPHAAFFACRDEHKRAMPGRIIGVSRDAAGNTAFRMAMQTREQHIRREKANSNICTSQVLLANIAGMYAVFHGPEGLKRIAGRIHRLTDILAAGLTQGGLLLRHRSWFDTLTIEVADKDVVLSRALSFGINLRSDLASAVGITLDEATTREDVLALFAVLLGDDHGLDIEALDASIAQEVATIPAGLLRHDAILSHPVFNRYHSETEMMRYLHRLARKDLALNQAMIPLGSCTMKLNAAAEMLPITWPEFAELHPFCPPEQALGYRQMIEQLSGWLVQLTGYDAVCMQPNSGAQGEYAGLLAIRRYHESRNEAGRHLCLIPSSAHGTNPASAQMAGMEVVVVACDKQGNIDLHDLREKAQAAGEQLSCIMVTYPSTHGVYEETIREVCQIVHQYGGQVYLDGANMNAQVGITTPGYIGADVSHLNLHKTFCIPHGGGGPGMGPIGVKAHLAPFVPGHQVVKIDGVLTEQGAVSAAPFGSASILPISWMYIRMMGAEGLKQASQMAILNANYIATRLQQAYPVLYTGRDGRVAHECILDIRPLKESTGISEMDIAKRLIDYGFHAPTMSFPVAGTLMVEPTESESQVEIDRFIDAMLAIRSEINRVAQGEWPLDDNPLVNAPHTQAELVADWAHPYSRELAVFPAGSEHKYWPSVKRLDDVYGDRNLFCSCVPMSDYA

SEQ ID NO: 6577 - protein, 319 aa, Zea mays
MSTSSQCTLMEGAISLPRNTRIAVVTGANRGIGLEVCRQLAGNGVTVVLTAVDEELGAKAVGNLQGLALSDVLSHQLDITDASSIARLANFLKARFGKLDILVNNAAVAGVVYSQDHLDDLEPREEKFNLMDRDQRLEWLWRNCRETYHAAKECLQTNYYGTKHVIEALLPLLKASDDGRIVNISSDFGLLRHFRNEDLKQVLNDVGNLTEERLDELLDQFLRDFKVGTAEARGWPVAFAAYKESKAAVNAYSRMLAAKQPALRVNCAHPGYVKTDITLHSGLLAPEEGASNVVKVALLPDGGVTGAFFEEGNELASFV

SEQ ID NO: 6578 - protein, 262 aa, Zea mays
  misc_feature (164)..(164): Xaa can be any naturally occurring amino acid
  misc_feature (181)..(181): Xaa can be any naturally occurring amino acid
  misc_feature (186)..(186): Xaa can be any naturally occurring amino acid
  misc_feature (223)..(224): Xaa can be any naturally occurring amino acid
  misc_feature (236)..(236): Xaa can be any naturally occurring amino acid
  unsure (1)..(262): unsure at all Xaa locations
KSGNPDSFIGSFIRRFGRTGVYRTFMFSKPTVLVATPDACKRVLMDDDSFLEGWPRATVALIGRKSFLTLPCEEHRRLRKLTAAPINGFDALTTYLGFIDRTVVATLRGWSDAGEIEFLTELRRMTFKIIVQIFLTAADDATTLALESSYTDLNYGMRAMAINXPGFAFHRAFKARKSWCXVLQGXVLNERRATKRLPAGSSVDMMDRLIEAEDEHGRRLDDXXIIDILVMYLNAXMESSGHICMWATVYLQKHPEIFAKAK

SEQ ID NO: 6579 - protein, 446 aa, Lactococcus lactis subsp. cremoris
MTITAADIRRDVKEKDIKFLRLMFTDILGTLKNVEVPATDEQLDKLFENKMMFDGSSIEGFVRINESDMYLYPDLDTWIVFPWGDEYGKVAGVICDVYTPEGEPFAGDPRGVLKRNLKSMEKLGFKNFNLGPEPEFFLFKLNENDEPTLEVNDKGGYFDLAPTDLAGNTRREIVNVLTDLGFEVEASHHEVAIGQHEIDFKYTNALKACDNIQIFKLVVKTIARKHGLHATFMAKPVHGINGSGMHCNMSLFTEDGANAFADPAGDMGLSDVAHSFIAGLLKHAYNFTAITNPTVNSYKRLVPGYEAPVYVAWAGRNRSPLIRVPASRGLSTRVELRAVDPTANPYLALAVLLAAGLDGVENKLEAPEAIESNIYVMTEEERKAHGITDLPSTLHNAVKALREDTIVTEALGEHVLVNFVDANGIEWASYAQFVSQWEIDNYLELY

SEQ ID NO: 6580 - protein, 497 aa, Mycobacterium sp. MCS
MATISTPEYLLDQAKRRFTPTLNTIPGMGIVEKRLRDKLQNQEWKQFVLAEPPAGSGLKPVMGDSGLPVLGHMIETFRGGPDYLLQVYKTYGPLHYAYSPALPAVVALGPDATQAVFSNKNKDFSQRGWHPVIGPFFNRGLMMLDFDEHMYHRRIMQEAFTRTRLAGYVEHIDRVASQVIANDWVENDARFLFYPAVKELTLDIASVVFMGHEPGTDKELVTKVNDAFTMTTRAGGAIIRTGLPPFKWWRGLQARKVLDNYFEQRVKEKRGSEGTDMLTVLCHTADEDGNTFSDQDIVNHMIFLMMAAHDTSTSTLTTMAYHLSRNPEWQERCREESERLGDGPLDIEALEKLETLDLVINESLRLVTPLPFNVRQTVRDTELLGHYIPANTDVVLWPSVNHHLPELWTDPEKFDPARFTEPRNEHKQHRYAFAPFGGGAHKCIGMVFGQLEIKTVMHRLLRRYRLEPPRPGYVSKLDYAGMPVPMDGMPIVLRPLR

SEQ ID NO: 6581 - protein, 430 aa, Shewanella sp. MR-7
MTRSEALFEQAKKTIPGGVNSPVRAFNGVGGSPLFIEKADGAYIYDADGKAYIDYVGSWGPMILGHNHPKIREAVLAAVHNGLSFGAPTELEVQMAEKVIAMVPSIEQVRMVSSGTEATMSAIRLARGFTNRDKILKFEGCYHGHADCLLVKAGSGALTLGQPSSPGIPEDFAKHTLTAVYNDLDSVRTLFEQYPTEIACIIIEPVAGNMNCIPPIPGFLKGLRTMCDEFGALLIIDEVMTGFRVSRSGAQGHYGVTPDLTTLGKVIGGGMPVGAFGGRKEVMQFIAPTGPVYQAGTLSGNPIAMSAGLAQMEALCEEGLYEALSAKTKRIAEGFKAAADKHGIPMAINYVGGMFGFFFTEQEQITRFDQVTKCNIEHFRTFYHGMLDEGVYLAPSAYEAGFLSMAHGEEELRLTLEAADRVLARMKAAM

SEQ ID NO: 6582 - protein, 319 aa, Burkholderia mallei ATCC 23344
MNVAPPPSMPATGGPLIDRARVDAHLAPAAREWSIEIVDTTGSTNADLGARLKALPRRRDALAAPIARVAYEQTAGRGRQGRPWFAKPGDALLCSVACVLPRPVGALAGLSLAVGVALAEAFAALPAATGDAPRGDADGARRIALKWPNDLLVATERDGETAIVGKLAGVLIETVWNTIDATAVVIGFGVNVRTADAAAAEVDALRARDATLAGGLPPVALAAVRAGATLTDTFAAALNALAVALPAFAADGLAPFAARWHALHAYAGREVVLLERGAELARGVAVGIDETGQLLLDTPAGRQAIAAGDVSLRTPGAAR

SEQ ID NO: 6583 - protein, 267 aa, Dehalococcoides sp. BAV1
MNIAFIGGGNMGEAILGALIQKNICPPQNITVSEIKAERRTYLETSYGIKTTASNPDAIKSAEVVLLAIKPQNLPELSAELKGKLADKQLVISIIAGATLSKLSGGLAHKAVVRVMPNTPAMIGMGMSVWTALPSVSPAQKDQAKAILSAMGKEIYTGKETMLDAATAISGSGPAYFFLFMEGLEKAALEMGFTPEEASILVSQTAAGSAIYAGKSGFALTQLRKNVTSPGGTTAEAIKAFEEAGLEATIIKAAKAAFNRSVELGKG

SEQ ID NO: 6584 - protein, 229 aa, uncultured crenarchaeote 74A4
MADDQKNDGAIIIAEKQTGGRGRSGRKWISPKGGIWLSIILHPKFDISITTLFPIASSLALSYAIEKTCKISPLLKWPNDLTVNGKKLAGMLVDASMQSNRIESLVLGVGINFNVNVKEIGKELKNTLNYYGIASLSEQKNKVTAIELVQSFLLELEKIYELLNTNQTKKIISEWTKRSSTIGKKVEIDTVNGKIKGDAIKIDEYGRLIIKNKGKISKVIAGDIVHLEK

SEQ ID NO: 6585 - protein, 179 aa, Pyrus communis
FTQQYQPAACNSNPTPCKDPTEKLFTVHGLWPSNSNGPDPVNCKPKTKVPQIDPSLKPQLEIIWPNVFNRADNESFWNKQWDKHGTCGYPTIKDKNHYLQTVIKMYITQKQNVSQILSKANINPDGIGRTRKLIENAIRNGTNDKEPKLKCQKNNGTIELVEVSLCSNYLGKHFIDCAH

SEQ ID NO: 6586 - protein, 155 aa, Arabidopsis thaliana
ASRARLFKEYKEVQREKVADPDIQLICDDTNIFKWTALIKGPSETPYEGGVFQLAFSVPEPYPLQPPQVRFLTKIFHPNVHFKTGEICLDILKNAWSPAWTLQSVCRAIIALMAHPEPDSPLNCDSGNLLRSGDVRGFNSMAQMYTRLAAMPKKG

SEQ ID NO: 6587 - protein, 366 aa, uncultured crenarchaeote 74A4
MGHWSLILGHGQKNVKESIKKQIEKSWMYGTVNEQTIKLSELISKAVPVAEKIRYVTSGTEATMYAVRLARSVTGKKIIAKIDGGWHGYTSDLLKSVNWPFKESESSGTVNDEKIISIPYNNLEGSLKILKKHSKNLAGVIIEPVLGGGGCIPATKEYLKGIQEFVHKNKSLFILDEIVTGFRFRYGCLYPTMKLDPDIVTLGKITGGGMAIGVICGKKEIMEHADTTGKKKSERAYIGGGTFSANPTSMTSGYATLNYLKTNKSTYSKINAIGDYARKELEKVFDGKVVVTGKGSLFMTHFIKNGVTEISNSTDVAKCDSEMLQKYHFKMISKDGIFFLPGKLGAISISHTKEDIEKIILASESF

SEQ ID NO: 6588 - protein, 245 aa, Bacillus cereus G9241
MIKLVLIRHGQSLWNLENRFTGWTDVDLSENGLSEAREAGAILKKNGYTFDVAYTSVLKRAIRTLWIVLHEMDLAWVPVHKSWKLNERHYGALQGLNKDETAQKYGEEQVHIWRRSIDVRPPALTEDDPRYEMNDPRYKALKKGEFPLTECLVDTEKRVLAYWHSEIAPKLKNGNKVIISSHGNTIRSLVKYLDNLSSDGVVSLNIPTSIPLVYELDDDLRPIRHYYLSMDGEVPEGEIPKHISF

SEQ ID NO: 6589 - protein, 466 aa, Phaseolus vulgaris
MALFMAILGVLVLLLCFCSALLKWNEVRFRRKGLPPGAMGWPVFGETTEFLKQGPNFMKNKRARYGSFFKSHILGCPTIVSMDPELNRFILMNEAKGLVPGYPQSMLDILGTRNIAAVHGSTHKYMRGALLSIISPTLIRDQLLPKIDEFMRTHLMDWDNKVINIQEKTKEMAFLSSLKQIAGMESSSIAQPFMTEFFKLVLGTLSLPINLPRTNYRGGLQARKSIISILSQLLEERKASQDVHVDMLGCLMKKDENRYKLSDEEIIDLVITIMYSGYETVSTTSMMAVKYLHDHPKVLEEIRKEHFAIRERKKPEDPIDCNDLKSMRFTRAVIFETSRLATIVNGVLRKTTHDMELNGYLIPKGWRIYVYTREINYDPFLYHDPLTFNPWRWLGNSLESQSHFLIFGGGTRQCPGKELGIAEISTFLHYFVTRYRWEEVGGDKLMKFPRVVAPNGLHIRVSSFSN

SEQ ID NO: 6590 - protein, 276 aa, Geobacter sulfurreducens PCA
MRGDGIRARKALGQNFLTDRSVLSRIAALVSAGAGERILEIGPGKGALTSYLAEQAGQLVAVELDDRLVPLLRGSFAGNPSVTIIEGDILDLDLRETLGRYGTPPWKVAANLPYNISTPVLFRLLDARDLFSRLVLMLQKEVGNRLAAGPGSKEYGVLSVLFQLHFDVTREILVRPGSFHPVPKVDSVVLLFVPLAQPRVDVGDEDYFRRVVKASFAMRRKTLWNCLKGGALGVPTDGIRDVLARCGIDEGRRGETLSLQEFASLTKGLLAAGGSL

SEQ ID NO: 6591 - protein, 261 aa, Blastopirellula marina DSM 3645
MDPFPQAALDEIARSVGAAAVEALAELPSTSRYTKERADAIAATLPYVIVAQRQTAGRGRGDNAWHATDGALTFTAVFDQASLLIPLQRWPQASLMTAVAVAEALETLVPDESIFVKWPNDIYCRGRKLCGILLERTDSPRPMLHLGIGVNVNNSLAAAPQEVQDRAISLVEMSHQDFFLPDVLLAILQRMQANFALCERSLVPLADAWRSRCLLWGRKVEIQSGEQTIAGICGGIDDSGALLVDSPAGVRRILAGVVTRF

SEQ ID NO: 6592 - protein, 614 aa, Acinetobacter sp. ADP1
MSLLLQITIFLGAALLLVPLGKHLGIATVLGYLFTGILLGPSILNIASDANAILHMADFGVILLMFLIGLELQPQRLWQLRHSIFVMGSLQVVLTGIVLIAVIILLFKLDIASGFVLGFALALSSTAFVLQLLAEKQQLSTTYGQQSFSILLFQDIAAIPLLAMIPLLTGTSSTHHGIAYFAAIIATFTGLFLFSRYIMRPFFRFVAKSGATELITAVGLFIVLGVVMLMDLLGISTTLGAFLTGVLLADSEFRHELEASIAPFKGLLLGLFFMTVGMTTQVSLLLDMPWLIIGGALGLILIKGIVLTAISRYFKYSWQNSLLLAACLAQGGEFAFVILKVAQKEGVLAQAMTDPVILIVTVSMVMTPICYWLIQKQILPLFSKEHPPEYDAIPQHEHPMIIAGFGRFGQIIARNARLNHIGFTAIDNNLQQIDFVRRYGGTLYYGDITQPDILRAAGIEKAKVFILAIDDVEDSMNVARHIRLNYPQITLMVRARDRYQVHLLRDLGVEHIWRETYLSSLGMAYRALCELGIPEQQAYDNIELFRDYDEKLLTQQQNIYNDEQKVFETHRNALAELEHLFESDERHQTKRNSEVNLKRGLENHRIDVTRDDPL

SEQ ID NO: 6593 - protein, 434 aa, Bacillus thuringiensis serovar konkukian str. 97-27
MVVEFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIENYDAAQDTDGEMFGKFFKLMLQEGVNLAPSKYEAWFLTTEHTKEDIEYTIEAVGRAFAALADNK

SEQ ID NO: 6594 - protein, 373 aa, Lactobacillus plantarum WCFS1
MKIKAAVVDKVNDPFVIKDDIELAEMKATDLQIKMVATGICHSDEAIRRGDASLGYPVILGHEGSGIVEKVGSEVTNFEVGDHVILSFYADGTCDNCLKGMPTKCRNYADYNLSGTRPDGSDHFQENGHHISDMFDQSSFTTHTVVDQRNAVKVPKELDLRRLGPLGCGYVTGSGTVLNSLQPRPGQTIAVFGTGAVGLAAMMAGKISGCTEVIAVDIVDSRLELAKELGATHAINSKEEDPVEAIKKLTHGYGVDFAVDTTGVEPVMVSAIHALAQGGTAALIAVTAKNITISSWNDLCVDDKKVIGVNMGDAIPGVDIPRLIDFYQHGMFPFEKTEKFYKFEDINQANADSGSGKTIKPVLIIDEDYQPGK

SEQ ID NO: 6595 - protein, 467 aa, Yersinia pseudotuberculosis IP 32953
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWKSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERVKSSEIPS

SEQ ID NO: 6596 - protein, 440 aa, Clostridium thermocellum ATCC 27405
MSYNIKIKEVLEFVEENDVKFIRLAFCDILGIPKNISIMPQELERAFEQGISFDASSILGFMNVEKSDLFLHPDPSTLSILPWRPQQGRVIRFFCDIKHPDGSAFEGDSRNILKKAVERAEKMGYACRIGSECEFYLFETDEKGRPTYIPHDEGGYLDMAPLDKGENVRREICLSLEQMGIQPESSHHEQGPGQHEIDFKYSDALTAADDLMTFKTVVKAVASRNGLFASFMPKPILTESGSGLHINISLSKDGFNIFKERNYDSSAAKSFIAGVIDKILDITAFANPITNSYARLGSFRAPKYVSWSHQNRSQLIRIPAETGEYSRMELRSPDPACNPYITFALILHAGLDGIERKLELPGPINQNLYNAGADELQNIKALPQNLKEALDVASKSSFVRNILGEEMLSKYLEIKLKEWNMYFESEDRESVEKQMYFKII

SEQ ID NO: 6597 - protein, 1082 aa, Magnaporthe grisea 70-15
MIQKYGGHAVKFSFSNSPLDNIFGLRFAWEFYRHGRRDEYLKFTHRSFAQSGAGRANPYTYEVNLGGVRTIWTADPENIKAMLGSQFEDYGRGKAFQSRWHDLLGTGIFNADGREWHDSRHRLRPLFNRQRVSNLDSFERQIQIMINRHLGGGRTVDLKDVISRFALDAIGDYAMGFQVNALADRKNDFLDALERIKTIQNIKECAGPLSWLVPTPGFKRDLKVLDDFMEPLIEHAASLPQSVLDEMEKTDHGWTYVKACASVSRDRHFLKYELMSVILAGRDTVSGTLVWTFLELVKRPDLMADLRREIENTVGIGRDAPRPTHDDLRSMRLVKNTLNETLRLYPTVSLNLRTALRDTSLPRGNDHDGNKPVGLAEGTPVIFSSHILQLSPETYEQSPPGTSPPHVFDPYRWEEWKPKPWTYIPFGGGPRICIGQEFALAEMAFLLVRLLQNYSRLEMRCEMRGNSDEGWERPNGSASIVEQFMMEKGRVRISGDVTLSPRDKDSQLVKIISTKPTMIVTIPVLLATYILYWTVRLVKNILRANATGLPVRWTPVAPTNPFWIVLGKPTSRVLRAILPSFLSNWTYFSTFDWHWLDRLYLDFEVHEKNGDTFLHATPSGLMLHTRDPQVAQQILHTCPKPDDVAKSLELCGPNLVSSSEVDWPRHRKVTVSTLSDRNNRLVWSETVRQTLNVLQSYQPGHGEIIDPEGDIRRIYLNMFSAVCFGRPLDAEKEPGETTDGKLPGGHKRSYRYCLETSLRDIFILHTVPSWIKYLPPALVPHKISEFFAASREMMQYLDEMIRRCQDEAQEGGEESKSGDNLLRITVRSGLQSNTKEPQGRSYLSKEEVRGNLLIYSLAGHESNAHTLTYALYLLAACPDVQDWLAEELAAITLLDGQLSAEETYFGIMAKLPRTLAVMYETLRLYPSIIFLPKTTASRSVSIDLGHVEGQSKAIIPPNTNIWVNMCGMQVLPEVWGDDARTFRPSRWINSSGQLAAPSLVAGSAYVAWGGGKRVCPGQRFSQAAFAASVVALLTGGKRVHVVPREGEEEGMARRRVLEVLDDSFVGTTIHMRRAGDVKLVVA

SEQ ID NO: 6598 - protein, 604 aa, Neurospora crassa
MSMYPHRPIAGAPIQNMGRLNELLDGIRMEFESQARQYETCQHDLATQLQELQVIREKVFQMEQHQMNVKQKYEDEIALLRRQLEARGGAPGNMNPPPQHPGQQQPPAIGLGSNVFSAIMAGQGGQALVPPPPPPQQQEQPAHMPAPPGLQGPPPPPPPPSQQPPFQQQYQGPQGPGNFPPQPPQSTASPGPAGKRGIGRPPAGGPATPQINTPIPYNGGPAQSPQVPTHPTPDHTRMAQHHQPPPPPPSQTNALSELDPDRLPNHIKKMKDDWWVIFNAAVPRVLDVELVHTLQHESVVCCVRFSMDGKYVATGCNRSAQIYDVETGEKLCILQDENIDLTGDLYIRSVCFSPDGKYLATGAEDKLIRVWDIQSRTIRNTFHGHEQDIYSLDFSRDGRTIASGSGDRTVRLWDIETGQNTSVLSIEDGVTTVAISPDKQFVAAGSLDKSVRVWDMRGYLAERLEGPDGHKDSVYSVAFSPDGRNLVSGSLDKTIKMWELSAPRGIPSSAPPKGGRCIKTFEGHRDFVLSVALTPDSQWVLSGSKDRGVQFWDPRTGHTQLMLQGHKNSVISVAPSPVTGSNGVGYFATGSGDMRARIWSYSRI

SEQ ID NO: 6599 - protein, 613 aa, Pseudomonas aeruginosa PAO1
MEHGSSFLQSGVVFLIAAVFMVPLAKRLQLGAVLGYLLAGVLIGPSVLGLVDNPESVAQISEMGVVLLLFIIGLELSPRRLWVMRKSVFGVGLLQVLLTGLVIGTVALVGFDQPVNSAVVLGLGLALSSTAFGLQILAERKELTQPHGRLAFAILLFQDIAAIPLIAMIPLLSGAHSDAGGSELTQTLKVVGSIAAVVVGGRYLLRPVFRIVAQTKLQDMSTATALLVVMGTALLMELAGVSMALGAFLAGLLLADSEYRHELEAQIEPFKGLLLGLFFISVGMSADISLLLKSPWMVLGLTVLLIALKAPVLYFVGRISGGLDKASALRLGVVLAAGGEFAFVVFKMARDQGLFQNDLHNLLVLSITLSMALTPLLVLGLARLLAKEPEATKPPPEMERIDNDDTPRVVIAGVGRMGQIVARVLRAQRVPFIALDTSVETIELTRTLGAIPIFYGDPMRPEILRAAQVEKAEFFVIATDDPETNIETAKRVRKLYPHLKIIARARNRQHVHLLLDAGVEPVRETFFSSLEMSRMVLCGLGLSEEQADARIRRFRRHDEEVLASQHLFYNDRDALIKSAREARVELETLFQTDQLEDRGAVAAETPEKPSRAS

SEQ ID NO: 6600 - protein, 557 aa, Gibberella zeae PH-1
MSRRAPNPAAERAAQNQATIKSLLKLEANKVCSDCKRNKHPRWASWNLGVFICIRCSGIHRGMGTHISRVKSVDLDSWTDEQLQSVLKWGNARANKYWEAKLAAGHAPSEAKIENFIRTKYELKRWVMDGPMPDPATLDVEGDDDVPLSIVKEKQVIERKESIRKASLTNSSAPRTVPPPQGDLIGGDPVPVRSSSAAPQSSKVPPKGEPAPPRTTSTKDSLLGLDFFGEPQAPPRPASTTGTAPSGQSRPDLKQSILSLYASAPRVQPQAQPQQPPSAGGFGGFASPTFSHQSQGSVGGFNDAFSSLSVSNAPKPAAPDPFASLGSAGRTTSSNNNAFGGLGGGSFFDSKPSQPSAPTHQHQSSNFSNFGGFSSPAPVAAAAPAAPKPAQSSAMGDLFDLSAPVTTSPPPPQPAAAPASSVFNLSSPQSPPAAAPASTTTSSMGGFSGADVWGGGEWGAPATAPAPVQKAPEPVKPATTGFEWGNSGGAFANTPIVPGASGGLTSGGFNPIASPKVSADEEFGGWTSSGPPAGGSTSQTKSGGFGGDDDLFSNVWQ

SEQ ID NO: 6601 - protein, 133 aa, Arabidopsis thaliana
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFQLEHGFVYREHGNTPGYYDGRYWTMWKLPLFGCT

SEQ ID NO: 6602 - protein, 534 aa, Coccidioides immitis RS
MRWQLWGFLTALLAINGLANDVELNQDDSRRQQCSGMYGKKAWGGDVDPFIHVALEKLPPKEPSPLMSLIIFEWKDEGLIGRFAPGDKEKFQKETICDRHNVEAGLCDEQSLGAFILEPNATSRAQSALISMAVNLTSAKPIKYPIKKTGFYCVSTYAFTGDDYKGIVTFRNAYGELSAPQIPKLAFYGGLTILYAVIGIFWAFLYVQHRHDILPVQNYITAILVFLVVEQLMTWGFYDYQNRHGMNAMAKVLMFIVAVLNAGRNSFSFFLLLIVCMGYGVVKPSLGRKMIYVRFLAIGHFVFGVIYAVASLSIAPESAGPLVLLVVLPLAATLTAFYVWTLNSLSATMKDLVERKQRVKAMMYKKLWWCILGSIMVIFGFFFINSFLFASKRVVDYIPEHWKTRWFVLDGWLNIVYLFDIAFIAYLWRPTMNNRRFAMSDEIAQDDDGFEIRSLTSSLDDEERVGSNANNRPIGGAHAEHSPAPAAAESLSHPQQARHSIDADHFAVGEEDRWSDDESPRNSTERKGLMHKDD

SEQ ID NO: 6603 - protein, 236 aa, Codonopsis lanceolata
MLGVFSSSIMSPPEELVAAGSRTPSPKITATALVNRFLKSNASAVSMQVGDDVHLAYTHHNESPSAPRSFAVKDEIFCLFEGALDNLGSLKQQYGLSKSANEVVLVIEAYKALRDRAPYPPNHVVGHLEGNFAFVVFDKSTSTLFVATDQAGKVPLYWGITADGYVAFANDADLLKGACGKSLASFPQGCFYSTAVGELRCYENPKNKITAVPATEEEIWGAKFMVEGPGVLTATE

SEQ ID NO: 6604 - protein, 522 aa, Magnaporthe grisea 70-15
MSDDDFMQASDEEEYDFDYEDDDSNNDDGAVDIENKYYNAKQLKQSDPQEAIDEFLGIPALEESKGDWGFKGLKQAIKLEFKMQHYDKAIEHYKELLTYVKSAVTRNYSEKSINNMLDHIEKGAGGSPEAGKCMEEFYSLTLACFQNTNNERLWLKTNIKLCKLLLDRKEYGTVTRKLRELHKSCEREDGTDDPSKGTYLLEIYALEIQMYAETRNNKQLKRLYQRALKVRSAVPHPKIMGIIRECGGKMHMAEENWKDAQSDFFESFRNYDEAGSLQRIQVLKYLLLTTMLMRSDINPFDSQETKPYRNDPRIAAMKDLVDAYQRDDIHQYEAVLKKNTDLLADPFIAENIDEVTRTMRTKAVQRLIAPYERVRVDWIAAQLRITEAEARDILGFLIIDGKVAGKIDQSRGLVEIESRADMDRIVAIKSLADALPLYFGQLFSSSEGLSTGEASAGFFGGASEGDFFMGFDEPLGGLGHAVRRSTRAGKGKNAGTAWGRGSSSGAGSVSYLNASAVHSTFT

SEQ ID NO: 6605 - protein, 426 aa, uncultured bacterium 463
MSTSQQLFERASKHIPGGVNSPVRAFKAVGGTPVFIERSEGACIFDSEGKRYIDYVLSWGPMLMGHNHPAVREAVVRQSEKGLSFGAPTELETQLADRICNIMPNMDMVRMVNSGTEATMSAIRLARGYTGRDTIVKFEGCYHGHSDSLLVKAGSGALTLGVPSSPGVPAALADHTMTLTFNDPEGVRAAFAEHGDKIACVIVEPVAGNMSCIPPSPGFLETLREVCDNSGAVLIMDEVMTGFRFGLQGAQGFYGIEADLTALGKVIGGGMPVGAFGGKREIMEQIAPLGPVYQAGTLAGNPIAMAAGLATLEVISAEGFYEPVFKRTEQLCAGLREAANENGVAFTTNSAGTMFGGFFTESSKIENYAQVMACDTERFNRFFHMMLQAGIYLAPASYEAGFLSSAHTDADIEATVDAARSAFAAL

SEQ ID NO: 6606 - protein, 217 aa, Vibrio fischeri
MKLNQDSLTSKFGSPIERVEQAIKSVQQGNGVLLLDDESRENEGDLIYSVDHLTSEQMALMIRSCSGIVCLCLTEDKADYLELSPMVEHNESVNQTAFTISIEAKKGVTTGVSATDRVTTIKTACKNGALPHELAKPGHVFPLRAKDGGVLTRRGHTEGTVDLMRLAELTPAGVLCEVTNSDGSMAKTPEIIIFAEQHHLPVLTVNDIALYRKEKSN

SEQ ID NO: 6607 - protein, 588 aa, Pyrococcus abyssi GE5
MECKACEKGKCRNANLEEVLSEREGLLEFYEEFKEHIHECKRMSYGQYMFVIDKEVLPKAVLWWHNHPKFKETHLSTAVGTDETPLNGKFAYMPFLSVQVEPFNMDRNYWVFLKAYLDPENPEFPSVAAELPAALWIEREVQDLLGFKAINHPDPRRLVLPEDWPDGVYPLRKCMDYRYSPMAEPKIELKKPPEGTSTVPMGPLHMGIEEPAHFKLFVKGEEIVDVDYRGFYSHRGIEKIGEGRLTYNQVLFLAERICGICGYQHSVSYAMAIERLADVEIPDRARYIRTLLLELERIHNHLLWVGIAAHLVGYDTGFMHAWRIREPVMWLMERLTGNRKQYGMNIVGGVRRDILDYRKEEILRVVREIREEVKRFLEVVLNTNTFIKRAEGVGILPYKVAKEFSVLGPTARASGRKIDARLDQATKTATAYNELDWKVPVYKEGDVLARVLVRMDELFESIWIVEQVIDQMPGGDVMVPVGRLPEYEEALGFTEAHRGEVVHYVMTGEKNKVYRWKVRAPTYNNLPAVPEMLKGYHVADAPLIIASIDPCYSCTERVQIVDVRSGKVKVLTESEFNELSIKRSKEMV

SEQ ID NO: 6608 - protein, 488 aa, Nostoc punctiforme PCC 73102
MQIQTPDWVKHAVFYQIFPDRFARSKQPRKRLLQEARWEDWDSMPTLQGYKGGDLWGIMEDLDYIQNLGINAIYFTPIFQSASNHRYHTHDYYQVDPMLGGNEAFKELLDAAHQRNIKVVLDGVFNHSSRGFFFFHDVLENGPHSPWVNWFKIEGWPLSPYNGEFPANYVGWAGNRALPEFNHDNPEVREYIMEIAEYWLKFGIDGWRLDVPFEIKTPGFWQEFRDRTKAINPEAYIVGEVWGDSRQWLDGTQFDGVMNYLFAGPTIAFAAGDRVVLEQVQSRDYQPYPPLFAAEYATKIQEVLQLYPWEIQLTQLNLLASHDTARLMTIAGGDIASVELSTLLLLTFPGAPSIYYGDEVGLPGGIDPDSRRGFPLEANWNQEIFNTHRQLITIRQTYPALRTGDYQVLYAQGQLYLFARTLGTEELIIAINAGTSSATANVDVASLHTQPNKLLYGTAEAEWNGEEGTQQLSLTLPARSGCILGTGD

SEQ ID NO: 6609 - protein, 227 aa, Neisseria gonorrhoeae FA 1090
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEKYGDEQVRIWRRSYDTLPPLLDKDDAFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 6610 - protein, 402 aa, Ralstonia solanacearum
MTTSRIAARVRRIKPSPSTSAADRANELRRQGKSIVNLVVGEPDFDTPQHIRQAAVQAIERGATRYTLMAGTVELRQAIVDKMARENDLHYAMNEIIATNGAKSAIYSALAITLEAADEVLIPAPYWVSYPDMVLACDGTPITLPCPEHDGFKLTPARLEAAITARTRWLILNSPSNPTGASYTLDEYRALADVLARHPHVLVMTDDIYEHIRFDTVRTPHLLNAAPELRDRTLVINGVSKTYAMTGWRLGWVAGPRDLIQALDTFLSQSAGNCCSISQAAAAAALNGDQRFVAESVAVYKQRRDTTLARLNAIPGLTCRSPDGAFYLYVNCAGLIGKKTPEGKTLDTDTDVVMYLLEREGVAIVAGTAYGLSPYFRMSIATALETLEEGCRRIERAVLALA

SEQ ID NO: 6611 - protein, 293 aa, Anabaena variabilis ATCC 29413
MGLTDNYKLNLIQWYPGHIAKAEKNLKEQLSRVDVVFEVRDARIPLATHHPQIDEWVGNKARILVLNRLDMIPPQVRSLWIDYFQNRGEVPYCTNAQHGQGVAGVAKAAQAAGVELNQRRRDRGMLPRAVRAVVIGFPNVGKSALINRLLGKRVVESAARPGVTRQLRWVRISDQLELLDAPGVIPVKLGNQEAAVKLAICDDIGQASYDNQLVAAALIDIVNSLQEQAGELLPRSPLYARYELDPTPHTGEGYLHALAEYRHKGDVERTARQLLTDYRKGLLGTLPLELPPM

SEQ ID NO: 6612 - protein, 456 aa, Acidobacteria bacterium Ellin345
MHDALRQEIELFEKRTPKSAEAHKRNLKRLPLGVASNYRAYDPYPIFVKDAFGSKFRDLDGNEYIDHNLTFGALMAGHCHPAVMKAVEKRLTTGTMFGMPHDMEWELAEEICARFPIEMLRFASTGTEATMHTVRLCRAATGRDKIIKFEGGYHGLHDAALVSVKPKLEQIGDLKAPIAVPGGQGVPKTAVANVLIASFNDLESVEHRFKTHPNEISAIILEPVMMNVGICMPEPGFLEGLRELCDKHGALLIFDEVKTGAKLGWGGASEYFGVIPDAICLAKSIGGGLPLAAFGASKKVMGLISDHKVFHGGTYNTNPVSMAAGLATFREVLTRENYAHVEKLSHKLVTGYRRVVEEVGLDAYLEIAGANGVLMFAPKRVRNYRDWLEVDASLWQQYWFAMVNRGVMPQPYWWDEQWTMSVAHTDADTEKHLAVFGEIAPALAVAQKEPREAVVH

SEQ ID NO: 6613 - protein, 512 aa, Rhizobium sp. NGR234
MNSHPLMRLLRSRHTVMKLPSNAIKNDTMLPKIIPAIMAGGRGTRLWPLSRATAAKQFLKLIGEETLFQDTLKRVSDAKVYGAPLVITNEEFRFLVAEQARELGVTLSSIVLEPVPRNTAAAVAVAARIVADRFGEDALLLVLPSDHAITVDDTYKKCVRSACIAAAEGKLVTFGIQPTWPATGYGYIERGTYLGKDVHAVQCFVEKPSLEKAAALLETGNYYWNSGMFLFQAASIIAELEEHAPDVLSAVHAAVRGSTVDADFIRLAPESFSQAPSISIDYALMEKTANAAVVCSDFAWSDLGSWDAVWKNEEQNADGNVLKGNVTACNTKNSLVLSHTAHLAVQGMDGVAVIASEDAVFVGRLEEAHEIGNLVKRLAADENTARLTELHPTLIRPWGGYTTMLNGDRFQVRRLFVRPGKMLSLHKHFHRSEHWICVKGTAEVTIEDRVTILHENQSIYIPEGAIHRLGNPGKIMLELVEIQTGAYLGEDDIIRVADESRNEMPDSRRTGP

SEQ ID NO: 6614 - protein, 365 aa, Oryza sativa
MHVKPFLRLYSGRHRAHARAFLDRSVGRELARPAMAAVPEVALRHGAGRPMPAVGVGTADSAATSPETKRGAALAALEVGFRHFDTAALYGTEAPLGEAIAEATRRGLVASREEVFVTTKLWCTQCHPGLVLPSLRESLRNLQMEYVDLYLVHWPISVKPGPPMLPVKREDAVPFDFEGVWRAMEECHRLGLAKAIGVSNFTTKHLDKLLAVATIPPAVNQVEMNPVWQQRTVREYCAAKGIRVAAYSPLGGQNWIGEGNDVMESPVLADIARARGKSIAQGRIQIPGQVSLRWIHEQGVTPIPKSYNKERLKQNLEIFDWELTKEDRLKISQIPQKKIVTAARMFSPDGEFASVDLSDMEIVEE

SEQ ID NO: 6615 - protein, 608 aa, Ashbya gossypii ATCC 10895
MSNANHHHQQQKMYTGGRNMPHGMHRPGSIPIGQRIGKYQVIKTLGEGSFGKVKLAHHVSTGQKVALKIINKKVLAKSDMQGRIEREISYLRLLRHPHIIKLYDVIKSKDEIIMVIEYAGNELFDYIVQRDKMSENEARRFFQQIISAVEYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYSIPKFLSQGAANLIKRMLIVNPLNRITIHEIMEDEWFKVDLPDYLVPVDMKADATSKPGTDDERIDEALVAVLANTMSYDKDEIYEALEDPNQTDPTVLEIRDAYLLLKENKSLIDGLRSNKQKLDQLDTFLSQSPPTFESHSQLGPGSGFQAALGGSQHGDQNPHQVKRLASRQRTYQLSFSEQQDEDSTIAILPSSLPQIHRANMVAQGSPAAVKISPLSNKKSKTRWHFGIRSRSYPLDVMGEIYLALKNLGAEWAKPSEEDLWTIRVRWKYDVGTQQNERIPDLMRMVIQLFQIETNNYLVDFKFDGWESSSGNPISSSSTDDEMSTFSAYPFLHLTTRLIMELAVNSQSS

SEQ ID NO: 6616 - protein, 816 aa, Chlamydophila caviae GPIC
MSFDKNLVNIETMKQAILNRLYFGVVQSPESASARDIFTAVSKTVMEWLAKGWLKTQSSYYEQDVKRVYYISMEFLLGRSLKSNLLNLGILDLVRDALAELNYDFDSLVQMEADAGLGNGGLGRLAACYLDSMATLGIPAYGYGIRYDYGIFDQKVVNGYQVEAPDEWLRYGNPWEICRGEYLYPVHFYGRVIHYTDARGKEVADLVNTQEVLAMAYDVPIPGYGIDTVNTLRLWQAQSPHGFEFNYFNHGDYIRAIEDIALVENISRVLYPNDSISEGQELRLKQEYFLVSATIQDILRRYTKMHISLDDLPNKVSVQLNDTHPALGIAEMMHILIDREELPWDKAWDMTTRIFNYTNHTILPEALERWSIDLFSRLLPRHLEIIYEINARWLEKVSQRFPGNDDKRKALSIIEEGSDKHVNMANLAVIGSAKVNGVSAFHSQLIKTTLFKDFVEFFPDKFINVTNGITPRRWLALCNPRLNTLLDQTIGDGYLVDLSQVHKVIPFADDANFREQWHQIKLKNKEDFALKLKKEIGEKIDPTSLFDFHVKRIHEYKRQLMNILRVIYLYNDLKENSASSIVPTTVIFAGKAAPGYAFAKLVIKLINSIADCVNNDPQVNEVLKVLFLPNYCVTMSEMIMPASDLSEQISTAGMEASGTGNMKFALNGALTIGTMDGANIEMSEHIGRDNMFIFGLLEEEIAKMRREYYPQGICNNNPKIAHVLKLLDQGFFNTSDKDLFKPIVHRLLHEGDPFFVLADLESYICAHESAATLFTQTDEWVKKSIYNVGGIGFFSSDRAIADYAKDIWNVPTNCKS

SEQ ID NO: 6617 - protein, 195 aa, Zea mays
MKLVTAFVVLLFSLLPDSSTAEDFDFFYLVQQWPGSFCDTRQGCCFPDGAGKPEAAFGIHGTSLGRSWPTLSCKNRRSFEFWSYEWKKHGTCSNLDPHDYFARALQLRERHDLAAVLADAGIVPSDTDTYPVDRVRDAIAQGTGFVANLECNRDADGEAQLFQVYQCVDREAKDLIDCPLPMPTKCTDRVKLPVF

SEQ ID NO: 6618 - protein, 522 aa, Triticum aestivum
KHLPTPLITMSISFSQELLISTLAIILLPLMLYLRSSRSKNPSVLPINWPIVGVFPYLIANFHNLHDYLAVVLAGSGHNFRAHGPPGTGLRFFITCEPANVRHIFTTNHANFPKGAEFAAIFDIAGGSFFTTEGEPWRRQRARAQRVLSNPRLLACMTACCRDKVENGLLPVLMHMASTGTTFDLQDLTIRLVLDMTATPLFGVDPGLLSSDMPPMDAAVAMDTVMEVALFRHIVPTSGWKVMRRLNIGPERKLAAAHTVLRGFIEEMMERRKRKEHAGNEGAPSVDILSSYIDDPDYQQNDGLLHATLINYMIAGRDTIGTALTWVFYNLAQNPHVVSFIRHELSPIASQKAATGANNSSTMVIFEPEETKSLVYMRAAIHESLRLHPPVPIERKTAVAHDVMPSGHVVHAGDTLLISLHSMGRMEGVWGKDCREYNPDRWLSEDGKKLRYVPSYNFLSFSSGPRLCLGKDVSFMQMNTIVAAMVWNFDVEVVEGQRVQPKMSCVLQMKNGLMVKLKKREM

SEQ ID NO: 6619 - protein, 317 aa, Xylella fastidiosa Temecula1
MDERVLLTCLGCSYVSGNVLASMTGMTEATIASCIQALRAVGIPIKSRAEQGYALAAPLSLLTAERIRAELSHSIAAELRVLDVAWTLESTNTSLLARPALADGVEVLLAERQTGGRGQRGRSWISPLAANIYLSLSRVFSGGASQVMGLSVAVGVAIAEALIAAGFSHVRLKWPNDLVDNGRKLGGVLVERQGVARAVIGLGLNVRMPKNFAEQIDQPWVDLETLAGSAVERNALVALLLSALLPALHLFQLEGLAPFLPRYAKLDCLVGCAVWIEEANLKYVGIARGLAADGALLVEINGVLRPFHTGQVSVRPI

SEQ ID NO: 6620 - protein, 107 aa, Gossypium barbadense
QTKAIAGKVTNWDNVVLAYEPVWAIGTGKVATPAQAQEVHCELRKWLHENVGGDIAASTRIIYGGSVNGANCKELAAQPDVDGFLVGGASLKPEFVDIIKAAMVKKN

SEQ ID NO: 6621 - protein, 147 aa, Glycine max
  misc_feature (20)..(20): Xaa can be any naturally occurring amino acid
  misc_feature (23)..(23): Xaa can be any naturally occurring amino acid
  unsure (1)..(147): unsure at all Xaa locations
LNEVFIKLDDIWGLLGTAAXAFXCFYLLLAVIAGPMMLGLRLVFITIHPMKWGATLMNSFLFNVGLILLCSISVIQFCSTAFAYYAQATAAQEIFGHTLESLRGIKYLYKYNVFQIAFVALAGLTFVYYAALGWRRKKPSGRFQLST

SEQ ID NO: 6622 - protein, 195 aa, Zea mays
MARGLRENTSPRRKNQPCGWTRRCREDGRTESPRTYRLFISRSRLATTAPPARAAIKTRPISKSTAMKKTSSPLLIVLFLTAAAMAAEPEKQAAPAAQETAVHIVYVDRPEDADPEEFHIRTLTPVLGSEQKARDAVLYHYKNAASGFSAKLTPQQVKDLKEQPGVLQVVPSQTYQLHGPGSGTHQGTTHTLGLM

SEQ ID NO: 6623 - protein, 274 aa, Oceanobacillus iheyensis HTE831
MEYVTLNNGLKMPQLGFGVWKVPNEEVVSPVEHALKVGYRSIDTAKVYGNEVGVGEAISNSGIPREQLFITTKVWNSDHGYDNTLKAFDESLERLGLDYVDLYLIHWPTPEFDQYVETYKALETLYKDGKVKAIGVCNFDIEYLERILNECEIVPVLNQVECHPYLQQKELRDFCEKHNIYLESYSPLMNGKEVLQSEELQNLAERKGKTVAQTILRWHLQSGMIVIPKSVTPNRIEENLDVFDFELTDTEMQEINELDRNLRSGAVPSEMNVR

SEQ ID NO: 6624 - protein, 268 aa, Roseovarius nubinhibens ISM
MPDDIRAMKGGTPIVSLTAYTTPMAKMMDAHCDFVLVGDSLGMVVHGLPSTLGVTMEMMILHGQAVARGLSRAMMVIDMPFGSYEESPEQAFRNAARLMAETGAGAVKLEGGTHMAETIAFLVARGVPVMAHVGLTPQSINTLGGYKVQGRDAGAEKLLADAQAVAEAGAFAVVLEKVPAVMADRITQEVAIPTIGIGASAGCDGQILVVDDMLGLFTAFKPKFVKRYADLGTQGEAAIATYADEVRARQFPASEHTFAAEQPQKAAK

SEQ ID NO: 6625 - protein, 391 aa, Methanococcoides burtonii DSM 6242
MRTQCKPSQFIANRMQKVPPSGIRKFFDLVSDSEDVITLGVGEPDYVTPWHIREACIHSIEYGETSYTSNYGLMELREELSKHYTRRHNVYYEPETEILVTAGVSEGLDLAIRAIVNPGDEIIVVQPSYVAYVPAIIFAGGVPVTLGARPENDFKITADEIRAAITNKTKAVIINYPNNPTGATMDKSDLEAIADVIVEHNILMISDEVYERLTYEGTHTCFSSLEGMRDRTILLNGFSKAYAMTGFRMAYALAPKEIIDAMMLIHQYTMICAPITAQIGAIEALRNGEEEVEKMAREYNRRRKLIVGGLNKIGLDCFNPRGAFYAFPAISSTGLSADEFAERLLNEYKVVTIPGNIFGDTGDGFLRCAYAASREDIKEALDRIGNFVDGL

SEQ ID NO: 6626 - protein, 230 aa, Streptococcus mutans UA159
MVKLVFARHGESEWNKANLFTGWADVDLSEEGTQQAIDAGKLIKEADIKFDLAFTSVLTRAIKTTNLALEYSDQLWVPVEKSWRLNERHYGGLTGKNKAEAAEKFGDEQVHIWRRSYDVLPPAMAKDDPYSAHTDRRYANLDDTVIPDAENLKVTLERALPYWEDKIAPALKDGKNVFVGAHGNSIRALVKHIKQLSDDDIMGVEIPNFPPLVFEFDENLNVTAEYYLGK

SEQ ID NO: 6627 - protein, 381 aa, Listeria monocytogenes str. 4b H7858
MTKSIRPELRDIQVSGIRTFNTRVTGIPDMIRLTLGEPDFPTPEHVKQAAISAIEENFTNYTPNAGMPELLEAASTYFHEKYDLSYNNKEIIVTVGATEAISVALQTILEPGDEVILPDPIYPGYEPLITLNRAHPVKVDTTETNFKLTPEQLRAHITPKTKALIIPYPSNPTGVTLSKKELFALAEVLNETGIFVIADEIYSELTYHEEHVSIAPLLREQTIVINGLSKSHAMIGWRIGFLLAPEALTQEMLKIHQYSVTCASSISQKAALEALTNGKDDAFQMRTEYKTRANFTQDRLEKMGFTVIPPDGAFYFFVKLPDEITENAFDWAVKLAEEAKVAVVPGNAFSEKGDRYFRLSYATSFNNLAEALDRMAQFIAK

SEQ ID NO: 6628 - protein, 413 aa, Streptomyces avermitilis MA-4680
MHSAVLLIEFGAIILSLGLLGRAAARLRFSPIPLYLLAGLAFGEGGLLPLGASEEFVATGAEIGVILLLLMLGLEYTAGDLVSNLKAHYPAGLVDFTCNALPGAAAALLLGWGPVAAVVLAGVTWISSSGVIAKVLGDLGRVGNRETPVILSILVLEDLAMAVYLPIVTALVAGAGLAAGSVTLAVALAAAGLVLFVALRFGRLISRFVSSDDPEKLLLVVLGLTILVAGIAQQLQVSAAVGAFLVGIALSGEVAEGAHTLLSPLRDLFAAVFFVFFGLHTDPASIPPVLLPALALAAVTAVTKIATGYWAARRAGISVKGRWRAGGALVARGEFSIVIAGLAVTAGIEPSLGPLATAYVLLLVVLGPLTARYTEPLIARLNARSGRVRPEHRDAPVPTEPEGDTRAQTTVGD

SEQ ID NO: 6629 - protein, 413 aa, Clostridium thermocellum ATCC 27405
MNFDTIESAIEDIRQGKMIVVVDDEDRENEGDLLMAAELVTPEHINFMATYGRGMICAPITEARAKELGLELMVTKNSEHMRTAFTVTVDHKSTTTGISAFERAKTIKELSNPDAKPDDFVRPGHVFPLIAKEGGVLKRAGHTEAAVDFAKLAGLYPAGVICEIMNDDGTMARVPQLMEFVKKHGLKLVTIADLIKYRRNNEKLIRRAAEAKLPTEYGDFKIVAYENVINGEHHVALVKGDVANSDEPVMVRVHSECLTGDAFHSLRCDCGEQLHKAMEMIGKEDKGVLLYMRQEGRGIGLVNKIRAYELQDQGKDTVEANVLLGFPPDLREYGIGAQILYDLGVRKIRLLTNNPKKLIGLGGHGLEIVERVPIEIKGNEINSFYLKTKKEKMGHLLTSINTTEHQEGESNGN

SEQ ID NO: 6630 - protein, 493 aa, Ralstonia solanacearum
MALTFDQLRHTGLIRTDNLIDGRWSAGADGARYAVTDPATGSIIAQVADSSAADARAATDAAARALPAWRDTLPAERAAILRRWHAAIVANADALGRLISLEQGKPFAEGRGEVMYGASYVAWFADEATRIYGDLIPQQQRGKRMSAIKEPIGIVAAITPWNFPLAMIARKIAPALAAGCTVVAKPAEDTPLTALALAQLAQEAGLPPGVLNMIAASRERGVAAVADWLQDGRVRKITFTGSTPVGKHLARESAGTLKKLSLELGGNAPFIVFDDADLDAAIAGLLSAKFRNGGQTCVCPNRVYVQAGVYDRFAAMLAARVSALKVAPATDPDAQIGPMINARAVDKIERHVQDAVAHGARVLAGGKRLPEVGAHFYAPTVLADAHPGMALCGEETFGPVVPLFRFTDEAEAVQAANDTPFGLAAYFYSQDVRRIDRVAHALEAGIVGINEGALASEAAPFGGVKESGYGREGSKYGLDDYLSIKYLCQGGLA

SEQ ID NO: 6631 - protein, 241 aa, Glycine max
TSSKAMVARGDLGAELPIEEVPLLQEDIIRRCQIMQKPVIVATNMLESMINHPTPTRAEVSDIAIAVRQGADAIMLSGETAHGKFPLKAVKVMHTVALRNESSVQSGVSYPSQLSSHESHMGEMFAFHATTMSNTLNTPIIVFTRTGSMAILLSHYRPYSTIFAFTNEARIKQRLALYHGVMSIYMQFSNDVEETFSRALKLLLSKSHLHEGQHVTLVQSGAQPIWREESTHHIQVRKVHG

SEQ ID NO: 6632 - protein, 379 aa, Xanthomonas axonopodis pv. citri str. 306
MNFAPVPELIEELRAGRMVVIVDDEDRENEGDLIMAAELVKPSDINFMVTHARGLVCLSLTRERCAQLGLAPMVRNNTAQFQTNFTVSIEAAEGVTTGISAYDRAHTVRTAVRPDARPQDLSQPGHIFPLISQPGGVLTRAGHTEAASDLPMLAGLEPAGVLVEVLNPDGSMARRPQLEVFAREHGLKMGSIADLIAYRLANEHTVERVDEREITTEFGPFKLVTYRDRIAHDLHFALLRGRADPQTPTLVRVQVENPLADLLHWQRDDFGVAATDALRAIAAEGQGVMVVLSAPRDSESLLARLRQQPEAAANAKDVSQWRRNGAGAQILADLGLGKLRVLGTPRRQVGLAGFGLEVVEYLECHAGEGVRSVPPSAVP

SEQ ID NO: 6633 - protein, 306 aa, Ustilago maydis
MVDITEQDAWIAHLSECKQLSENDIKRLCDKAREILLGESNVQPVRCPVTVCGDIHGQFHDLSELFRIGGNSPDTNYLFMGDYVDRGYYSVETVTLLVALKVRYRDRVTILRGNHESRQITQVYGFYDECLRKYGNANVWKYFTDLFDYLPLTALIDDQIFCLHGGLSPSIDTLDHIRSIDRIQEVPHEGPMCDLLWSDPDDRCGWGISPRGAGYTFGQDISEAFNHNNGLTLVARAHQLVMDGFNWSQERNVVTIFSAPNYCYRCGNQAAIMEIDENLKYTFLQFDPAPRAGEPLVSRRVPDYFL

SEQ ID NO: 6634 - protein, 474 aa, Nocardioides sp. JS614
MFQNSDELLKYVKDEGVEMIDVRFCDLPGIMQHFTVPVSSFDQSVFDDGLGFDGSSIRGFQAIHESDMSLFPDPTTAYLDPFRTAKTLVVNFFIHDPLTGEAYSRDPRNIARKAMAYLGTTGIGDKAYFAPEAEFYVFDNVRFETKANAGYYEIDSSAGAWNTGAAFENDNRGYKVKYKGGYFPVAPTDHFGELRDEMVIELERAGLQVERAHHEVGTAGQAEINYRFDELLKAADDVMKFKYIIKNVAWRNGKTATFMPKPIFGDNGSGMHCHQSIWNAGEPLFYDETGYGGLSDTARWYIGGLLKHAPSLLAFTNPTVNSYHRLVPGFEAPVSLVYSQRNRSACVRIPITGSNPKAKRIEFRCPDPSANPYLAFSALLLAGLDGIKNKIEPAAPIDKDIYELPPDEMADIEQVPASLDAVLNNLETDHEFLTAGNVFTSDLIETWIDYKRQNEILPVQQRPHPHEFELYYDI

SEQ ID NO: 6635 - protein, 583 aa, Streptomyces avermitilis MA-4680
MIVNEPVPDTFEDTPAKDRDPEWFKRAVFYEVLVRSFQDSNGDGVGDLKGLTAKLDYLQWLGVDCLWLPPFFKSPLRDGGYDVSDYTAVLPEFGDLADFVEFVDAAHQRGMRVIIDFVMNHTSDLHPWFQESRSNPDGPYGDYYVWADDDKQYQDARIIFVDTEASNWTYDPVRKQYYWHRFFSHQPDLNYESAAVQEEILAALRFWLDLGIDGFRLDAVPYLYNEEGTNCENLPATHEFLKRVRKEIDTHYPDTVLLAEANQWPEDVVDYFGDFPSGGDECHMAFHFPVMPRIFMAVRRESRYPVSEILAKTPAIPSSCQWGIFLRNHDELTLEMVTDEERDYMWAEYAKDPRMRANIGIRRRLAPLLDNDRNQIELFTALLLSLPGSPILYYGDEIGMGDNIWLGDRDAVRTPMQWTPDRNAGFSSCDPGRLYLPTIMDPVYGYQVTNVEASMSSPSSLLHWTRRMIEIRKQNPAFGLGSYTELQSSNPAVLAFLREAPSTGGNGDDLVLCVHNFSRFAQPTELDLRAFSGRHPVELIGGVRFPAIGELPYLLTLAGHGFYWFRLRKDVTQVTKVSLFVSS

SEQ ID NO: 6636 - protein, 244 aa, Plasmid pIlo8
MNQNIKYSQNFLTSEKVLNQIIKQLNLKETDTVYEIGTGKGHLTTKLAKISKQVTIELDSHLFNLSSEKLKLNTRVTLIHQDILQFQFPNKQRYKIVGNIPYHLSTQIIKKVVFESRASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTITYEQVLSIFNSYLLFNGRK

SEQ ID NO: 6637 - protein, 366 aa, Zea mays
  misc_feature (246)..(246): Xaa can be any naturally occurring amino acid
  unsure (1)..(366): unsure at all Xaa locations
MEAAAIPTSAPETRSVRAIPSCFASFLQSSVQSLREHKCACSPSTDLAGTGTYQVFLTGSRSFYLLLDRIAVVTGGNKGIGLEVCRQLAGAGATVVVLTARDETRGAAAAQELRESGLSDVIFHQLDITDAASVSRLAEFLKARFGKLDILVNNAAVGAVEYVQDPADSSTSEEELSGMDMVQRLQCMLKRVRETYDAATEGIKTNYYGIKHVIEALLPLLQASSDGRIVNVSSDFGLLRLINNEXLRQELNDVEKLTEERLDEVLAAYLRDFDAGEVGARGWPVDFSAYKVAKVAMNAYTRILARSHPGLRVNCAHPGYVSTDMTVHTGPLTPEQGAANVVKVALLPEGGPTGAYFALGEEASFM

SEQ ID NO: 6638 - protein, 406 aa, Crocosphaera watsonii WH 8501
MYSSALGATSGQTTAYGSRMFVYEVVGLSQNTDNDSLDYPIRRSGSVFITVPYGRMNQEMRRISRMGGRIVSIQPVDAETPLKSTSNGSSTAKVAQPQASNQTEKKRKSMTQAKTKIPTNIYRQKSPYVGKCIENYALVAEGGSGIVQHVTFDISGGDLHYLEGQSLAIIPPGTDAKGKPHKSRLYSIASTRHGDKVDDKTISLCVRQLEYEHPETKETVYGVCSTYLCNLEVGADVAMWGPVGKEMLLPDEEDANIIMLATGTGIAPFRSFLWRMFFENNPEYKFKGKSWLIFGVPYSANVLYKDQLEEIQTKYPDNFDLTYAISREQKNSEGGRMYIQHRVAEQAEKLWTMLQDPKTHLYMCGLKGMESGLEEGLRDFASKQGVEWPDFVKQLKKEHRWHVEVY

SEQ ID NO: 6639 - protein, 256 aa, Vibrio sp. Ex25
MRRPVVMGNWKLNGSKAMVTELLTGLNAELEGVEGVDVAVAPPALYIDLAERVIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAKAKA

SEQ ID NO: 6640 - protein, 531 aa, Roseovarius nubinhibens ISM
MAPKVLVSDKLSETAVQIFRDRGIDVDFLPDVGKDKDKLAEIIGQYDGLAIRSATKVTEKILDAATNLKVIGRAGIGTDNIDKDAASKKGVIVMNTPFGNMITTAEHAIAMMFAVARQLPEASASTHAGKWEKSKFMGVELTGKTLGVIGAGNIGGIVCDRARGLKMKVVAYDPFLSQEKADKMGVEKVDLDTLVARADFITLHVPLTDQTRNILSAERLAQTKKGVRIINCARGGLVDEAALAELLKSGHVAGAGFDVFSQEPATENPLFDLPNVVCTPHLGAATTEAQENVALQVAEQISDYLLTGAVSNALNMPSVTAEEAKVMGPWIKLAGHLGNFIGQMTDEPIKAINILYDGVVSQMNLEALTCSAVAGIMKSVNPEVNMVSAPVIAKERGVKISTTHQDKSGVFEGYIKLTVVTAERERSIGGTVFSDGKPRFIQIKGINIDAEIGAHMLYTTNEDEPGIIGMLGQTMGQNGVNIANFTLGRSQAGGEAIALLYVDAEVPAPVIKQLEDTGMFKQVRPLQFDVA

SEQ ID NO: 6641 - protein, 264 aa, Roseovarius nubinhibens ISM
MRDLTPLALVGASGWLGRFMGPALLRAGVVGPGDFIGLNRSGASEAYAQWPGLRWSTDPEKGLEGAGMVILSLRPDEFRAAPLRCPGALVLSVMAGVSMAEIRERTGARAVVRSMPNAAMEIGQSFSPWVAEAEADDADRAMVRAVLGASGREEAFAREADIDVYAAICGAGPAWAALLLEALAAAGRAEGLSPEQALAAAEGAVVGAGAMLAGQGAQAGAMVDEFIAYAGTTAAGLEAARAAGFAEAVAAGIAAGTQKARALG

SEQ ID NO: 6642 - protein, 369 aa, Vibrio vulnificus CMCP6
MPISTPQEIIEDIRLGKMVILMDDEDRENEGDLIMAAEHITPEAINFMAKYGRGLICLTMTKERCQRLGLPPMVQDNNAQYTTNFTVSIEAAEGVTTGISAADRARTVQAAVAKEAKAADLVQPGHIFPLAAQDGGVLTRAGHTEAGCDLARLAGFEPASVIVEILNDDGTMARRPDLEVFAEQHGLKLGTIADLIEYRNNTETTIERVAECKLPTEFGEFDLVTYRDTIDNQIHFALRKGTMGDQTPLVRVHLQDTFTDLLRSDRNAERSWTLDKAMKRIGQEGGVLVILGNEESPELLIHRVKMFEAQDKEEAPKLAKKQGTSRRVGVGSQILADLGVHDMRLLSSSNKKYHALGGFGLNVVEYVCE

SEQ ID NO: 6643 - protein, 95 aa, Triticum aestivum
MAWRASLSRNVKEIRFLFCQSSPASGPAREFVKKNYGDIKTRNPTLPVLIRECSGVQPQLWARYDMGVERCVRLDGLTEAQIDKKLEELAKAGVA

SEQ ID NO: 6644 - protein, 90 aa, Triticum aestivum
MAGAAKASWMVAMSVGAVEALKDQAGLCRWNYALRSIHRAAKARANVRGGVSQGAKQLPASAASVVERRRWEKAEEGLRTVMYLSCWGPN

SEQ ID NO: 6645 - protein, 129 aa, Glycine max
MELARPASSRRKLKDLLLQSDNRLCADCNAPDPKWASANIGVFICLKCCGVHRSLGTHISKVLSVTLDDWSEDEIDAMMEVGGNASANSIYEAYIPEGYTKPGPDAGHEQRSKFIRSKYELQEFLKPSL

SEQ ID NO: 6646 - protein, 323 aa, Staphylococcus aureus subsp. aureus NCTC 8325
MSKYSQDVLQLLYKNKPNYISGQSIAESLNISRTAVKKVIDQLKLEGCKIDSVNHKGHLLQQLPDIWYQGIIDQYTKSSALFDFSEVYDSIDSTQLAAKKSLVGNQSSFFILSDEQTKGRGRFNRHWSSSKGQGLWMSVVLRPNVAFSMISKFNLFIALGIRDAIQHFSQDEVKVKWPNDIFIDNGKVCGFLTEMVANNDGIEAIICGIGINLTQQLENFDESIRHRATSIQLHDKNKLDRYQFLEILLQEIEKRYNQFLTLPFSEIREEYTAASNIWNRTLLFTENDKQFKGQAIDLDYDGYLIVRDEAGESHRLISADIDF

SEQ ID NO: 6647 - protein, 428 aa, Mycobacterium sp. JLS
MDDVTMPQTPAERTWHAQGHQPRPRTFTQSSKLQDVLYEIRGPVHEHASRLEAEGHRILKLNIGNPAPFGFEAPDVIMRDIIQALPYAQGYSDSKGIMPARRAVFTRYELVDGFPRFDVDDVFLGNGASELIQMVLQALLDNGDQVLIPAPDYPLWTACTSLAGGTPVHYLCDETQGWNPDVADIESKITDRTKAIVVINPNNPTGAVYSRETLERIADLARKHQLLLLADEIYDKILYDDAKHISLASVAPDVLTLTFNGLSKAYRVAGYRSGWLVITGPKEHASSFIEGISLLANMRLCPNVPAQHAIQVALGGHQSIDDLVLPGGRLLEQRDVAWEKLNEIPGVSCVKPAGALYAFPRLDPEVYEIHDDELLVLDLLLQEKILVVQGTGFNWPTPDHLRIVTLPWARDLANAIERLGNFLVSYRQ

SEQ ID NO: 6648 - protein, 216 aa, Solanum chacoense
MFKSLASILIILLHLSPGNGTFEQLQLVFTWPTAFCHKVNCVRIPNNFTIHGLWPDNKSRRLNFCKSTKYIKSTDEGKKAYLEYRWPNLTTTEVESKKNQFFWEKEYIKHGTCCLPLYDQNAYFKLAVDLKDKFDLLNLLGKHGIRPGTTHLTSQKIANAIRTETRGIPNISCYDDFQGTSELLEIGICFDPNAIVKNCFRPKSCLPKGTTGVTFP

SEQ ID NO: 6649 - protein, 219 aa, Brassica napus
  misc_feature (132)..(132): Xaa can be any naturally occurring amino acid
  misc_feature (187)..(187): Xaa can be any naturally occurring amino acid
  unsure (1)..(219): unsure at all Xaa locations
MSAFTSKYADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGLDGLGERCKXKYYEAGARFAKWRAVLKIGENEPSEHSIHENAYGLAKYPVICQKNGLVPIVNPEXLRSRSHDIHKCAAVTERVLAACYKALSDHHVL

SEQ ID NO: 6650 - protein, 269 aa, Methanococcoides burtonii DSM 6242
MHLTEKRIGFIGTGKMGESLIRGILAAHSEITLNASDVYKPALERLNNELGINVSTDNTETIGDSDVVVLAVKPQILKDVLVAIKDSITADKLVISIAAGVSVTAIEDELNEGTRVVRVMPNIAATVAEAASAVCAGKNATEDDMEVALEMFQSIGSAITIPEKLMDAVTGLSGSGPAYIFPVIEALADGAVHEGLDRANAITLAAQTVLGAAKMVLETGMHPGELKDMVTSPAGTTIRGIHTLEESGIRAAFMNAVIESSKRSKELGK

SEQ ID NO: 6651 - protein, 91 aa, Prochlorococcus marinus subsp. marinus str. CCMP1375
MSISVTSPCSKSTIEDLGIKNWPIWTCDPSTFPWTYREKETCLILEGEITVTPNGGEPVKFGVGDLIVFPEGMSCTWEVHKAVKKHYRFGN

SEQ ID NO: 6652 - protein, 246 aa, Triticum aestivum
  misc_feature (226)..(226): Xaa can be any naturally occurring amino acid
  misc_feature (234)..(234): Xaa can be any naturally occurring amino acid
  misc_feature (240)..(240): Xaa can be any naturally occurring amino acid
  unsure (1)..(246): unsure at all Xaa locations
MEGAISSGPNPRIAVVTGGNKGIGFEVCRQLASHGVAVVLTARDEPRGAEAVEKLRALGLAQVIFHQLDVTDTSSIATLFVFLKTRFGKLDILVNNAAIGGVEYLQELHANEEKFAGMDFDQMLEWMVKNVREPVDSAKKGVQTNYYGTKHVTEAVLPLLQSSSEGRIVNVSSLFGLLRLISNEEVRQELNDIDNLTEERLDELLDRFLRDFEADALEARGWPWGXSAYKVARXAMNAYXRLLSKE

SEQ ID NO: 6653 - protein, 76 aa, Arabidopsis thaliana
MAVTSKLFWRTTAIHSRRRRRKTSKGYNDITFITSNGGRDNCMQVWPSIGKKKFETISYLPDLTDYELANESDYLI

SEQ ID NO: 6654 - protein, 402 aa, Rhodopirellula baltica SH 1
MSDNKGVVYLGAGKVDVQSIDDPKLELSYRGKTRQCHHGVILKVISTNICGSDQHMVRGRTTAPAGMVLGHEITGEVIEVGRDVEFIKKGDICSVPFNIACGRCRCCKEGDTGVCENVNPDRPGAAYGYVDMGGWIGGQSRYVMVPYADWNLLAFPDRDQALAKIRDLTMLSDIFPTGYHGAYTAGVTTGSTVYVAGAGPVGLACAHAAQLLGAAVVIVGDMVEERLAQARSFGCETVDLKTDASLPDMIEQILGSREVDCAVDCVGFEARGHGGDSGVEKPATVLNQVMEVTRVGGGVGIPGLYVTDDPGGVDEAARTGNLSLRIGLGWAKSLHFTTGQCPVMKYNRGLMMAILHDRCQIAKAVNATVISLDDAPQGYADFDQGAAKKFVLDPHGVLAAST

SEQ ID NO: 6655 - protein, 321 aa, Escherichia coli CFT073
MKDNTVPLKLIALLANGEFHSGEQLGETLGMSRAAINKHIQTLRDWGVDVFTVPGKGYSLPEPIQLLNAEKILSQLDDGSVAVLPVIDSTNQYLLDRIGELKSGDACVAEYQHAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLTPYLSRWEKLDNFINRPVKLIIGDKEIFGISRGIDKQGALLLEQDGIIKPWMGGEISLRSAEK

SEQ ID NO: 6656 - protein, 609 aa, Saccharomyces uvarum
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYLFWC

SEQ ID NO: 6657 - protein, 259 aa, Nocardia farcinica IFM 10152
MVAMTHNDTATIALITGANKGLGYETARALAARGCTVLVGARDPERGRAAAEKLAADGGDVRFVRLDVTDAATIAETAAYLEAEFGRLDILVNNAAITGGFDTGLLPSTTSIDIMRTVYETNVFGPVAVTNALLPLLRRAEAARIVNVSSEVGSVQLMNDQDGPMWPMVSITYPSSKTALTMITTMYAKELWDTPIKVNAANPGYCATDLNNNSGFRTPEQGAEPIVHLATLPADGPTGQLWGYRWGATDGVEYGPLPW

SEQ ID NO: 6658 - protein, 336 aa, Alkalilimnicola ehrlichei MLHE-1
MSGSEGRLAARGSAQAVLERLSAGDCWSGEALGRELGISRAAVWKAVATLRGLGVPVEAVAGKGYRLPGPVEVLDRQRIVAELRRAGVAPLPSVDVWLSTPSTNLCVLGSQAGTPRAAFAEVQTAGRGRQGRRWWSAFGEQVQFSLAWHYQALPAPVPGLSLAVGVELAETLSGLGARGLQLKWPNDLLCKEGRKLAGILIELEGQVLGPCRVVVGVGVNHGRGAGGAEADRPVASLAEAGLEGVARNRLAALLLSAVIRGCQRFGVTGLDDYREGWARWDALRDRPLSVVQAGATLRGWGAGISEDGALVLTLASGGQRVLHAGEVHIGAALADS

SEQ ID NO: 6659 - protein, 415 aa, Mesorhizobium loti MAFF303099
MLSQRMSLLSGPGTVAAQEPAELAQLAAAAGRQIIDLAAGEIIIETPLSVREGAIAAINAGTNRYTDAIGLTLLRKAVAEKLAAQTHVGWNLEDIVITAGAKQALLNAALAVLDPGDEVIIIRPSWPTFASQILLAGAKPVFVDSRPSTYIPNIGAVRDALTQRTKAIIVNSPNNPTGIIYDPTTLRAIGDLAIDHHLWIVSDECYSCFVFAGRHESIVTAHPGVRSRTILVNTFSKELAITGWRLGYLAGPPEIVAAAKKLQSDMTSNANVIAQHAVLHHLEVGDCSFERKMHQRLSKARHTGLRILAGLEGVTVPRADGTFFFYLDLKRLISELSAEGPVRSADDIARLLLDETDVATVAGGFFGDMNGLRLSFGVPQDLLELGLKRVVETLNSLKTRQPSKGRVTKAHDPEK

SEQ ID NO: 6660 - protein, 420 aa, Prochlorococcus marinus subsp. marinus str. CCMP1375
MAKRTYYDPLHQGITLDDKIPEEEMIIGLIDSSPFQRLRRIKQLGPASLTFHGAESSRFTHSLGVFHIARRALKKLLKLEPELIQFKGLLYASSLLHDIGHGPLSHTSEGMFGLNHEEWSFKVIKEHPEITNILNKLKSSLSLEVSNLFRREDTNHKLIKTLVSSQLDCDRLDYLMRDSHSSGTHYGQIDLERILSALTIAPDGDLAINPKGLLAVEHYLVVRNLMYRSIYNHRLNEVCNWLLEKIIELARQLGPKAIWADSYFSTWLWNPKKINIETFLANDDVRTIYHLSRWKDEAPQPLRGLCECFLNRKLPKAINIEDLKVEFQLEALSITKRLTEELGKDSNIYCGLRHNKIYGYEPYKKGLRLWDGENLKALEKESLLIERLISPSKNTWLIYPKEINSSLKKKLSKLRQTQKI

SEQ ID NO: 6661 - protein, 368 aa, Mesorhizobium loti MAFF303099
MEIVDLTAGEIWSELARMIRQGAIEAINKGVNRYTDPVGTTELREALARKVSLETRQIWKAEEIAVTCGAKQALFNAAMVLLDPGDEVIIPVPYWTTFPAQVLIAGGKPIFVDTRSNGYVPRIEDIEAAITERSRAIVINTPNNPTGSVYDTQTLTGIAQLAIARDLWIIFDECYADFVHGDEAHRPIVFLVPEVRSRTLIVNAFSKSLALTGWRIGYLAGPKEVIDAVKALQSHTTSNPNVVAQHAVLAHLQRSDGSYEAGLRAQLASARQVGLSMLSSLTQVPIPRAQGGFYFYLDISKLVWSARRENVTRAPDEIVSALLTDAGVGVVSGSVFGDPAGLRLSYGIPTDQLVSGLARLTRLLNSWN

SEQ ID NO: 6662 - protein, 140 aa, Glycine max
CCTCEAVEMVRTLAMIKPDGLSGKYTEAIKEVILDSGFHIVKETEVQLDAERASVFYAEHSQRSFFDSLVKYITSGPVLAMVLERPDAVAQWRTVIGPTDAKKANTSHPNSIRAMCGLDSEKNCVHGSDSPESADREISF

SEQ ID NO: 6663 - protein, 194 aa, Oryza sativa
  misc_feature (107)..(107): Xaa can be any naturally occurring amino acid
  misc_feature (134)..(134): Xaa can be any naturally occurring amino acid
  misc_feature (168)..(168): Xaa can be any naturally occurring amino acid
  unsure (1)..(194): unsure at all Xaa locations
MLVRNLNDVKYDNQSSVFLLRNKDFKYQYAPLYAERLTRMRKQVVDAAKKKWPQAAIKNLAELAPNEKCIIIGTLFKDMKNKPNILKELAESDDSVPIQPVLNRDAXYIDLETDQLLLEDELQRIVLIDAPNSXVNIIAANRLCTGMIIGLLGSENEKSEFEIEDYCXQRIDFQYAPSTKLPRQIKSSRNDYIV

SEQ ID NO: 6664 - protein, 275 aa, Escherichia coli CFT073
MANPTVIKLQDGNVMPQLGLGVWQASNEEVITAIQKALEVGYRSIDTAAAYKNEEGVGKALKNASVNREELFITTKLWNDDHKHPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIVENFDVWDFRLDKDELGEIAKLDQGKRLGPDPDQFGG

SEQ ID NO: 6665 - protein, 616 aa, Methanococcoides burtonii DSM 6242
MTKPLVVHDPVHKTIILSELEQLLIGTPQLQRLRGIQQLGLADVVFPGANHSRFEHSLGTMHTASLLGRSVGLDNEDIMKLRLAGLLHDVGHSAFSHAVESVLKRDPAIQPKMCENCFVDHEAFTKYIISEVIPEDNIIARYVRDELGYDPFEFFNEVSKIATGDLSIEKPYLSQLMSGDIDADRIDFLLRDSYHTGVSLGLIDIDQIMQSLCIVDNNVVLGSLGSGSFDEELTLAAAESMLIARSHHYTAIIHHPRTQAVRVMLLYALEMTLKQQKEQFGDEAVGTMVVDFFTTYNDADLLNFINAKGGEVARGLLQDIRNGQIYVPVARSNQKTLSPGTKMALSTIARSGKATRMFENELEKRLGNVLVDLSIATGVPKSARVMVGGCENFFYDESALANGLVRAISRQMSLTVFTHPDVAIASELSSAQLGMRDIVDDLSPKLLHFIREGQYLPIEGLILLLYAIHEMFEEVHDGFVSIPRIRNITWLYKKVAFFKEDIRLKYLFDYEFHTRYGFLYSNKVYEDIQLLVAMGIVDEDLRYFEKDGRFRQRYEYVLTDAGVQYAADLVDPYQRDYKIITSDLTMNKHSIPRDIVTMPLARFQSDRGKRTSGAKK

SEQ ID NO: 6666 - protein, 273 aa, Yersinia pseudotuberculosis IP 32953
MQHRNITFIGAGNMVRAIIAGLVAGGYPAKMISVCAPSAKNRDALATEFGVISSDDNIRESQKAEVVVLAVKPQLMADVCQQLQKQVDFSDKLVLSIAAGVQVARFYALLGNKLNLVRIMPNTPSLVGKGMSGLYAPEQVSAADRDFTTELMSAIGKVCWVDNEDGINSIIAAAGSSPAYFFLFMEAMQQETERLGFDSETARQLVQQAASGACALVEANPHVPLSALREQVTSKGGTTAEAIRVFNEQHLPEMVAHAMQAAITRAKEMEKLF

SEQ ID NO: 6667 - protein, 646 aa, Photobacterium sp. SKA34
MTGYFLQAFIYLVAAVIAVPLAKRLGLGSVLGYLIAGVIIGPVIGLVGSETTTIQHFAEFGVVMMLFVVGLELEPKMLWGMRHRLIGLGGLQVVITALTVMGIAHLFDITWSYALAIGLIFSLSSTAIVLQTFNEKGLSKTEGGKSAFSVLLFQDIAVIPMLALIPLLAVPELVAKSQAVVAKTVEHHDELSLVVGLPGWAYAIVIILAIAGVVVGGHYLSRPLFRFVASSGLREIFTATALMLVIGIAALMSLIGLSPALGTFLAGVVLANSEFRHELESNIEPFKGLLLGLFFITVGAGIDFHVLFDQFGTVIGLTIGVMLVKFIVLLILSFIFKVKGSDRWLFALSLAQAGEFGFVLLSYTVQNNVLPESMSQTLSLVVALSMFLTPGLFILYDRVILPRFCEAKNEREADEIDEQGKVIIAGIGRFGQIVNRLLASNGVQTVVLDHSVTQIDNMRQINIKSFFGDATRHDLLHTAGIEDAKLFIVAIDDKERATELVHYIKQTYPQVRVLARAYDRGHHYSLRCAGADYVISETYRSALALGTEALKNLGVHPFRAEQQKATFVETEARSKEKLYQTWLDSTEEDRFNTSYVELFNQLESTLSDVMKQERTDKHTKSERGWTPPPKVFHDEVEQDLVEKHDY

SEQ ID NO: 6668 - protein, 453 aa, Mycobacterium sp. JLS
MKTLHDKQDDHARLAAELADDGVQFAMAAWVDVTGRPKSKVVPIGHLPDMLAGSERYTPRGIGRLGEMNPAEDECVGLPDPDTMRILSWDPRIALFHADLVLGDAGEPFENCPRSALKGVIAKARDMGFAMNLGVETEFYLFRTSALPELTPRFASSVIEPTPAYDARAVIDSLEFFSEVSAHMEAAGYGLYSFDQEGGEGQYELDFSYTDVLSMCDRLTYMRLMLPALAQKVDATVSFMPRPETRSWGSGAHMNMSLVSTTTGDNVFVEPDGSWSKTAMSFAAGVLRHAPALSALTCPTVNSYKRLTPKLADGTVSWAPVWARYGTNNRSCMLRLPGNRPAIENRSVDMMANMYLASAFTLAAGLEGIELGLDPGEPVTDDASDWEASAGGAGERLPRTLLEAIDAFATDPLVATTFPAGFVRDYLAMKVDEWNGYHSVVTQWEVDRYLLDV

SEQ ID NO: 6669 - protein, 254 aa, Petunia x hybrida
MGRKFFVGGNWKCNGTAEEVKKILATLNAADVPSQDVVEVVVSPPYVFLPLVKNELRPDFHVAAQNCWVKKGGAFTGEVSAEMLVNLSIPWVILGHSERRALLGESNEFVGDKVAYALSQGLKVIACVGETLEERESGSTMDVVAAQTKAIADRVKDWTNVVVAYEPVWAIGTGKVASPAQAQEVHAELRKWLAANVSPEVAASTRIIYGGSVNGANCKELGGQPDVDGFLVGGASLKPEFIDIIKAAEVKRNA

SEQ ID NO: 6670 - protein, 636 aa, Methanothermobacter thermautotrophicus str. Delta H
MVSEMLEEIKRTIMQRLPERVQVAKVEFEGPEVVIYTKNPEIITENGNLIRDIAKDIRKRIIIRSDRSVLMDPEKAIRKIHEIVPEEAKITNISFDDVTCEVIIEARKPGLVIGKYGSTSREIVKNTGWAPKILRTPPISSEIIERIRRTLRKNSKERKKILQQLGNRIHQKPKYDNDWARLTAMGGFREVGRSCLYLQTPNSRVLLDCGVNVAGGDDKNSYPYLNVPEFTLDSLDAVIITHAHLDHSGFLPYLYHYGYDGPVYCTAPTRDLMTLLQLDHIDIAHREDEPLPFNVKHVKKSVKHTITLDYGEVTDIAPDIRLTLHNAGHILGSAMAHLHIGDGQHNMVYTGDFKYEQSRLLEAAANRFPRIETLVMESTYGGHEDVQPSRNRAEKELVKTIYSTLRRGGKILIPVFAVGRAQELMIVLEEYIRTGIIDEVPVYIDGMIWEANAIHTARPEYLSKDLRDQIFHMGHNPFISDIFHKVNGMDERREIVEGEPSIILSTSGMLTGGNSLEYFKWLCEDPDNSLVFVGYQAEGSLGRRIQKGWKEIPLKDEDDKMRVYNVRMNIKTIEGFSGHSDRRQLMEYVKRISPKPEKILLCHGDNYKTLDLASSIYRTYRIETKTPLNLETVRIQ

SEQ ID NO: 6671 - protein, 432 aa, Triticum aestivum
  misc_feature (214)..(214): Xaa can be any naturally occurring amino acid
  misc_feature (332)..(332): Xaa can be any naturally occurring amino acid
  misc_feature (340)..(340): Xaa can be any naturally occurring amino acid
  unsure (1)..(432): unsure at all Xaa locations
MGSLLSSLLGKPEPPPPMVLVPPLFDYPPIAARTRMAVPAYELMFGKLPLRSLFEDYFDNAGTISSRIMLKPLEDPHVDLVANVAAAGDKASGTEVKGDALFRWQKYLYDPHTFVDVQVSTSEPMLKLRSCAYFPEYRLGAFGTIPLLMGNRLSSEDYAVLGVRYGSENLSIGASFVPLPESAEVPYGAWLVGRKGSLCAGAQYKPLSGNTTRXEHPMPYTDPKNWNYAISDGVASTSPLSPSFNFSLELARNTQLIASFYQHLVVQRRIKNPFEDDQIVGITNYIDLGLELATGIDKSKPAESGTNSLFQLGASWPANQNFLLKGKLGPSXSSVALAFXSWWRPSFTFSVPAENDHSKGTTSYGFGIRVEDLRKPSYERADPNYVMMSTNKEHLAPAALREFGQRPMFQADVDSGNFDHLPPELRPMSKII

SEQ ID NO: 6672 - protein, 553 aa, Listeria monocytogenes
MKEKDWWKKSVVYQIYPKSFNDSNGDGVGDIQGIIEKLDYLKELGVDVIWLSPVYDSPQDDNGYDIRDYQKIYEEYGDMATFDQLLQGLHDRDMKLVMDLVVNHTSDEHKWFEESRKSKDNPYRDYYFWREENEINNWGSIFSGPAWELDEKTGEYYLHLFSKKQPDLNWENPKLRQDVYNMMKFWLDKGIDGFRMDVINFISKNTDFPDGPVPDGQIYGDAGNDFCNGPRIHEFLQEMNQEVTSKYDVMTVGEMPGASTTDAQIYTNPANNEVDMIFTFEHMNLDSDSDNKWDLKPIYLPDLKENMSEWQVALQENGWNSLYWNNHDQPRIVSRFGNDNRFRVRSAKMLATCLHMMKGTPYIYQGEEIGMTNVHFETLDDYRDIETLNMYKERKEQGHSHESIMQSIYTKGRDNARTPYQWDNSENAGFTTGTPWLKVNPRYTEINNEEALKNPDSIFYYYQNLIKLRKTTEIITTGNYRLLLPKDEAIFAYERYTENEKLVVLCNFTEEEQVISDETILNEIQKGSVLVNNVPNIIEGTLRPYEAIVYQIK

SEQ ID NO: 6673 - protein, 413 aa, Coccidioides immitis RS
MPFAAPRSLLSASIASRRIFKIPLGFVLQNTKAIPIPQAPKRFPPLTLPSAVPYRGLATQSTGPTDKMKALVYAGNGKVALEERPKPTLSSPTDAIVKLKYGTICGTDLHIIKGDVPTATPGRILGHEGVGIIEEVGSNVTGLSKGDTVLIACITACGSCSFCRKGMSSHCSHGGWILGNTIDGTQAEYVRIPCAMSSLYKLPPTVDLAEAVMLSDALPTGFECGTLNSKVRPGSSVAIVGAGPVGLAAMKTAQLYSPAKLVLVDLDDSRLQVGQKLGATHGVNPKGQDGIKRLLDLTPNGQGFDAVMEAVGIPATFQLCQEIVGPGGVIANIGVHGTKVDLHLEKLWSQNISITTRLVDATTIPELLTLFEAKTLNVSDFITHRYKFADCVKAYDTFKAAAQHQALKVSLEF

SEQ ID NO: 6674 - protein, 307 aa, Porphyra yezoensis
MAFITSGAAAVSGASLTARRAFTGAAVCPVPSGRTSPAAATWSMSAGGLRTFLVGGNWKCNLSKDAITSLCKELAAAPDLETDKVEVVLAPPTPYLDHTRSVLRQDFEVAAQNIWVGGPGAYTGETAAEMIKDVGCTWVILGHSERRNLLQIRESDDFIAQKTKTALSHGLKVMFCIGETLEEREEGRTLDVCVRQLHALAETIGADDWKDVVIAYEPVWAIGTGKIATPDQVEEVHEKIRHYLAGDVNDKVAQETRILYGGSVSPGNCNELAQLPDVDGFLVGGASLKASFLEVIESFKSDLAATV

SEQ ID NO: 6675 - protein, 83 aa, Coccidioides immitis RS
MSTKYAFSKGLKELRFLFCHSSAHGDATRTFLKRAYPTMKKHNPYTPILIREAADIEPRIFARYEFGREKQQSLLGTCSLGRQ

SEQ ID NO: 6676 - protein, 274 aa, Alkalilimnicola ehrlichei MLHE-1
MNNHRRHRPRKRFGQNFLHDPTLISRMVKAIRPRPGDPLVEIGPGEGALTLPLLRAAGRLTAVELDRDLVAPLQARARTAGELTVHQADALRFDFRQLAPAPPARLRVVGNLPYNISTPLLFHLLESADVIQDMHFTLQKEVVERLAAPPGSKTYGRLSVMVQYRCAVTNLFRLPPGAFRPPPKVDSAFVRLVPHAEPTVDVGDEQAFARLVTQAFSQRRKTLRNTLRPLMSADTIIGVGIDPRERAENLSLEQFAALSQAHTRTKRNASRDTP

SEQ ID NO: 6677 - protein, 282 aa, Chlamydomonas reinhardtii
MQLCKVQRASAARSSRASRSQRVEVVCASSAKFFVGGNWKCNGSVANVAKLVDELNAGTIPRGVDVVVAPPFIYIDYVMQHLDRDKYQLSAQNAWIGGNGAFTGEVSAEQLTDFGVPWVILGHSERRSLFGESNEVVAKKTSHALAAGLGVIACIGETLEQRNSGSVFKVLDAQMDALVDEVKDWTKVVLAYEPVWAIGTGVVASPEQAQEVHAYLRQYCAKKLGAAVADKLRIIYGGSVSDTNCKDLSKQEDIDGFLVGGASLKGAAFVTICNAAGPKAKP

SEQ ID NO: 6678 - protein, 327 aa, Photobacterium profundum SS9
MNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 6679 - protein, 255 aa, Euglena longa
MPRKFFVGGNWKRNGTRDTISKIVEEFNKGPSVADADVEVVIGVPFVYADFTQEKLRKDWKLSVQNCWIGKGGAFTGEVSAEMIKDAGIPWVILGHSERRHLPELKESDETVAIKVAYALANGLKVMACIGELLEEREKGQTQAVNERQLKAIAAKLKEEDWKNVVIAYEPVWAIGTGKVATPEQAQEVHEQVRAWVASNVSPSVAAEVRILYGGSVTAKNSVELAGKPDVDGFLVGGASLKPEFLDIVAAYKHK

SEQ ID NO: 6680 - protein, 251 aa, Treponema pallidum
MKLVLIRHGESEWNRLNLFTGWTDVPLTPRGESEAQEGGRVLQEAGFDFDLCYTSFLKRAIRTLNFVLQALDREWLPVHKSWKLNERHYGDLQGLNKTETAQKYGEQQVRVWRRSFDVAPPPLTVGDARCPHTQASYRGVCASGRTPVLPFTESLKDTVARVVPYFEEEIKPQMISGQRVLIVAHGNSLRALMKHIESLDETQIMEVNLPTGVPLVYEFEADFTLCGKRFLGNEADVAARAQAVADQGKSN

SEQ ID NO: 6681 - protein, 356 aa, Euglena longa
MGYYTVTTQVQENYVQSWYKGKLAPFVGGCLLATCLSLSFSGETAQQNYAVSAKPAVHAIPLTAMGVGTRSGVPQTAAQKRFPSRSSALQMAAAVWAPSAKMPRKFIVGGNWKCNGDRPSINALVQALNTGESAIGSGVEVVVAPPMLYGDYARGLLRPDFGVAFQNCWTGGNGAFTGEVSANMIKDAGFDWVILGHSERRSLPEIMETDATVATKTAYALKAGLKVILCIGETLDARQSGKTDEVNARQLAAVAEKVSDWSNIVIAYEPVWAIGTGVVATPEQAQETHAQIRKWLAENLSPQVAQQMRIMYGGSANAANADSLAKQPDVDGFLVGGASLKPEFLKIAESWKSKVE

SEQ ID NO: 6682 - protein, 362 aa, Oryza sativa (japonica cultivar-group)
MAHAAAATGALAPLHPLLRCTSRHLCASASPRAGLCLHHHRRRRRSSRRTKLAVRAMAPTLSSSSTAAAAPPGLKEGIAGLYDESSGVWESIWGEHMHHGFYDAGEAASMSDHRRAQIRMIEESLAFAAVPDDAEKKPKSVVDVGCGIGGSSRYLANKYGAQCYGITLSPVQAERGNALAAEQGLSDKVSFQVGDALEQPFPDGQFDLVWSMESGEHMPDKRQFVSELARVAAPGARIIIVTWCHRNLEPSEESLKPDELNLLKRICDAYYLPDWCSPSDYVKIAESLSLEDIRTADWSENVAPFWPAVIKSALTWKGLTSLLRSGWKTIRGAMVMPLMIEGYKKGLIKFTIITCRKPETTQ

SEQ ID NO: 6683 - protein, 244 aa, Serratia marcescens
MSKLIPVVMAGGTGSRLWPMSRESFPKQFLSIDDSGVSLLQQTLQRLSGLTGIEVAAPLVICNEEHRFLVAEQLRGIGQLATNIILEPVARNTAPAVALAAHLAAEKDEGSMLLVLAADHLITKVENFHAAIQTAMSFADNNQLVTFGIIPEHPETGYGYIKRGSHLSNDCFKVDSFVEKPRLEKAIEYLASGDYSWNSGMFMFKTAKFLQELQQFSPDIFSTTQQSVSKSQRDMNFIRVEQDI

SEQ ID NO: 6684 - protein, 632 aa, Kluyveromyces lactis NRRL Y-1140
MERLVFEDVQQQLRQSSTDLSRWKLFQSSKWSAEALMGMRPTDSEDSLSADMSLATDGDDESPLKKRQILSSRCVLLDFCDNENQSETLPDVIPLMGKELDLYLLASSMFDCKEYDRCAFFLKDTSHDGLEFLYLYSRYLLWDKKVTESTEDVMIKDPEIFSADLSESLQAAEYGNDAEGKCRSGISLSNRDVDVGNGEKINLPKLHHEITDFLEKNKSLSKLGTALLMYLLGIIQKKQGVPSGAMSYFLKSLKLYPYNWTCWCELLSCISRTDESILLLKYLNDNFSIVKENGIIHEHLMLRFFKLAVFKEFGGDFDKYIEELGEIMKVFPNFSFLRAQHALINYKYMDYANAEIVFDELVTMDPYRLDDLDTYSNVLYVLQKPYKLAYLAQYAANVDIYRPETCCIIANYFSSKQQHEKSILYFRRALMLDKSYTHAWILMGHEFIEMKNSHAAIECYRRASDVNPRDFQAWYGLGQAYEVLDKHSFALYYFQKACALKPLDKRMWFASASCYEKLDKTVQAIKCFQRSSQLSGEQDISILYRLAKLHEKNNDVSSCKHYMAKCVELDEVKKAQQIDEIGKAKLWLAKHEFKHRNYSDAYNYANGVIHGTSQEIEEARAILAECRKRIDI

SEQ ID NO: 6685 - protein, 94 aa, Zea mays
MSSQITDESLREAIKERLEAAHVEVTDMSGGCGQAFNSVIVSSQFQGLNSLKRHRLVNAALKEEIAIIHAWTAKCQTPEEYAKTKEAADAPAQA

SEQ ID NO: 6686 - protein, 468 aa, Roseovarius nubinhibens ISM
MIDAKGIEYLYLQFVSVTGKIMGKGIPADHWESVAKKGFQLVYGATVNLFTNRAGEYLGYGPEAAELIGIPEPETFMQLPWAPTIGRFYCTLFRNREEKENPGGYLTSDCRGNLRRMHDDFEKKHGRRLRIGTEPEMMWLKFDENGKPRDGYSKPYCYHIDQFESLRPVSMQVIRYARQMGLDMIQGDHEDAPGQLELNWMFDDVLRNADRLTTYRQICAQVARENGIFACFMTKPFMGVSASGCHHNMSLWRGGEDEFVKCGNDPDDLPGMAENYMYVRGGENTFMPDDDDPQMPGKEGLEAIGGVVHHLQALTAVGCSTVNSYRRLWDTGFWAPVFADWGFQNRTTGLRVSAPGRFEYRSVDSMVNPYLMGTTLLAAMDDGIDNQLDPGAPEERNIYAAIKAGKEVKKLPMSLGEALEFLKNSEVVRRGMPGEMYRLYDEYKQDEYARFMSTVTDWDKDTYMECLP

SEQ ID NO: 6687 - protein, 376 aa, Vibrio vulnificus CMCP6
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHAQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 6688 - protein, 180 aa, Oryza sativa
FAYRPNPNDPTIVPHQAHKSQPSLGDRTAWIQSNETLPQPLSAASLAVGRIAPPRIPPHRPTAKQRRREEEEEEAAAAAAMAWRANLSRGVKEIRFLFCQSSPASAPAREFVKKNYGDIKARNPSLPVLIRECSGVEPQLWARYGTRSFFFSSLLHGIRDPLSRFLNFLFLYLLRREMLG

SEQ ID NO: 6689 - protein, 278 aa, Lactobacillus plantarum WCFS1
MQSKLAVIIGGTSGVGKHTAIDLANQNYHVIIVGSRADKGRQAQADISQATGNQAVQLALADLSTKTGVQQFAHQLAAMTDHIDILLNSIGVILPERHLSADGYDLNLVLNYLTHFWTIQALLPLLKHSDQARILLVGALPFVINHAKVSLPDFDAPATSKYNAMTVTAQATAARVLLTLALSERLTATNVTINIFHPGYVPDSNFGAGGSWVSRLAGRILGESFSRKNSPIGAWLATAPELTHTSGHFYDDRLRQVRLSKQYTRSKANDLWRLSSQY

SEQ ID NO: 6690 - protein, 323 aa, Sporidiobolus salmonicolor
MVGTTTLNTGASLELVGYGTWQAAPGEVGQGVKVAIETGYRHLDLAKVYSNQPEVGAAIKEAGVKREDLFITSKLWNNSHRPEQVEPALDDTLKELGLEYLDLYLIHWPVAFPPEGDITQNLFPKANDKEVKLDLEVSLVDTWKAMVKLLDTGKVKAIGVSNFDAKMVDAIIEATGVTPSVNQIERHPLLLQPELIAHHKAKNIHITAYSPLGNNTVGAPLLVQHPEIKRIAEKNGCTPAQVLIAWAIVGGHSVIPKSVTPSRIGENFKQVSLSQEDVDAVSKLGEGSGRRRYNIPCTYSPKWDINVFGEEDEKSCKNAVKIK

SEQ ID NO: 6691 - protein, 411 aa, Magnaporthe grisea 70-15
MSTSGKKATATALAQKYAPQIANKTVLVTGVSPNSLGATFVTAIAVASPALLILAGRNAAKVEETTKAIQAAAPHVPVRFLNLDLADRESVRKAAGEVLSWQDVPGIDVLVNNACLIGSEYKLIDGFEAHFVVNYLHPFLFTNLLLPKVIAVKGRVVNVASDCHRWHHIRFSDLNFDVSVSWKISQRSAARLQPRQNGKIYNMWQAYGQSKTANMLFSLALARRLGGRGIVTNSVHPGIIQTNAASHLDPAEILRLIAAEEVERQCGLANQAFLSYKTVDEGTATHVYAAFEPGLKDHNGAYLLDSHVADPVEDPVAPWGTSEADAEKLWRLITRRIPPSKSHIKGGKSKHLEANYYDQRLAPLLKRPDRSHPPDDFCREIPPAAPKQDKKIVYINTHNAKRINLVNLNEA

SEQ ID NO: 6692 - protein, 253 aa, Staphylococcus aureus subsp. aureus NCTC 8325
MRTPIIAGNWKMNKTVQEAKDFVNTLPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 6693 - protein, 317 aa, Glycine max
MRVGTSFLALLSLLPLLLSLQFSSAQLPADTDNISSRTLDAILQDCAFKAFLRPKTGVPYDGKVPRSLNGIRVSAMRLRSGSLRTRGVESYKEFQIPIGVFEQPYVERLVFVYHNLGNWSEKFYPLPGYIYLAPVLGLMSYSGANLSDSELPELDIRASDKPILIKFPHVESAPLGSVPTCVYFDLHGSVQFDILLHGNVCSTFQQGHFSIVVESNAPSPAPAAVAVAADVGRSGSGRNNSMVWIIVASLVGGCFLLIMLSLLVAKVRRTRQGMKIQQLEWAAESNETLQIASIGGTKAPLAIGTRTRPTIENDYIP

SEQ ID NO: 6694 - protein, 386 aa, Bacillus subtilis subsp. subtilis str. 168
MTSYLSDYVQQIKPSGIRKFFDLAATMEGVISLGVGEPDFVTAWNVREASILSLEQGYTSYTANAGLYSLREEISRYLSNRFDLSYSPDNELIVTVGASQALDIAIRAIVNPGEEVIIPEPCFVAYDALVSLAGGIPVHVHTTADKGFKATAADFEAAVTEKTKAILICSPSNPTGSVYSKEELNEIAEFAKKHDVIVLADEIYAELTYDEEFTSIAALPGMKERTVVISGFSKAFAMTGWRLGFAAAPSLLRDAMLKIHQYAMMCAPAMAQFAALEGLKNGMEDVEKMKKSYRRRRNLFVESLNEIGLSCHHPGGAFYAFPSIKSMGMSSEQFAEELLTQEKVAVVPGSVFGPSGEGYIRCSYATSIEQLQEALVRMKRFLHKTT

SEQ ID NO: 6695 - protein, 294 aa, Oryza sativa (japonica cultivar-group)
MAAQASSKRGMLLPREAVLYDDEPSMPLEILGYHGNGVGGGGCVDADYYYSWSGSSSSSSSSVLSFDQAAVGGSGGGCARQLAFHPGGDDDDCAMWMDAAAGAMVENTSVVAGGGNNYCHRLQFHGGAAGFGLASPGSSVVDNGLEIHESNVSKPPPPAAKKRACPSGEARAAGKKQCRKGSKPNKAASASSPSPSPSPSPSPNKEQPQSAAAKVRRERISERLKVLQDLVPNGTKVDLVTMLEKAINYVKFLQLQVKVLATDEFWPAQGGKAPELSQVKDALDAILSSQHPNK

SEQ ID NO: 6696 - protein, 508 aa, Glycine max
MGDFNLALVIVAIVVCVIVFLFNVYLLVNFQHPDDVNQAYFPKFVVVLGLSVAAISILMLPADVANRQACRHAIYNGACSLTLPMKDLWLAIYILDAVLVFFVIPFAMFYYEGDQDKSVGKRIKSALLWMVTTAIVCALVLGILYGLIGKVDFTVRHLSSSTSQFPSTWDFNSGQQCIGSTHQCSAFTASPSSEKTWTMRTTFPEYVVALATIVGSVLFAIFGGVGIACLPLGLIFSFIRRPKAVITRSQYIKEATELGKKAKELKKAAESLHQEERSGSKGRKFRKNVKSVEKELFQLEEDVKLLEEMYPQGEKAETTWALTVLGYLAKFVLGILGLIVSVAWVAHIIIYLLIDPPLSPFLNEVFIKLDDIWGLLGTAAFAFFCFYLLLAVIAGAMMLGLRLVFITIHPMKWGATLMNSFLFNVGLILLCSISVIQFCSTAFAYYAQATAAQEIFGHTLESLRGIKYLYKYNVFQIAFVALAGLTFVYYAAFGWRRKKPSGRFQLSS

SEQ ID NO: 6697 - protein, 548 aa, Listeria monocytogenes str. 4b H7858
MTKFAQKTIYQVYPKSFYDTTGDGTGDIPGITAKLDYLQKLGIEMIWLNPFYPSPQNDNGYDIADYTAVDPLFGTMDDVTTLIKEAKKRNIGIMIDLVLNHTSTEHPWFKKALAGDPFYRDFYYFRPAKADGSPPTNWVSKFGGNAWEKLPDSSEYYLHLYDVTQADLDWANPNVREALFDVVNFWIDKGVEGFRLDVLNVIAKPKFLEDDFEGDGRRFYTDGPGIHAYLKELHERTFGDKPIITVGEMSSTDIDNCIRYSNPDEKELSMVFHFHHLKVDYPDGEKWRLADVNFENLKSIFHTWQVAMSEENGWDALFWNNHDQPRALGRFASDKPEHYYHSATLLGATIHFMRGTPFVYMGEEIGMMNPKFPTIDDYVDVETLNHFDILQKNGLSEQEVMAIIKERSRDNSRTPMQWDDSQNAGFTTGTPWLKVADNASEINVQAALSNKTSIFYFYQKLIALRKEYPVIQTGDYTPYWTDEDLIIAYKRSNEITSLLSIHHFGSTTKKIQLPNEFLNAKVLLSNYERQTISSELELAPYETLTLIR

SEQ ID NO: 6698 - protein, 146 aa, Medicago sativa
MASDSFTDKNAVFRKLKTKSENKSCFDCNAKNPTWASVTYGIFLCIDCSAVHRSLGVHISFVRSTNLDSWSPEQLKMMSFGGNSRAQVFFRQHGWNGDGKVEAKYTSRAAELYKQLLSKEVAKSMSEEAALSAPPAASSQSAQGAN

SEQ ID NO: 6699 - protein, 331 aa, Coccidioides immitis RS
MSRYAEVHKQPAGPGDARPTALQVIEDEGLEGNMKDKVFLITGCSSGIGIETARAIAATGARVFLAVRDLTRGRTACESFLEPGRVELLQLDTSSLSSVKAAASNFLEKSQTLNVLICNAGIMMIPTYEESADGFEIQLATNYLGHFLLFWLLKEAMLKASTPDFNSRLVNVSSSGHHASEVQFEDINFHRGGAYAPSKAYGQSKLAQIYMANYVDRHYGPAGLHALSLMPGGIFTNLQKHVPQEIKDGWTSNPEIMMVLKSHEQGAATTVVAAVAKEWEGRGGKYLEDCEASSPEALVQGFRGFKEYAFDEGKEERLWELTLDMLGLAEA

SEQ ID NO: 6700 - protein, 396 aa, Fusobacterium nucleatum subsp. nucleatum ATCC 25586
MRISDRVKNMKYSAVRKLAPLAAEAEKKGIKVYRLNIGQPNIETPKLFFEGLKNIPDHVIRYADSRGISILLEQVIEVYARDGHILKKEDIIVTEGGSEALTFAMLAICNPNDEVLIPEPFYSNYKSFLDIAGAKIIPIPTDIKNDFALPKKEEIQKLITSKTKAILYSNPCNPTGKVYTEEEVKLLANLAAENDLFVIADEPYREFIYDDNDKHYSLLDIEKAKENVIIIDSVSKHYSACGARVGFLISKNKDFMTYIMKLCQARLAAPTVEQYAVASLMKAPKEYFKEIKEIYKRRRDIIVNSLNKIEGVTCSTPKGAIYAFAKLPVESSEDFCKWLLTEFVYDNSTVMLAPGEGFYETEGLGKNEVRFSFCVGENDIEKAMRVLEEALKVYKK

SEQ ID NO: 6701 - protein, 136 aa, Zea mays
  misc_feature (26)..(26): Xaa can be any naturally occurring amino acid
  misc_feature (45)..(45): Xaa can be any naturally occurring amino acid
  misc_feature (49)..(49): Xaa can be any naturally occurring amino acid
  misc_feature (52)..(52): Xaa can be any naturally occurring amino acid
  unsure (1)..(136): unsure at all Xaa locations
MINLRRPEGLIGEIISLLRKGFYLKXLNLSRGESFAENTTPVAAXPFFXGLXDYIISGPVVAMVWEGKSVVTTGRKIIGATNPLASEPGTIRGDFAVDIGGGVFHGSDCFLSANKGIVLWFFRGPCCLSGGRHLFF

SEQ ID NO: 6702 - protein, 504 aa, Streptomyces avermitilis MA-4680
MAQSTRTVIPKGFRSAELGWPELHRIPHPPHRLPVVGDVLGVNVRTPVQDSLRIGRRLGPVFRRKAFGKEIVFVGGADLAAELADESRFAKHVGLGVANLRPVAGDGLFTAYNHEPNWQLGHDVLAPGFSREAMAGYHPMMLAVTERLIDHWDREQTAGRAVDVPGDMTKLTLETIARTGFGHDFGSFERARPHPFVTAMVGTLTYAQRRNVVPEPLAPLLLRTATRRNAADLAYLNRTVDALVRARRTTSGEGDLLDRMLDTARPGTGERLAPENIRRQVITFLVAGHETTSGALSFALHYLSRHPDVAARARAEVDRVWGGTARPGYDQVAKLRYVRRVLDESLRLWPTAPAFAREARRDTVLGGVHPMREGAWALVLTAMLHRDPGVWGADAERFDPDRFDAQAVRSRAAHTFKPFGTGARACIGRQFALHEATLVLGLLLRRYELRAEPGYRLRVAERLTLMPEGLRLRLDRRVPAVEDVPVANPEVSSGPRCPVTGAGE

SEQ ID NO: 6703 - protein, 551 aa, Azoarcus sp. EbN1
MTVSPAGSPCRRGRRAAASGHFSVRGITLSCSRPKWQTGFYRILARAGQCLYPTPACAHAGSYRISTDPAMKLHPVILSGGSGTRLWPLSREQYPKQLLALIGDDTMLQQTALRLAGFSGGLPVSDQPLVVCNEEYRFITAEQMRAAGCPTNHILLEPVGRNTAPALTLAALTVRRDSDDGVLLVMPADHVIRDREAFHRAIDIGIEAALAGAMVTFGIVPERAETGYGYIRVGAEASPGIHAVASFVEKPDAGTAAEYVASGAYLWNSGLFMVKAGVWLKALGHFNPEMLAACESALETAGRDADFVRVGCEAFQACPSDSIDYAVMEKLAATPELGIAPQVVPMSVGWSDVGAWDALWTLADKDDDGNSGRGDVMFEGTTGSLVHATSRMVVCLGVEELVIVETPDAVMVARKDQTQDVKKIVARLKSDSRPQALAHRKIHRPWGCYDSIDTGGRFQVKHIEVKPGASLSLQMHHHRAEHWIVVRGTARVTRGDETFLLSENQSTYIPLGVTHRLENPGKMLLEMIEVQSGSYLGEDDIVRFEDTYGRS

SEQ ID NO: 6704 - protein, 209 aa, Bacillus anthracis str. 'Ames Ancestor'
MKRVGKEFFLQHDIVIMYSILFVFIIILKMQFFTWIGLLSCLFGIIFYTLNEYMTHRFLFHLKPPKNVFLLKMLRRLHYDHHVYPDDLKLLFLPVWFSIPSFTIYLLISYAITKSVTITLSFGIGMIIMLLVYEWKHYIAHKPIRPVTKFGRWLKKQHILHHYKNEKFWFGVSNPVFDFIFGTLKDGKDVELSETARNLEKEKKTKVVR

SEQ ID NO: 6705 - protein, 256 aa, Zea mays
TSLTCSIFLKAASDVYHLYWFLTPLSCSFCSVIWWPLGKHDKLISIDDRNIFLWNVDMSNKSAKVISQGSADMLPNLSGGAWDPHNHNSIASISDSSLHLWDLRSMEKSSAIEHAHIRDVDYNPKKQHIIATTEDDFGICLWDLRMLKLPLKDLPGHSHWTWAIQHNPEYDELLLSAGTDSTVNLWLAKVSNNDSEPNSPSGSPNRQEEPLLNSYTDYEDSIYGIAWSSHDPSLFASLSYDGRVVLESVKPYLQRK

SEQ ID NO: 6706 - protein, 602 aa, Pseudomonas fluorescens PfO-1
MPHEGNLLQAAVVFLLAAVLTVPLAKRLQLGAVLGYLFAGVIIGPSVLGLIGNPQSVSHISELGVVLLLFIIGLELSPRRLWVMRKSVFGVGLAQVLLTGSVIGVLALSVFGQPLNSAIVLGLGLALSSTAFGLQSLAERKELTSPHGRLAFAILLFQDIAAIPLIALVPMLAGVDHHTSTADDIRHSLQVLGSIAVVVIGGRYLLRPVFRVVAKTGLPEVSTATALLVVIGTAWLMDMVGVSMALGAFLAGLLLADSEYRHELEAQIEPFKGLLLGLFFISVGMGANLSLLLSAPITVLGLTLLLIALKLPLLFVVGRLAGGLNKVSAIRLGIVLAAGGEFAFVVFKIGRDQGLFEPRLYDLLVLTITLSMAVTPLLLLVCARLVSPKVQPVEVPEKFRQIETESPRVVIAGMGRMGQIVARILRAQNIKFVALDTSVETIELSRSFGGVPVFYGDPMRPEILSAAKVGEAEYFVIATDDPETNIKTAEIVRKLYPDMKIIARARNRQHVHRLVDVGADPIRETYYSSLEMSRRTLVGLGLTQAQADARIKRFKHHDEQVLEAQHAVYDDAAKVLQTAQEARAELARLFESDQLEEQSGKS

SEQ ID NO: 6707 - protein, 102 aa, Oryza sativa
MGGKLQHLMERLHLAGKGGGGGAARDVPRGHFAVYVGEARARFVVPTAYLRQPAFVALLKSVEEEYGFDHCGGGGLTIPCSERDFSALLGRLASSPPPPSWR

SEQ ID NO: 6708 - protein, 540 aa, Prochlorococcus marinus subsp. marinus str. CCMP1375
MPNKSSATSMRSGHIAPVVLTILDGWGHREENINNAINNADTPVMDALWQAYPHTLIEASGADVGLPDNQMGNSEVGHLTIGAGRIIQQELVRISNTIRSKKLDQITNLSNLANKLIETDKTLHLVGLCSDGGVHSHINHLCGLLEWAKNKGIQKVAVHAFTDGRDTPAKSSLQYLKIIKEKFEVLGIGELATLCGRYWSMDRDNRWERIEKAYELLTNPNYPLSELSSDEIITNSYDSSITDEFLEPIRLTPSYLKDGDGLIMFNFRPDRARQLIKSITLPSFSEFKRKYQPQLNVVTLTQYEMDLPVSVVFPPESLDNLLGQVISEHGLLQYRTAETEKYPHVTYFFNGGIEQPLPGEKRHLVPSPRVATYDLSPEMSAEKLTKSCQEAIESGIYSLIVINYANPDMVGHTGIHAATKKAISTVDKCIGKILDSTGKMSGTLLITADHGNAELMKGPDGEPWTAHTTNPVPVILIEGEKRKISGQGNQIRLREGGGLADIAPTLLEVLSLPKPDAMTGSSLIETIQTNSKTNLVQQHV

SEQ ID NO: 6709 - protein, 1814 aa, Ustilago maydis 521
MNTKSNASFGLPPVALNTASPSQTTNPTTSDRPTLITSQFPGQALYLTHPQRLSLLSIKIDATTSITTTRAAVLAQQQLSPSLPPPSPPPPPPSAVYRHASTSKLHSHQPPPSSFHTNASHKSSRSRPLSHDFTQKARDALNDFGRLANRRQSAIERANGAETLARVADGLGSKRASSHDDRARPTSSHPLILQQDSNHQPPSFAPPKLPLDPTSQQHLTSQDAQVVRSHATRSFTLLPQSDLRFLSHSIPLSIHASITTSSDPSTIIPSPLEFTTASHNGSSPYSTSALDPSQLLLKVEPPAELARQSWSRSTSFLTPQNASQYHTSEHHSVKFRYRLRLCAKTASPTSYLFPHTERNDAPPPSTPLALALGQVLFLSAASPEKLIEAIESPSSSIASSELAALEGISRVQLTPSSYPLSSTVTRGASEFDFEWTWKSLARSSSSNASRCCCAFVEISPDGKSATLLAAISLFIQLPPSVPLLSNMLSSTQADTIPHQRLSSSDSLAIIAALNLDQEPSLRTDTAPALSSFHQDSHPTSFIAPSSTQHGSTRLLIDRTELALEDLVNDSPIFRAALVNLERRTASIKKASKAVLRASQEARLRIFRLIEAEQAVDTALQALVGMAPETIGRLQDQLLRQARIATMQHQREQASVIESCLERPLAQIVELCRLAQDGFKLFENESKTYYSQTQKWLANRSSNADPSNTPAIGNDAHRQDRADQKQKLRELRFEQARLDLFAMLQRLHGGRAEAHLARSILQLTQWLVDFPNKPHWPSHTQTSSLSALDASLLDALDHQALQLQEVESRSRQVADRARMLEHALGKIGDADIDILGAHRFEIDQTSPAPSNFNGAVSSKTRKFKSFLGVFAAGIQSSPLTLSKNASPNTESAVKQVELVAPVDGAQLPYQHPRRRHSMKEKFNHVRQPDVGNTSPFKSHAPSSWVYNNLPAAPRRGSELHESSRLRDDAASDQLSLHASQDASEGASSMAGAHELSRTSTAEQGLGIFEPASANTVQEYGLSPAPGQCSGPIAPSLTTGSDRKKEGVLWVSTKSVTGPVGADAPRGINRSNHWRECWVVLSGSGQISEFADWKNAKALEPTNPLIDLRFATVREARGVDRRFAFEIVTRDSRRLFQAPDEEAMRDWMRAISKAIESLLNGTSSVRKLDRAVRASPFRSSDSVQQRPADFDEDEEVPGVGEGNDFAVRKLLDRTTRSSTQSMNDLAASAKAQDSDRKDRAKLGAHLAGLSESHAESSVQSSRRRSQHQRGISNKTPISGYLGAGKLGLTASDVAALHRRDGTQLSDDASISSKSTSGEQDAEFDRQIEAVVHKSYGSRDDTGTSHSGFSFNSAVSGVDEMGKFKANASARATSSSSPSKATSAANASVTSTATSTKMSRSAEIAAISRRPENRHCADCQESDPRWASWMLANQPCCIFICIRCSGVHRSLGVHISKVKSVDLDDWTEEQLQAARDWGNVRANALWEHSKPAGLLPLPSDRKEFWRRKYTDQEWKDPNPKILRDARPCYNSITDAPDNNHDATPTRRSALITEASPDVVTPQSKSQSHAQELGLRIMPSDQTASSNGSAKFPDVPGSPRPNGPRPLPQQRSVTMQASAISSLSSPTAGKLAGVKPNLTSPDSPNKQDRADWTARQTSFASDDEALTGLVASMMTEYASLRQDFPKESYPSCAPSIPTSTSAPPMSSLTSTNPHVSKAMLAARADRRLFPCLASTEAVETLPSNNAKVQVSSPPSTFFVSDMGAHTSSRMLFDGPGRGEAAWDATSEIGTDHHEGRSTESLPAITNPPARFDAFASHA

SEQ ID NO: 6710 - protein, 199 aa, Medicago sativa
YSHNLEFSEEKIELTFATNYLGHFLLTKMLLEKMIDTANKTGIQGRIINISSVIHSWVKRSCFCFKDMLTGKNYNGTRAYAQSKLAMILRVKEMARQLKARNARVTINAVHPGIVKTGIIRAHKGLITDSLFFIASKLLKTISQSASTTCYVALSQKIEGVSGKFFTDCNESSCSRLANDESEAKKLWNNTNNLLHKPT

SEQ ID NO: 6711 - protein, 244 aa, Zea mays
  misc_feature (228)..(228): Xaa can be any naturally occurring amino acid
  unsure (1)..(244): unsure at all Xaa locations
MSAMQSSYLPATTESIAMAQEAKDASESILILYRVLEDPSSSSDAVRTKEVAITNLTNYLTKENRAQELRNLLTQLRPFFALIPKAKTAKIVRGIIDAVSKIPGTSDLQISLCKEMVEWTRAEKRTFLRQRVEARLAALLLESQEYTEALTLLSGLIKEVRRLDDKLLLVDIDLLESKLHFSLRNLPKAKASLTAARTAANAIYVPPAQQGTIDLQSGILHAEEKDYXTAYSYFFEALKGYALG

SEQ ID NO: 6712 - protein, 183 aa, Hevea brasiliensis
MASSMLSTAAVACINRASPAQASMVAPFTGLKSTSAFPTTRKTTTDITSIASNGGRVQCMQVWPPRGKKFYETLSYLPPLTREQLAKEVEYLLRKGWVPCLEFELEHGTVYREYHRSPGYYDGRYWTMWKLPMFGCTDAVQVLQELDEMIKAYPDCYGRIIGFDNVRQVQCISFLAYKPKGAE

SEQ ID NO: 6713 - protein, 514 aa, Ashbya gossypii ATCC 10895
MRVRKRTLKRTSTRLREGIQRKKAAAQHRKERKQAKKDVTWKSRAKKDPGIPASFPYKHKILEAMEEKKREDQEERERRRQERQEAKRLARERGEEVMDDEDSDEEMEEGNGLSALVESAQLAAKEYDGAVGGDAEEDVEVQDLDVDFYADAGEAESELEKSRKAYDKIFKTVVDAADVVLYVLDARDPEGTRSRKVEEAVLQAQGKRLLLIINKVDLVPPHVLEQWMTFLKSSFPTIPFRAAPGATNAASFNKKLTLSATASGLLECLKTYAHQSNLKRSIVVGVIGYPNVGKSSIINALTSRRGGSFKACPVGNMPGVTTSLREVKIDNKLKILDSPGICFPSESTKKTKSEQEAELALLNALPPKYIIDPYPAVLKLIKRLSQNEEMTASFKKFYELPAIPAPDAESFTKQFLIHVARKRGRLSKGGIPNLTSAGVSVLNDWRDGKIMGWVLPNSSKAASAKATQPGASSETGPAGVRSSTEQTTIVEEWSKEFDLDSLFASLDNAIQTAN

SEQ ID NO: 6714 - protein, 231 aa, Sinorhizobium meliloti
MDARQMKIKAAEAALEHVESGMRLGIGTGSTAEEFVRLLAEKVASGFQISGVPTSERTARLCLELGVPLKSLDELPELDLTIDGADEVDGKLRLIKGGGGALLREKIVASASTRMIVIADESKVVDVLGAFKLPIEINPFGQVATRLAIEKTASRLGLAGEIVVRSSGDGVFMTDGGHLILDASFGRIPDADALAVELNAIPGVVEHGLFIDVASMAIIAGPEGARTLTAS

SEQ ID NO: 6715 - protein, 399 aa, Glycine max
MASASASLLKSSLVLDKSEWVKGQTLRQPSAASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 6716 - protein, 966 aa, Prochlorococcus marinus str. MIT 9211
MIRQFSDCEEFCDRHIGIDACAQESMLAALGFTDLEDFVASVIPNQILNQNSSSNLLSKGSNELQALEQLNEIARKNIVNRSLIGLGYFGTLMPPAIKRNILENPAWYSSYTPYQAEISQGRLEALFNFQTLISELTGLPISNASLLDEATAAAEAMSLSLLVHKASHARKFFVDQAVFPQTIEVLRTRAEPLNIVLEQIDPRNCEIDEKVFGLLIQLPGSDGRLWDPSLAIEKAHRVGALATVAIDPLAQVLLKPVGELGADIAIGSSQRFGVPMGFGGPHAAFFATKETFKRQVPGRLVGQSVDQDGQIALRLALQTREQHIRRDKATSNICTAQVLLAIIASFYAIYHGPEGLEAIAKRIACFRKRLEDVLRILGYPLEPISGFDTISVNCEEATEIHKLAALKGFNFRILPLGASIEKATGFAISLDELSNEEEINSLSEIFAKVKGEVYKTPSTCDLNIEDCLSELPLRQTPWLNQKVFHSFRSETELIRYIQLLASKDFSLVHGMIPLGSCTMKLNATAELIPVSWKEFSSIHPLAPIEQSQGYEQLIKELESWLSELTGFNGASLQPNAGSQGEYAGLLVIREWHKSRGHQNRNVCLIPTSAHGTNPASAVMSGFRVVSIICDEQGNIDLRDLVQKVEVHSSELAALMITYPSTHGVFEPKIREICELVHDHGGQVYLDGANLNAQVGLCKPGEYGADVCHLNLHKTFCIPHGGGGPGVGPIAVAKHLLPYLPGHPFRKCGGVNSIGAVSAAPFGSASILPISWMYIRMMGLNGLRKASSVAILSANYLASRLDPYYPILFRGPNGNVAHECILDLRPIKTKTGIEVDDIAKRLMDYGFHAPTVSWPVAGTLMVEPTESESLAELDRFCDAMISIRKEIEAIESGDSDLNNNVLRLSPHTLQTVTSEDWDRPYSRQQAAFPLKGQIKNKFWPAVSRIDNAFGDRNLVCSCPSMEDFAEN

SEQ ID NO: 6717 - protein, 425 aa, Clostridium perfringens SM101
MDRNKEIFEESKKYMPGGVNSPVRSFGSVGINPPVIKSGKGAMIKDENGNEYIDFVLAWGPMILGHCDEDVVEAIKKTSEESIAFGASTKLELDLAKILCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYEALLIFDEVMCGFRVAYKGAQTLFDVKPDLVTYAKIMGGGLPCGAYGGRREIMENLSPLGGVYQAGTMSGNPIVMSAGLATVKKLYENPSYYDHIEKIGSKLEKGIIEIAKKKGLGLVVNRQGGMMTLFFTDLKEVKCYDDVKTCDGERFKRYFLHMLNKGFNIPPSQFEAMFLSVKHTEEHIDKFLEAFESFEG

SEQ ID NO: 6718 - protein, 333 aa, Alkalilimnicola ehrlichei MLHE-1
MDQSRMTLGRFLAQQCPQDEKGKALALLLRQVGDSCRRIADAVAGGALREMTGAADNVNVQGEEQKKLDVFANDVLIEGCNWGGTVAGMASEEEDDIYTLPEGEPRGPWLLLFDPLDGSSNIDVNVSVGTIFSVLPAPDTGRDPVNEDLLQPGHRQVAAGYAVYGPSTVLVLTLGDGVYAFTLDRGQGEWFLTSSKMKVPEQTAEFAINCSYQRIWPAPIKRYIEECLDGEEGPRGKRFNMRWIASMVADLHRIFTRGGVFLYPADEKRPNGRLRVLYEINPMSMLMEQAGGEAFTGKERALDLQPEALHQRSGLMLGSREEVEVLRRYYAEQ

SEQ ID NO: 6719 - protein, 275 aa, Prochlorococcus marinus subsp. marinus str. CCMP1375
MACSLGVIGLGRMAQVILQSLFEAGQFNPEEVFGVVGKKNSVERVLHQFKSPFTVVDVNDKNAIDVWNTPVKILAVKPQQLNQVQEKCSKEFLAKLPAKPLLISILAGVKLKRLQSLFPDHVCVRAVPNTPALVSAGLTGLSWGEEVTEDQKSLVESIFKPISQVFELPEDQLDAFLALTSSGPAYLALISEALADGAVAAGLPRALAQSLTNFTLEGTAILLKKKELHPGQLKDMVASPAGTTISALRHLEKEGVRSALIEAVILAAKKSREMA

SEQ ID NO: 6720 - protein, 401 aa, Zea mays
  misc_feature (175)..(175): Xaa can be any naturally occurring amino acid
  misc_feature (206)..(206): Xaa can be any naturally occurring amino acid
  unsure (1)..(401): unsure at all Xaa locations
SHSRTPSSISFQSIHPRFLRPAASQPHGQIKIGINGFGRIGRLVARVALQSDDVELVAVNDPFISTDYMAICLFLRESYVNVVKVQSNLMMWIRFYFIAVDVIVYDETYMFKYDTVHGQWKHHEVKVKDSKTLLFGEKEVAVFGCRNPEEIPWGSVGAEYVVESTGVFTDQEKAXAHLKGGAKKVVISAPSKDAPMFVVGVNEKEXKSDINIVSNASCTTNCLAPLAKVINDKFGIVEGLMTTVHAITAAQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 6721 - protein, 578 aa, Kluyveromyces lactis NRRL Y-1140
MQLARIIFQRGFLRTFGTVAKKEFINMSTQVELKRVATQDIQPVKPKQSKKSKIRKYKPKPLDPTSALGVLQFEIDEILKEFSLARDAILNDVGCILNEERDGPMHRLYHREVNSVEVLKMGANGEGLALIPNPVDLDKKQIALIPFALPGDVVRIKTFKTHPHYVECDLLEVIKPSSKRNNDLIQCRYFGKCSGCQLQYLTYEDQLAFKKRTVMNAYKFFAPRLMEDKLVPEIGETMRSPLEIGYRTKLTPHFDLPKRMKGNGERPALGFGHKGRPQWRGNADGGSGPMLDIEECIIGTKIINQGMTNERARFEREFTKYNKGATILLREHTKVIDPEIPVAEQLDDGSEDIEGKISYLQINDEENDKSLVKTCVTNTRQIVTEYINGYTFQFSAGEFFQNNNSILPSVTAYVRKNLQIEGSKPEDPHYLVDAYCGSGLFSITSSKGVDRVIGVEVSADSVAFAERNAKANGVENCKFIVGKAEKIFGSIDTPCDRTSVILDPPRKGCDDIFMKQLAEYNPARIVYISCNVHSQARDVEYFLKETENGKHYKIESLRGFDFFPQTHHVESVCVLSRS

SEQ ID NO: 6722 - protein, 488 aa, Escherichia coli
MKKVNHWINGKNVAGNDYFQTTNPATGEVLADVASGGEAEINQAVAAAKEAFPKWANLPMKERARLMRRLGDLIDQNVPEIAAMETADTGLPIHQTKNVLIPRASHNFEFFAEVCQQMNGKTYPVVDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVGALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 6723 - protein, 438 aa, Synechococcus sp. WH 7805
MASAPVTAPTLNTTRSQELFSAAQALMPGGVSSPVRAFRSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKQLFAENPDAISGVILEPIVGNAGFIQPEPGFLEGLRELTKEHGALLVFDEVMTGFRISYGGAQAHFGVTPDLTTMGKVIGGGLPVGAYGGRREIMEMVAPAGPMYQAGTLSGNPLAMTAGIKTLELLRQPGTYEKLTTATEQLITGIKEAASAAGMPITGGSVSAMFGFFLCEGPVRNFEEAKATDAERFGKLHRAMLQRGVYLAPSAFEAGFTSLAHSDGDIEATLQAFRESFADIA

SEQ ID NO: 6724 - protein, 636 aa, Methanococcoides burtonii DSM 6242
MIVGFLFTGMLVGPHGYGFIDAVEEVEVLAEIGIVLLLFTIGVELSIKDLWKMKRAVVFGGSIQVFLTTIAVFSIANYLGYGIGESIFIGFLFSLSSTAIVLKLLQNRGELQAPHGRFSLAVLLYQDVIVVPMILITPFLAGAGSMSDAAFIPILAKGIGLVILVFASAKWIVPQVLFQITKTRDSELFFLSIIVICLSVAWLTSSLGLSLALGAFLAGLIISESEYSHQALSNMIPFRDIFMSFFFISIGMLLDLDYFFNDPFLFIIIAACVLLLKSVIAGLSSYLLGFPLHTAVIAGLGLAQVGEFSFVLSTFGVEYGLLTDEVYQLFLVVSILTMAVTSSVMSISPKVADKVVNLPIPSKMKCGFHSRKMMAVLDKKGHLEDHLIIAGFGFNGRTVAKAATIAGIPYLVLDTNPETVRKEQLKGELIYYGDSSQRGVLEHADIKDARVMVVCISDPAGTRRAISLARKMNPNIHIIARTQYLQEMEPLYELGANEVIPEEFETSIEIFVRLMKRYLIPKDEIEKFISEIRSDGYEMFRTLSGAMSIYDMEIDLPEMDITNLRVRASSFAVGKNLLQLDLRKKYSVTLLAIRRNSEVIANPDADAVLISGDVLVLMGSPEMISKVTPLFVGGDI

SEQ ID NO: 6725 - protein, 950 aa, Neisseria gonorrhoeae FA 1090
MKLSELFNPNEFAARHLSFGDEAALLAAVGEKSMDEFVGNTLPQSIRMPSELDLPEALTEADALAKLKGIASKNVINKSYIGLGYYPTRVPNVILRNVLENPGWYTAYTPYQAEIAQGRLEALLNFQQVCIDLTGFPVAGASLLDEATAAAEAMAMAHRVGKVKSERFFVDARVYPQTLDVMKTRAKYFGFELVVSDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIANRIHTLASVFADALVSDGLKVVHEVFFDTVTVDFGSKEKADQVFAAALESGYNLRSVNNTQVAAAFHETSVYEDLADLYRAFTGKDTFTFADDVKGRLNAELLRQDDILQHPVYNSYHTEHEMLRYLKKLEDRDLAMNRSMISLGSCTMKLNATAEMLPITWTEFSDIHPYAPEAQTAGYRELLADMENSLKAITGFDAISFQPNSGAQGEYSGMLAIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTSVAAAAFGSASILPITWMYLTMMGKQGMEQATRWALLNANYVAKRLSEDYPILYTGKNGRIAHECIVDLRPLKAESGITETDIAKRLMDYGFHAPTVSFPVAGTLMIEPTESESKAELDRFIAALKSIRREVQKVIDGEWPKDDNPLVNAPHTAADITGEWAHPYSREEAVFPLPFVREHKFWPFVNRVDDVYGDRNLVCSCPPMENYED

SEQ ID NO: 6726 - protein, 264 aa, Vibrio vulnificus CMCP6
MKKITINDLIKWKQEGRKFATSTAYDASFAQLFESQEMPVLLVGDSLGMVLQGKNDTLPVTVEDIAYHTRCVRAGSPNCLLMADMPFMSYATPEQACENAAQLMRAGANMVKIEGGDWLVDTVKMLTERAVPVCAHLGLTPQSVNIFGGYKVQGRDQEKADRMVKDALALQAAGAQIVLLECVPAELAARITQVLDVPVIGIGAGNVTDGQILVMHDMFGISANYMPKFSKNFLAETGDMRKAVALYMEQVQAGTFPDEAHTIA

SEQ ID NO: 6727 - protein, 448 aa, Leuconostoc mesenteroides subsp. mesenteroides ATCC 8293
MARKTFTKEEIKQIVADENVEFIRVTFTDVLGAIKNVEVPTSQLDKVLDNDLMFDGSSIEGFVRINESDMYLYPDLSTFMIFPWATDGHGGKVARLIADIYTADREPFAGDPRHALRTVLTEAREAGFTSFNVGTEPEFFLFKLDEKGNPTTELNDKGGYFDLAPLDMGENVRREIVLTLEKMGFEIEAAHHEVAEGQHEVDFKYASALEAADNIQTFKLVVKTIARKNGYFATFMPKPVAGINGSGMHTNMSLFTKEGNAFEDVSDEMGLSKAAYNFLGGVLEHATAFTALANPTVNSYKRLTPGFEAPVYVAWSASNRSPMVRVPASRGQSTRLELRSVDPTANPYTSLAAILASGLDGIKRELEPLASVDKNIYLMDEIERERAGITDLPDTLLAAVRELAADDVVRAAIGEHIADKFIEAKKIEYTSYRQYVSQWETDSYLEKY

SEQ ID NO: 6728 - protein, 322 aa, Streptomyces avermitilis MA-4680
MNTAQHKIGSGFGATSTAVDVLHGIDLSGQLAIVTGGYSGLGLETTRALTGAGARVVVPARRPDVAREAVAGIDGVEVDELDLGDLESVRGFAERFLASGRTIDIVINNAGIMACPETRVGPGWEAQFATNHLGHFALVNRLWPAVEPGGARVVSVSSGGHHLSGIRWDDVHWTHDYDKWEAYGQAKTANVLFAVHLDRLGRESGVRAFSLHPGGILTPLQRHLAKEEMVERGWIDENGDLVHPDAFKTPEQGAATQVWAATSPQLAGMGGVYCEDCDIAEPASADGERGGVKDWATDPEQAARLWDLSAELTGVNAFASRA

SEQ ID NO: 6729 - protein, 223 aa, Bacillus subtilis
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEA

SEQ ID NO: 6730 - protein, 265 aa, Phytophthora infestans
MAPKVLALLATVLLCCIASVAGQDAAPVAIQAHASHLLVDTEAEADDLSVQLGEASNLFLKFAQLAKEHSKCPSSRKGGDLGTFDRGQMVPEFDKVAFEGEIGVVHKVKTQFGWHLVLISRRLDGTEEPDKYRDLKQALLKIMPFLGPIILIFIMAYGARGSKGGPRARAFHILVKSEDEADKLFKEIDAAEDKKTKLSELAGKHSTCPSGKKGGDLGMFGRGEMVPQFDKVVFEGEVGELAKVQTQFGWHVLLCTERLGDKKSK

SEQ ID NO: 6731 - protein, 626 aa, Oryza sativa
MAIGGAAPPHPPRGGGGGSPEDSSTARRPDFEQPLLQAHAAVPARGKQEPVERDHEAQCSPEADGDGATFVRTCFNGLNALSGEYKKHSIFGRRSCSSGVGLLSIPYALSEGGWLSLVLLLAVAMVCCYTGLLLRRCMAASPAVRGYPDIGALAFGAKGRLAVSAFLYAELYLVAIGFLILEGDNLDKLFPGTSLAVGGLVVSGKQLFVVVVAVVILPTTWLRSLAVLAYVSASGVLASVVVVFCVLWAAVFDGVGFHGKGRMLNVSGLPTALGLYTFCYCGHAIFPTLCNSMQEKDKFSRVLVICFVACTVNYGSMAILGYLMYGDDVKSQVTLNLPEGKISSKLAIYTTLINPFSKYALMVTPVATAIEEKLLAGNKRSVNVLIRTLIVVSTVVIALTVPFFGHLMALVGSLLSVMASMLLPCICYLKIFGLTRCGRGETLLIAAIIVLGSLVAATEIVQLVKMPNDICRISALHLNLLYLDMRYRKTEAKNRKRAAEKGNPQTKSPLTRRKSERDEALLDEEREEEDDEAGGDALRARHQRLLVRQQRHGGADAPDQEPAQIPVHAGQPLARLLAARRSLLRPRLRMPCAAASPRDRGWGRGLKLRGESQEPYQVQIFRGCQK

SEQ ID NO: 6732 - protein, 670 aa, Pseudomonas aeruginosa UCBPP-PA14
MSRSAFTALLLSCVLLALSMPARADDLPYRFGLGKADITGEAAEVGMMGYSSLEQKTAGIHMRQWARAFVIEEAASGRRLVYVNTDLGMIFQAVHLKVLARLKAKYPGVYDENNVMLAATHTHSGPGGFSHYAMYNLSVLGFQEKTFNAIVDGIVRSIERAQARLQPGRLFYGSGELRNASRNRSLLSHLKNPDIAGYEDGIDPQMSVLSFVDANGELAGAISWFPVHSTSMTNANHLISPDNKGYASYHWEHDVSRRAGFVAAFAQTNAGNLSPNLNLKPGSGPFDNEFDNTREIGLRQFAKAYEIAGQAQEEVLGELDSRFRFVDFTRLPIRPEFTDGQPRQLCTAAIGTSLAAGSTEDGPGPLGLDEGNNPFLSALGGLLTGVPPQELVQCQAEKTILADTGNKKPYPWTPTVLPIQMFRIGQLELLGAPAEFTVMAGVRIRRAVQAASEAAGIRHVIFNGYANAYASYVTTREEYAAQEYEGGSTLYGPWTQAAYQQLFVDMAVALRERLPVETSAIAPDLSCCQMNFQTGVVADDPYIGKSFGDVLQQPRESYRIGDKVTVAFVTGHPKNDLRTEKTFLEVVNIGKDGKQTPVTVATDNDWYTQYRWERVGISASKATISWSIPPGTEPGHYYIRHYGNAKNFWTQKISEIGGSTRSFEVLGTTP

SEQ ID NO: 6733 - protein, 86 aa, Oryza sativa
MAGAAKASWMVAMSVGAVEALKDQGGLCRWNYALRSIHKAAKANAAGVSQGKKLPASAAAVAERRRAEKAEEGLRTVMYLSCWGPN

SEQ ID NO: 6734 - protein, 132 aa, Brassica napus
  misc_feature (2)..(2): Xaa can be any naturally occurring amino acid
  misc_feature (11)..(11): Xaa can be any naturally occurring amino acid
  misc_feature (16)..(16): Xaa can be any naturally occurring amino acid
  misc_feature (32)..(32): Xaa can be any naturally occurring amino acid
  misc_feature (35)..(35): Xaa can be any naturally occurring amino acid
  misc_feature (40)..(40): Xaa can be any naturally occurring amino acid
  misc_feature (47)..(47): Xaa can be any naturally occurring amino acid
  misc_feature (51)..(51): Xaa can be any naturally occurring amino acid
  misc_feature (60)..(61): Xaa can be any naturally occurring amino acid
  misc_feature (65)..(65): Xaa can be any naturally occurring amino acid
  misc_feature (67)..(67): Xaa can be any naturally occurring amino acid
  misc_feature (70)..(70): Xaa can be any naturally occurring amino acid
  misc_feature (75)..(75): Xaa can be any naturally occurring amino acid
  misc_feature (84)..(85): Xaa can be any naturally occurring amino acid
  unsure (1)..(132): unsure at all Xaa locations
WXSSMLSSAAXVTSPXQATMVAPFTGLKSSAXFPXHPAKXTTNITSXASNXRKELTCMKXXPPPXKXKVXNLSYXPDLTEIELXXEVEYPPPRGFPWVPWKGFPGSGKGLGFGKGENFPPFGRPQRGPKGKG

SEQ ID NO: 6735 - protein, 248 aa, Roseovarius nubinhibens ISM
MRRKLAAGNWKMNGDSATLDELATLAQRHAEASVDLLICPPATLISRAVSCAGPIRIGGQDCHAAPSGAHTGDISAAQLRDAGATAVILGHSERREDHDEDSDQVREKARAAHAADLLTVICLGESLAQREAQNTLDIIGAQLALSVPDSATGENTVIAYEPIWAIGTGLVPDTDQIGEVHDFIRARLERRFGAGVGRSVRLLYGGSVKPENAASIFAVSNVDGALVGGASLKAADFSPIVSALEASA

SEQ ID NO: 6736 - protein, 462 aa, Escherichia coli
MTANSPLQRIGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 6737 - protein, 348 aa, Zea mays
AGRAGLSPARVAAPAVRGAVEALLAGPDPARADEVARRCAGLSNWYGVIPALFPNARYVHGIMTGTMEHYVKKLRHYAGGLPLVAAEYGASEGWVGANVEPETPPESATFTVLPNIAYFEFIPLKAATGHGGGTAGDTCYAEAEPEPVGLTEVTVGEHYEVVVTTFAGLYRYRLGDVVQVAGFYNSTPKLKFVCRRNLLLSINIDKSSEQDLQLAVDSAAKVLAAEKLEVVDYSSHAEVSRDPGHYVVFWELNADAGDDVLQSCCDELDRAFADPGYVGSRRARGIGPLELRVLQRGTFQKVLRHYLSLGAPVSQFKSPRCVGRANNSGVLQILSANVVKAFFSAAYD

SEQ ID NO: 6738 - protein, 282 aa, Medicago truncatula
MIPHAARNGAVLISHGGSRCRARCFSDQFPIPVSPALFTSTVRTKMVAQNFVVDLDKPLVFQVGHLGEAYEEWVHQPIVSKEGPRFFQNEVLESLTLTVWWAIPVIWLPVVCWFVYNSIQMGLSCPHIALMVVLGIFVWTLLEYTLHRFLFHIKTKTYWGNTIHYLLHGCHHKHPMDGLRLVFPPTATAILLFPFWNAVKLFSTPSTTPALFGGGLLGYVIYDCTHYYLHHGQPKTEHPRNLKKYHLNHHFRIQDKGFGITSSLWDKVFGTLPSSKADAKSM

SEQ ID NO: 6739 - protein, 840 aa, Arabidopsis thaliana
MVVSVTIRRRFVLLLLACTCLLSRRLCFGEDRITFSSPIKDSESETLLCKSGIFRFGFFTPVNSTTRLRYVGIWYEKIPIQTVVWVANKDSPINDTSGVISIYQDGNLAVTDGRNRLVWSTNVSVPVAPNATWVQLMDSGNLMLQDNRNNGEILWESFKHPYDSFMPRMTLGTDGRTGGNLKLTSWTSHDDPSTGNYTAGIAPFTFPELLIWKNNVPTWRSGPWNGQVFIGLPNMDSLLFLDGFNLNSDNQGTISMSYANDSFMYHFNLDPEGIIYQKDWSTSMRTWRIGVKFPYTDCDAYGRCGRFGSCHAGENPPCKCVKGFVPKNNTEWNGGNWSNGCMRKAPLQCERQRNVSNGGGGGKADGFLKLQKMKVPISAERSEASEQVCPKVCLDNCSCTAYAYDRGIGCMLWSGDLVDMQSFLGSGIDLFIRVAHSELKTHSNLAVMIAAPVIGVMLIAAVCVLLACRKYKKRPAKDRSAELMFKRMEALTSDNESASNQIKLKELPLFEFQVLATSTDSFSLRNKLGQGGFGPVYKGKLPEGQEIAVKRLSRKSGQGLEELMNEVVVISKLQHRNLVKLLGCCIEGEERMLVYEYMPKKSLDAYLFDPMKQKILDWKTRFNIMEGICRGLLYLHRDSRLKIIHRDLKASNILLDENLNPKISDFGLARIFRANEDEANTRRVVGTYGYMSPEYAMEGFFSEKSDVFSLGVIFLEIISGRRNSSSHKEENNLNLLAYAWKLWNDGEAASLADPAVFDKCFEKEIEKCVHIGLLCVQEVANDRPNVSNVIWMLTTENMSLADPKQPAFIVRRGASEAESSDQSSQKVSINDVSLTAVTGR

SEQ ID NO: 6740 - protein, 246 aa, Brassica napus
  misc_feature (217)..(217): Xaa can be any naturally occurring amino acid
  misc_feature (223)..(223): Xaa can be any naturally occurring amino acid
  misc_feature (232)..(232): Xaa can be any naturally occurring amino acid
  unsure (1)..(246): unsure at all Xaa locations
MLAIFDKKVAKAPEALTSQEGGSVCALKDGFLPNHFASIYPGAVTTNLGSSGLIACSLHKQNPLLPRLFAVNDDMFCIFQGHIENIPFLKQQYGLTKTATEVTVVIEAYRALRDRGPYPADQVVRDFQGRFAFMLFDCTTKNVFLAADADGSVPLFWGTDGEGHLVLSDELETVKKGCGKSFAPFPKGCFFTSSGGLRSFEFPLNELKPVPRVDSSXQVCGVXFQVDSEAKXEGAMPRVGSVQNWS

SEQ ID NO: 6741 - protein, 266 aa, Pseudomonas aeruginosa UCBPP-PA14
MPDVTLTTLQGLKQSGEKIAMLTCYDATFAHTASQAGVDVLLVGDSLGMVLQGHDSTLPVSNEEMAYHTACVKRGNKGSLIVTDLAFESSHSVAQTLADAVRLMQAGAHMVKLEGGAWLAEPIARLAQMGVPVCAHLGLTPQAVNLFGGFKVQGRQETQARQLRADAIALEQAGAAMLLLECVPSVLAEEITQAVKIPVIGIGAGAATDGQVLVMHDMLGLSLTGRSPKFVKDFMQGQESIPAAIAAYVRAVKDVSFPAAEHGFNA

SEQ ID NO: 6742 - protein, 310 aa, Chara vulgaris
FGRIGRLVLRAALLNHPEIEVVAVNDPFIDTKYMVYMFKYDSVHGQFKGKISAKDEKTLIINGKEVAVYGSRDPAAIPWSDTGVEVVVESTGVFTDKDKAAAHIKGGAKKVIISAPSKDAPMFVVGVNEDKYTPDLTIVSNASCTTNCLAPLAKVINDNFGIVEGLMTTVHSLTATQKTVDGPSGKDWRGGRGAGFNIIPSSTGAAKAVGKVLPELNGKLTGMAFRVPTADVSVVDLTVRLAKPASYDTIKQCIKAASEGPLKGILGYTDEDIVSTDVIGDAHSSVFDAKAGIALNDNFVKLVSWYDNEW

SEQ ID NO: 6743 - protein, 114 aa, Brassica napus
MTAASLRLSEILPENKPLVSERTMPTLQGSLPPELANNVVRLYRECLRRATFIGKQQHNTELVVGMVRQQFKKHMNETDPEKIHKLKDDAARGLINHMLFESEKLTGRKVSQRS

SEQ ID NO: 6744 - protein, 312 aa, Chara vulgaris
KVGINGFGRIGRLVLRASLNHPNVQVVAVNDPFLDPEYIVYLFKYDTVHGKYKGEVGLSADKKLVVDGKEIAIFALRDPAAIPWGEAGADYVVESTGVFTAKDKAAAHLKGGAKKVVISAPSGDAPMFVMGVNEDKYTADLDVISNASCTTNCLAPLAKVMNDNFGIVEGLMTTVHAVTATQKTVDGPSGKDWRGGHGAGFNIIPSGTGAAKAVGKVLPELNGKLTGMAFRIPTADVSVVDLTVRLAKSTTYDEIKAVIKKASESDLKGILGYTDDDVVSSDFIGDVRSSIFDAKAGIALNGNFVKLVSWYD

SEQ ID NO: 6745 - protein, 183 aa, Arabidopsis thaliana
MGYRRSYAITFVALVAALWSVTKAQPSSSCVSTLTTLSPCLSYITGNSTTPSQPCCSRLDSVIKSSPQCICSAVNSPIPNIGLNINRTQALQLPNACNIQTPPLTQCNAATGPTAQPPAPSPTEKTPDVTLTPTSLPGARSGVGGGSKTVPSVGTGSSSRNVDPLPLHFLMFAVLVVCTSSFL

SEQ ID NO: 6746 - protein, 394 aa, Trichodesmium erythraeum IMS101
MSQIQTRTEPMVINMGPHHPSMHGVLRLIVTLDGEDVIDCEPVIGYLHRGMEKIAENRTNTMFVPYVSRWDYAAGMFNEAVTVNAPEQLADIAVPKRASYIRVIMLELNRIANHLLWLGPFLADVGAQTPFFYIFREREMIYDLWEAATGYRMVNNNYFRIGGVAADLPYGWVDKCEDFCDYFLPKVDEYERLITNNPIFRRRIMGLGVISREEAINWGLSGPMLRASGVKWDLRKVDHYECYDDFDWEVHWEKDGDCLARYLVRIREMRESVNIIRQAIKGLPGGPYENLEAKRMAEGPKSEWNDFDYQFLGKKIPPTFKIPKGEHYVRIESGKGEIGIYIIGDNNIFPWRFKIRAADFVNLQIFPHILQGAKVADLVAILGSIDIIMGSVDR

SEQ ID NO: 6747 - protein, 399 aa, Methanosarcina barkeri str. fusaro
MMKVVLDPVHGYIELDDLVQDLLYTPQMQRLRRIRQLGFSNLVYPGANHSRFEHSLGTMHLASTLTQSLDSIEEDKKTEIKAAALLHDVGHGPFSHVTENVIDKYTRRRHDDVKEILGKGEIREVLNKYGISPGNLVKHIKGETSLGQILSSEIDVDRMDYLVRDAHYTGVAFGVVDYNRLIKQMNFHEDRLVVDYGGLKAAESLLVSRFWMNTSVYYHHVTRISEAMCSRAVEYMIENNELDPFKLRHMDDIDLIASMRNAAGYAGELSRLLDARKLYKRALYVGLADVGKAVLRHRDRIRRVEIEIAELAGVSPEYVLVDIPKTPEMLEMQAMIKTDHKMIPLNEASHFISILREADMDNWRMGVYSQKEHCEAVGKAARDYFDVKKPLKQFKLSDL

SEQ ID NO: 6748 - protein, 381 aa, Methanothermobacter thermautotrophicus str. Delta H
MLTMDGKEEIIETEIAMGPVHSAAIEPYRVRLFVEDEIVRDAEITVGVNHRGIERIMEGLPVEKANSLTEKVCGICSGVHLWNSVLVAEKGLGVEIPERASYIRIIIGELERLHSHLLYLAHGNEVLGHETFSMRLFYIRETVMELLRLIGGNRVQYGVPIIGGIRPRADLDEMKVQRIREGIDLIEEKVEAFAERFTSDPMIMSRITGVCPISRKDALRLHVTGPTLRATGVDLDIRREMPCYDPFEFEVITQDEGDVRANLLMRVLEIFESVKIIRQALRDLPGGKVVDRSWEMQDTGIIKSYVEAPRGRLYHSYAIEDGRVRGSVIRTPSMSNIGAMQYACIGHHITDAQLGIVQCDPCFTCTDRAIEIVDLSDNPRR

SEQ ID NO: 6749 - protein, 554 aa, Clostridium perfringens SM101
MNKKWWKELIAYQIYPKSFMDSNGDGIGDIQGIISKLDYLKDLGIDLIWLCPMYKSPNHDNGYDISDYKDILDEFGTMDDFNELLNEVHNRGMKLIIDLVINHTSHEHPWFIESRSSRDNPKRDWYIWREGKGYEEPNNWESIFKGSAWEFCENSEEYYLHLFAKEQPDLNWENKEVRRELYNMINWWLDKGIDGFRVDAISHIKKEEGLKDMDNPEGLKYVSSFEKHMNVEGINSHLKELKEETFSKYDIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSICEYDDVKTINTYNERIESGVSEEIALKEAWVTSRDNSRTPMQWNSSKNAGFTCGKPWIGVNENYKTINVEVEERDENSVLNFYKKLIKLKKSNEALIYGVYDLILEEDENIFAYTRTLNNDKFLIMANLTGENAKYVYEKEKLNSKDLILNNYEVCEHKNLTEFILKPYECRVYKLS

SEQ ID NO: 6750 - protein, 140 aa, Brucella melitensis 16M
MAIERTFSMIKPDATRRNLTGAIIAKLEEAGLRVVASKRVWMSRREAEGFYAVHKDRPFFGELVEFMSSGPTVVQVLEGENAIAKNREVMGATNPANADEGTIRKAFALSIGENSVHGSDAPETAAEEIAYWFSGTEIVG

SEQ ID NO: 6751 - protein, 720 aa, Arabidopsis thaliana
MATTSSDRLIAGLTASIGSIESRYANPAQSVSLICRNQINGAPPIVLRSSRRSRLWLIEAIPPAKSWNGSNDGDEDIKKSDTRNYAIGGTGGHAVAGKDDRTMEIVIAAATTAALGVGNRVLYKLALIPLKQYPFFLAQLSTFGYVAVYFSILYFRYRAGIVTKEMLSVPKLPFLIVGVLESLALAAGMAAASNLSGPSTTVLSQTFLVWQILFSIIFLGRRYRINQILGCTLVAFGVIVSVASGSGAAHSFKDTGILWSLLMVFSFLLQGADTVMKEVIFLDSKKRLKGASLDLFVVNSYGSIFQVICIALLLPFLSKLWGIPFNQLPSYIRDGGACFLNIGSRITGCEGAPLLPVMFVMMNMAYNISLLRLIKISSAVVSSLASTVSEPIMFRVTGTLSAASSPAVAAASFSAALRLSITPTLAIASPPHLRWFSKFSRQFLGGRISSLRPRIPSPCPIRLSGFPALKMRASFSSGSSGSSASREILVQHLLVKNNDVELFAELQKKFLDGEEMSDLAAEYSICPSKKDGGILGWVKLGQMVPEFEEAAFKAELNQVVRCRTQFGLHLLQVLSEREPVKDIQVEELHSKMQDPVFMDEAQLIDVREPNEIEIASLPGFKVFPLRQFGTWAPDITSKLNPEKDTFVLRAVSEGWVYYGCPSRLFWFFSTKSRPLLQCKVGGRSMQVANWLQSQGFKSVYNITGGIQAYSLKVDPSIPTY

SEQ ID NO: 6752 - protein, 543 aa, Rhodopirellula baltica SH 1
MVLTFMTATRRRPVVLIVRDGWGQNPDPKWNESNAVHLANTPVDDKLTQEYPSVLIHTSGEDVGLPAGVMGNSEVGHQNIGAGRIVDQEVMRITRAIRDDSFFSNPVVTGAIDHVKKSGGRLHLLGLMSDGRVHSDLQHGIAVIDLAKRNGLTGDQLAIHAITDGRDTSPRGGLKFVSQLTDHCEASGVGVVASVIGRFYAMDRDLRWERVEAAYNLMTQGTGQTFPSASAAIESYYANPTESSRDGDEFITASSIVPEGGSPITVQPGDAVLFMNYRGDRTREITKAFTFDDAAWKDIPGGGFDRGKKIDNLYFATMTGYETGLPVKVIFEKPAKMPNILGEYVASKGLHQFRCAETEKYPHVTFFFNDYRDNPFEEEEWGMAPSPRDVSTYDQKPEMSAEDITEKVLKQIKSGKCDMIIVNYANGDMVGHTGVLEAAIKAVEKVDACVGRVVDATLAAGGSLVVTADHGNCEQMIDPETGGPHTAHTTYQVPLIVVDPEFVGKPLREGGRLADIAPTVLALMGLEVPPEMTGRPLMETQTA

SEQ ID NO: 6753 - protein, 830 aa, Arabidopsis thaliana
MGCLLILLLTLICFSLRLCLATDVITFSSEFRDSETVVSNHSTFRFGFFSPVNSTGRYAGIWFNNIPVQTVVWVANSNSPINDSSGMVSISKEGNLVVMDGRGQVHWSTNVLVPVAANTFYARLLNTGNLVLLGTTNTGDEILWESFEHPQNIYLPTMSLATDTKTGRSLKLRSWKSPFDPSPGRYSAGLIPLPFPELVVWKDDLLMWRSGPWNGQYFIGLPNMDYRINLFELTLSSDNRGSVSMSYAGNTLLYHFLLDSEGSVFQRDWNVAIQEWKTWLKVPSTKCDTYATCGQFASCRFNPGSTPPCMCIRGFKPQSYAEWNNGNWTQGCVRKAPLQCESRDNNDGSRKSDGFVRVQKMKVPHNPQRSGANEQDCPESCLKNCSCTAYSFDRGIGCLLWSGNLMDMQEFSGTGVVFYIRLADSEFKKRTNRSIVITVTLLVGAFLFAGTVVLALWKIAKHREKNRNTRLLNERMEALSSNDVGAILVNQYKLKELPLFEFQVLAVATNNFSITNKLGQGGFGAVYKGRLQEGLDIAVKRLSRTSGQGVEEFVNEVVVISKLQHRNLVRLLGFCIEGEERMLVYEFMPENCLDAYLFDPVKQRLLDWKTRFNIIDGICRGLMYLHRDSRLKIIHRDLKASNILLDENLNPKISDFGLARIFQGNEDEVSTVRVVGTYGYMAPEYAMGGLFSEKSDVFSLGVILLEIVSGRRNSSFYNDGQNPNLSAYAWKLWNTGEDIALVDPVIFEECFENEIRRCVHVGLLCVQDHANDRPSVATVIWMLSSENSNLPEPKQPAFIPRRGTSEVESSGQSDPRASINNVSLTKITGR

SEQ ID NO: 6754 - protein, 252 aa, Prunus microcarpa
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEVLNFKLEKEDIELINTIDKKSRTTL

SEQ ID NO: 6755 - protein, 156 aa, Oryza sativa
IPTYRRRRSMMYMRATHRDEEGKKVTEKVAVPETRHPDTARHFERKLDQQGLHRMERHPANGSRGIGAPPPKSGRGGKFTWEGPDSIVDSQLDPLPAAIDRNDPNYEEEEGDHEREADVVGEVEVAKVAGDARDGVARVDVVAPPQLHEKLQLQPQ

SEQ ID NO: 6756 - protein, 252 aa, Prunus lusitanica
AHYRSEADVGNALAEAFETGLVKREELFITSKASNHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINTIDKKSRTTL

SEQ ID NO: 6757 - protein, 315 aa, Coleochaete scutata
  misc_feature (289)..(289): Xaa can be any naturally occurring amino acid
  unsure (1)..(315): unsure at all Xaa locations
KVGINGFGRIGRLVARVALGRDDVELVAINDPFISTEYMVYMFKYDSVHGRWGGNVELKDAKTLLFNGKPVNVYDKRDAAEIPWSEMGAEYVVESTGVYTDMDKAAAHLKGGAKRVVISAPSKDAPMFVMGVNHEKYKGEAIVSNASCTTNCLAPLAKVVNDRFGILEGLMTTVHSITATQKTVDGPSSKDWRGGRGAGFNIIPSSTGAAKAVGKVLPELNGKLTGMAFRVPTADVSVVDLTVRLEKAATYDEIKAALKEASEGAMKGILGYTEDDVVSTDFITDERSXVFDAKAGIALNNKFVKLVSWYDNELG

SEQ ID NO: 6758 - protein, 252 aa, Prunus virginiana
AHYKSEADVGNALAEAFDTGLVKREELFITSKASNHGHVVEACRNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGSTANVKSFGSISPLEDPVLHGLAKKYKKSVAQIALRWNLDRNTPVIPKSSKIERLKENLEVLNFKLEKGDIELINTIDKKSRTTL

SEQ ID NO: 6759 - protein, 312 aa, Klebsormidium flaccidum
GINGFGRIGRLVMRAALERSDVEVVAVNDPFIDADYAIYMFTYDSVHGEVQREDREEDAHTISFDGHDVAFYAARDPSEIPWGKHGADYVVESTGVFTDMDKAAAHLKGGAKKVIISAPSKDAPMYVMGVNHEKYKTSDDVISNASCTTNCLAPLAMVVNNKFGILEGLMTTVHATTATQKTVDGPSNKDWRGGRGASTNIIPSSTGAAKAVGKVLPELNGKLTGMAFRVSTADVSVVDLTVRLEKPAKYDDIVAAIKEAADGPLKGILGYTSDDVVSQDFVHDSRSSIFDIKAGIALNDSFVKLVSWYDNE

SEQ ID NO: 6760 - protein, 473 aa, Nostoc punctiforme PCC 73102
MTTPQELLKKIQDEKIQLIDLKFIDTVGTWQHLTLYQNQIDETAFTDGVPFDGSSIRGWKAINESDMTMVLDPNTAWIDPFMEVPTLSIICSIKDPRTGEPYNRCPRVIAQKAVDYLVASGIGDTVFFGPEAEFFLFDSARFAQTANEGYYFLDSEEGAWNSGKEGTAEKPNLGYKPRFKEGYFPVAPTDSFQDIRTEMLLTMAELGVPIEKHHHEVATGGQCELGFRFGKLIEAADWLMTYKYVIKNVAKKHNKTVTFMPKPIFGDNGSGMHCHQSIWKDGQPLFAGDKYAGLSDMALYYIGGLLKHAPALLAITNPSTNSYKRLVPGYEAPVNLAYSEGNRSASIRIPLSGKNPKAKRLEFRCPDATSNPYLAFAAMLCAGIDGIKNKIHPGEPLDKNIYELSPEELAKVPSTPSSLELALQALENDHGFLTESGVFTEDFIENWIDYKLNEAKQLQLRPHPYEFYLYYDA

SEQ ID NO: 6761 - protein, 172 aa, Triticum aestivum
MAPRTMSSSSSILLAAAVAALLVASASAQSGCTAALVGLFPCLNYISGNDTAPTKSCCSQLSSVVQSQPQCLCSALGGDSSSLGGMTINKTRALELPKACNVQTPPASKCNGGGSAPGAATPTTPEVQAPAGSGSKTTPSAYLQENGGSSLQGPAGLVFALAAAAVYAVSSL

SEQ ID NO: 6762 - protein, 385 aa, Arabidopsis thaliana
MSCFLGPSTNNKSRENEGSSMAAPYEQQNLPRNDRRQITTWEAVGTNKESPKNIKAKSFKFRELATATNSFRQEFLIGEGGFGRVYKGKMEKTGQVVAVKQLDRNGLQGNREFLVEIFRLSLLHHPNLANLIGYCLDGDQRLLVHEFMPLGSLEDHLLGQQPLDWNSRIRIALGAAKGLEYLHEKANPPVIYRDFKSSNILLNVDFDAKLSDFGLAKLGSVGDTQNVSSRVVGTYGYCAPEYHKTGQLTVKSDVYSFGVVLLELITGKRVIDTTRPCHEQNLVTWAQPIFREPNRFPELADPLLQGEFPEKSLNQAVAIAAMCLQEEPIVRPLISDVVTALSFMSTETGSPSGLTGTALNPLSPKTVEDQGWLQCESPRDVYSLL

SEQ ID NO: 6763 - protein, 819 aa, Haemophilus somnus 129PT
MVNTLPLPFSYNRPENTKDSLKKSIVYKLIFLIGRSPEEASQRDWLNATLYAIRDLVTEGWISTARQARKEETRRVYYLSMEFLMGRTLSNALISEGVYHLAKDALAELNVDLEDVLEKEVDPGLGNGGLGRLAACFMDSIATLAIPGMGYGIRYEYGMFQQYIEDGKQVEKPDAWLEKGYPWEFIRPSKRFNIRFGGHIYFEGKKCIWKNAEEITALAYDQMIPGYSNDSAATLRLWSANAGETFNLVSFNRGDYFHAIEEKSSSENVSRVLYPDDSTSAGRELRLRQEYFLVSASLQDIIKRHKRIYNTLDNLADKIAIHLNDTHPALAIPELMYILIDQEGYTWQKAWDMCCQIFSYTCHTLMSEALETWPVEMMAKILPRHLQIIFEINDYFLEYVRTSVTTDNDFIRRISLIEEGNIRKVRMGWLSVVGSHKVNGVAAIHSDLMVSSTFADFYRIYPERFTNVTNGITPRRWIAVANPDLSALFDKYIGTEWRKDLTQLETLKAHIQDPELKKAIREIKRKNKQRLANYVKQELGIELNSNALFDVQVKRIHEYKRQILNVLHIVARYNEMIANPEKDWTPRVFILAGKAASAYTAAKQTINLINDVANIINNDDRLQGRLKVVFIPNYSVSLAQIIIPAADISEQISLAGTEASGTSNMKFALNGALTLGTLDGANVEILENVGKDNIFIFGNTVEQVEELRRNGYHPFDIYQSDEQLREVIDQINAGRFSPKEPTRYHDLLNSLRSYDYYQSFADFRSYVEMQKVVDEKYKNQEAWVESALQNIVNMSFFSSDRTILEYAEKIWKIEPLKLA

SEQ ID NO: 6764 - protein, 340 aa, Pichia anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 6765 - protein, 410 aa, Vibrio sp. Ex25
MAKVSLEKEKIKILLLEGLHPSSVEVLQAAGYTNIEYHKGSLPEEELIEAVKDVHFIGIRSRTNLSEEVINAANKLVAIGCFCIGTNQVNLDAAAKRGIPVFNAPFSNTRSVAELVLGQILLLLRGIPEKNALAHRGIWKKSADNSYEARGKRLGIIGYGHIGTQLGIIAENLGMRVYYYDIENKLSLGNATQVHTMSELLNKCDVISLHVPETPETKNMMGEAEFARMKPGSIFINAARGTVVHIPALCHSLEAGHIAGAAIDVFPTEPKTNADPFESPLQKFDNVILTPHVGGSTQEAQENIGVEVAGKLAKYSDNGSTLSSVNFPEVSLPEHGGECSRLLHIHKNRPGILTQINTIFAEDGINIAAQYLQTAAEIGYVVIDVETERSEEALAKLKSIEGTIRARILH

SEQ ID NO: 6766 - protein, 310 aa, Malus x domestica
MSTVTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVYA

SEQ ID NO: 6767 - protein, 459 aa, Bacteroides fragilis YCH46
MKQTRGYLLLICIVSAMGGLLFGYDWVVIGGAKIFYEPFFGIENSAALRGWAMSSALIGCLAGALLSGIWSDKYGRKKMLVIASFLFALSAWGTGAVDHFSYFIFYRIVGGLGIGIASNISPVYIAEVSPTHVRGKFVSLNQLTIVLGILLAQLANWQIGEYYTQGSDILSETSVQWAWRWMFWAELIPAGIFFLLSFIIPESPRWLATVHQQEKAQKTLTRIGGETYARQTLEELNQLTQSQGNRQNNEWKSVFRPEMRKVLIIGIVLAIFQQWCGINVIFNYAHEIFSSAGYAVSDVLMNIVVTGITNVIFTFVAIYTVDKWGRRTLMLIGSAGLALIYLILGTCYFLDVSGLPMLLLVVLAIACYAMSLAPVVWVVLSEIFPVKIRGMAIAISTFFLWVACFILTYTFPVLNESIGAEGTFWLYGGICLAGFLFIRQNLPETKGKTLEEIEKELIK

SEQ ID NO: 6768 - protein, 225 aa, Zea mays
WLIGANLENSAPLGKAGTGLVVLSAALAEVIVALGGGLLVGANNLNGALVDLDAREDASLLEDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 6769 - protein, 276 aa, Brucella melitensis 16M
MSIDSLPPLREVIERHDLMPKKSLGQNFLFDLNLTSKIARQAGDLRDQPVIEVGPGPGGLTRALLAQGAYVTAIERDDRCLEALAEIAAHYPGRLRIIAGDALEQDFTALFPEGPKPRIVANLPYNVGTQLLLNWLLVEPWPPFYSSMTLMFQREVAERIVAKLDSDHYGRLGVLAGWRTQAKIAFDVPPQAFTPPPKVMSSVVHIVPRETPLPCRAEALGQITQAAFGQRRKMLRQSLKSIGGAALLEKTGIDGTRRAETLSVEEFVALANACLP

SEQ ID NO: 6770 - protein, 359 aa, Xanthomonas campestris pv. vesicatoria str. 85-10
MLHHARCLGVAPAASRRHSSRVLQPAPLPRHAASPAAAVDDRALLAKLAGGRLSGDALARDAGLTRAAVWKRIQNLRAAGVDIEGRAGDGYRLATPLDLLDAARIRAGMAPGAAAGLAALDVAWTLESTNTALLAQPAPQQGVAVLLAERQTGGRGRRGRQWTSPLGAHIYLSASRRFNGGLGQLAGLSLAVGVAVAEALRGCGFADVGLKWPNDLLARQRKLGGLLIEGGGEMAGNARAVIGLGLNVHMPATAAASIDQPWIDLDTLAGGAVSRDQVTAAVLSGLLPALDLFEAQGLAPFLGRYADLDVLHGRAVQVEEAGTHHRGVALGLAADGALRVQLGETVRLFHSGEVSVRPA

SEQ ID NO: 6771 - protein, 520 aa, Oryza sativa
MIDRALEKEFPESEGEQGGGEKDPGSFNNTVAEKQGVLETVARRVTKKNETKDNKSFPFKEVFLDRPEQEDVPTLIDRKDNVFIISNPKSKYPVLQLDLRLISDLVVVIVSATFGGIAFACLGQPVITGYLLAGSIIGPGGFSFVSEMVQLRVVRAVAVVGGLLQIILFMLLCGISATLCGGKTKEGVFVGVLLSMSSTAVGAQFVGGSSDCVGDDHWAEPVLKFLMERNSINALHGQVTVGTLILQDCAVGLLFALLPILSGASGLLQGVASMAKSLVVLITFLTILSILSRTGVPWFLKLMISLSSQTNELYQLAAVAFCLLFAWCSDKLGLSLELGSFAAGVMISTTDLAQHTLEQIEPIRNFFAALFLASIGMLINVHFLWNHVDILLAAVILVITVKTFIVAVVVKGFGYSNKTSLLVGMSLAQIGEFAFVLLSRASSIHLIEGKLYLLLLGTTALSLVTTPLLFKMIPAVVHLGVLLRWFSVDSNQVELGLKSDGLRIDSGKRINLIVQGSHDS

SEQ ID NO: 6772 - protein, 394 aa, Mesorhizobium loti MAFF303099
MLHTISAFDRLGEENAFAVLARATALAQQGRDIVNLGIGQPDFKTPQHIVEAAIKALRDGHHGYTPANGLLATREAVVRRTLTTTGVEVSPEAVMILPGGKPTMFAAILMFGEPGAEILYPDPGFPIYRSMIEFTGAAPIPVPMREENGFAFSAEETLALITSKTRLLILNSPANPTGGVTPRAEIEKLVKGLEKHPDVAILSDEIYDAMTYDGETHCSLLGYPEIRDRLIVLNGWSKTWAMTGWRMGWSIWPNGDRGAHLYDKVRKLAVNCWSCVNAPSQFAGIAAIDGPQDDVDTMMRAFDRRRKVVVEGLNALPNISCITPKGAFYAFPNVSKTGWKAKKLASALLDDAGVALIGGPDFGILGEGYVRLSYANSEENILRALERIGAFLSK

SEQ ID NO: 6773 - protein, 252 aa, Prunus emarginata
AHYKSEADVGNALAEAFETGLVKREELFITSKASNHGHVVEACKNSLKKLRLDYLDLYLVHYPLATKHSGVGTTASLLDENKVLDIDVTVSLETTWHTMEKTVYLGLVRSIGLSNYEFFLTRDCLSYAKIKPQVSQFETHPYFQRESLVRFCKKHGVTPMAHTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 6774 - protein, 252 aa, Prunus emarginata
AHYKSEADVGNAIAEAIQRGLVKREELFITSNASNHGHVVEACKNSLKKLRLDYLDLYLVHYPFATKHSGVGTTASLLDENKVLDIDVTVSLETTWHTMETTVYLGLVRSIGLSNYEFFLTRDCLSYAKIKPQVSQFETHPYFQRESLVRFCKKHGVTPMARTPLGGATANVKAFGSISPLEDPVLLGLAKKYKKSVAQIALRWNIERDTAVIPKSSKVERLKENLEVLNFKLEKEDIELINTIDKKSRTTL

SEQ ID NO: 6775 - protein, 252 aa, Prunus emarginata
  misc_feature (193)..(193): Xaa can be any naturally occurring amino acid
  unsure (1)..(252): unsure at all Xaa locations
AHYKSEADVGNALAEAFETGLVKREELFITSKARHHGHVVEACKNSLKKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKXKKSVAQIALRWNLDRNTPVIPKSSKIERLKENLEVLNFKLEKEDIELINTIDKKSRTTL

SEQ ID NO: 6776 - protein, 152 aa, Capsicum chinense
MSTPARKRLMRDFKRLQQDPPAGISGAPYDNNIMLWNAVIFGPDDTPWDGGTFKLTLQFSEDYPNKPPTVRFISRMFHPNIYADGSICLDILQNQWSPIYDVAAILTSIQSLLCDPNPNSPANSEAARMFSENKREYNRKVREIVEQSWTAD

SEQ ID NO: 6777 - protein, 251 aa, Prunus emarginata
AHYKSEADVGNAIAEAIQRGLVKREELFITSKANHGHVVEACKNSLKKLRLDYLDLYLVHYPLATKHSRVSTTASLLDENKVLDIDVTVSLETTWHTMEKTVYLGLVRSIGLSNYEFFLTRDCLSYAKIKPQVSQFETHPYFQRESLVRFCKKHGVTPMAHTPSGGATANVKAFGSNSPLEDPVLLGLAKKYKKSVAQIALRWNIERDTAVIPKSSKVERLKENLEVLNFKLEKEDIELINTIDKKSRTTL

SEQ ID NO: 6778 - protein, 508 aa, Oryza sativa
MAVSSFSFLELLLSFLCFGFFYYYHVKSKQKNPVIPLQWPLVGMLPALLANCNHLHEWITSVLTVTPLNFRFIGPPSSDMRLFITSDPANIRHVFNTNFSNYPKGREFQEIFDILGDGIFSADGESWRRQRTKAQLLMSSPRFRAFVARYSRDKVEKALLPLLAHVAGTGDACNLQDVFLRLTFDTTTTLVFGVDPGSVAIDLPEVPFARAMDDAMTMLLLRHIVPLSWWRLARRLGIGYERKMPVAWRTMDRFVADTIAKRRAEKARTGIDDSADLLSSYINDDEEDAGTVDAFLRDTTINLMLAGRDTTGSALSWFFYLLTKNPRVLHKLLQELDSVKSTTAADGMVIFDPDETGRLVYLHAALCESLRLYPPVPMEHKGPAAADVLPSGHEVRPGDKIVVSLYAMGRMESVWGSDCMEFRPERWISDDGKLRYVPSYKFMSFNSGPRTCLGKDMAFVQLKTAAAAVMKNFEIEAVAGHVVEPKLSIILHMKNGFMVRVKRRLAVC

SEQ ID NO: 6779 - protein, 252 aa, Prunus emarginata
SSLQSEADVGNAIAEAIQSGLVKREELFITSKASNHGHVVEACKNSLKKLRLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVTPMAHTPLGGATANVKAFGSISPLEDPVLLGLAKKYKKGVAQIALRWNIERDTAVIPKSSKVERLKENLEVLNFKLEKEDIELINTIDKKSRTTL

SEQ ID NO: 6780 - protein, 397 aa, Clostridium perfringens str. 13
MILSRKAQNIGASLTLALTAKAGELKKEGIDVVSFGVGEPDFNTPKNIIEAATRAMEEGKTKYTATSGIVELKEAIARKLHDDNGLNYGTKNIIISTGAKQSLANVFMAILNPGDEVIIPVPYWVSYPELVKLSDGVPVFIETKKENDFKVTYDELKSVLSENTKAIVINSPNNPTGTVYSKKDLEVIAKFAEENDLIIISDEIYEKLIYGKEEHISIASLSEDAFKRTVVINGFSKAYAMTGWRIGYAACYNEELIKVMNNVQSHMTSNTNSIAQFAALEALNGDQETIKNMVKEFSLRRELMIELISEIEDLTFIEPKGAFYVMIDVSKVLKKANIKGSMEFANLLLKEENVVVIPGIAFGEDNFIRLSYATSKEEIIKGLKRIKEFVNKLMNRD

SEQ ID NO: 6781 - protein, 499 aa, Cytophaga hutchinsonii
MILDGWGLGTNPKVSAIAAAKTPFVDSLFVNYPHSKLEASGLAVGLPVGQMGNSEVGHMNIGAGRIVYQDLVKINLAVENNTLADEPAIKDAFNYAKTNNKKVHFIGLVSDGGVHSHVNHVKGLCNIANQYGLKDVYVHAFTDGRDCDPKSGLGFVKELQESMAKSTGKIASLVGRYYAMDRDNRWERVKLAYDVMVNGEGTHAADALKAIEESYAAGVTDEFIKPVVLVDANDKPIAKIEPGDVVICFNFRTDRGREITVALTQKDFHEQNMFKLDLYYVTMTNYDDTFNNVKVIFDKDNLSNTLGEVLQGASKKQIRIAETEKYPHVTFFFSGGREEPFKGEKRLMAASPKVATYDLAPEMSANEIKEKIVVELKSKDPDFVVLNFANPDMVGHTGVFEAAVKACEVVDSCTEAVVTTALENGYTAIVIADHGNADYMINEDGTPNTAHTTNLVPCILIDNEYKKPLKDGKLGDLAPTILALMGIEKPKEMTGESLL

SEQ ID NO: 6782 - protein, 326 aa, Debaryomyces hansenii CBS767
HKFLRGGPKNRSHVHSNTAYEILEDGMFVGILVNASEQERLDDGDEDLASSFRNELPTFDLMTKDTDAKKDFERYRFLDIAEPLMPQIMSAHWTKDFYLDQVHRPRHCSKGARVYPNSIVDILCSRVPWWAILIYSPIGIASFIVGKRSLAELGALNDIYKWLLIGCLFWTFAEYILHRFIFHMDRYLPDYNQTLFALHFAIHGVHHFLPMDPERIAAPPPMVLLLNFLLWYVSYATMGPAYGNIFYAGGFASFLWYEEFHISLHTNPEFYQFWTGWWSHHTEMKRYHLQHHYKNYDWGYGVTSKLWDFPFGTVLDSADANQVHSK

SEQ ID NO: 6783 - protein, 453 aa, Listeria monocytogenes str. 4b H7858
MEASLLKKNQSIELTIEDLTHDGSGVGKIDGYPLFIPNTLPGEKVTAKIIKLNKNYGFARMETIESVSADRVEPPCAVYSKCGGCSLQHLSYEGQLAFKRNQVEETMKRIGKLNVDVPETLGMENPWRYRNKSQVPVGFVNGKLTAGFYQKRSHAIIDMSTCLIHNEQGDFAVQKTREILAKYGTEPYDEQTGKGDIRHIMTRFAHTTGQLMIVLVTTKERMPFKEEIVRELVEQLELTSIVQNINPHKTNVIFGDRTKTLWGKDIIEDTIHGIRFAISARSFYQVNPIQTEVLYQQAIDAAELTGEETVIDAYCGIGSISLCLAKKAKHVYGVEIVDQAIQDARANAELNELANTTFETGKAEEVIPAWYKAGIVADVLVVDPPRKGCDEKLLETILAMKPKKVVYVSCNPGTLARDMKILTDGGYVAKKVQPVDMFPMTTHIEAVTVLHLN

SEQ ID NO: 6784 - protein, 337 aa, Synechococcus sp. WH 7805
MSTSRFANSTTTFDVVGIGNAIVDVLVQTDDAFLEQQGLQKGGMALIDEQQAEALYRSSGPGLETSGGSVANTMVGIAQLGGQVGFIGRVRDDQLGSIFSHDIRAVGARFDTPAATSGSTTARCLIYVTPDAERTMCTYLGASTQLEPDDLDLSMVKQTKVLYLEGYLWDSPAAKRAFIAAAEACKGEGGQVALSLSDGFCVDRHRDSFLELVNGHVDVLFANESEITSLYSTDDFDSALAQVKGCCSVAALTRSEQGSVVLSGSQRWDIPSYALGDLIDTTGAGDLYAGGFLHGYTQGLALETCGRIGSICAGQVVTQLGPRSQVSLKDLVAQHLS

SEQ ID NO: 6785 - protein, 165 aa, Oryza sativa
  misc_feature (60)..(60): Xaa can be any naturally occurring amino acid
  misc_feature (67)..(68): Xaa can be any naturally occurring amino acid
  misc_feature (72)..(72): Xaa can be any naturally occurring amino acid
  misc_feature (78)..(80): Xaa can be any naturally occurring amino acid
  misc_feature (84)..(84): Xaa can be any naturally occurring amino acid
  misc_feature (97)..(97): Xaa can be any naturally occurring amino acid
  misc_feature (99)..(101): Xaa can be any naturally occurring amino acid
  misc_feature (103)..(103): Xaa can be any naturally occurring amino acid
  misc_feature (107)..(107): Xaa can be any naturally occurring amino acid
  misc_feature (110)..(112): Xaa can be any naturally occurring amino acid
  misc_feature (117)..(117): Xaa can be any naturally occurring amino acid
  misc_feature (131)..(132): Xaa can be any naturally occurring amino acid
  misc_feature (135)..(135): Xaa can be any naturally occurring amino acid
  misc_feature (137)..(137): Xaa can be any naturally occurring amino acid
  misc_feature (142)..(142): Xaa can be any naturally occurring amino acid
  misc_feature (151)..(151): Xaa can be any naturally occurring amino acid
  misc_feature (155)..(155): Xaa can be any naturally occurring amino acid
  misc_feature (157)..(157): Xaa can be any naturally occurring amino acid
  misc_feature (161)..(161): Xaa can be any naturally occurring amino acid
  misc_feature (163)..(164): Xaa can be any naturally occurring amino acid
  unsure (1)..(165): unsure at all Xaa locations
FAKMKKGVRIINVARGGVIDEDALVRALDSGIVAQAALDVFTKEPPAPDSKLVLHENVTXTTHFVPXXLEHXEELLLXXXEAVXGALKGELAASAVXAXXXVXAEVXSEXXXLCCAXEKLGRLGCAASRLXXAGXSXSLKVXYASAGLLHXPVHXTXTAMXTXXF

SEQ ID NO: 6786 - protein, 398 aa, Colwellia psychrerythraea 34H
MCSNHGNRGVVYTGPGSVEIQDIAYPKLAIGNRKCEHGVILKVVTTNICGSDQHMVRGRTTAEPGLVLGHEITGMIIEKGSDVEFLDIGDIVSVPFNIACGRCRNCREGNTGICLNVNPGRAGAAFGYVDMGGWVGGQSEYVMVPYADFNLLKFPDKDQALEKIRDLTMLSDIFPTGYHGAVTAGVVPGATVYIAGAGPVGLAAAASSQLLGAACVIVGDMNPERLAQARSFGCETIDLRQDATVPDMIEQILGVPEVDAAVDCVGFEAHSHGCSHHKEQPAIVLNTMMEVTRAGGGIGIPGLYVTGDPGASTEAAKTGQLSMNFGLGWAKSHYFVTGQCPVMKYHRNLMQAILWDKVQIAKAVNVKVISLDGAPEGYNAFDKGAAQKFVIDPHSMVV

SEQ ID NO: 6787 - protein, 245 aa, Pyrococcus furiosus DSM 3638
MLKDSAPKRKILEELRKGETVSGDYLASKLGVSRVAIWKHIRELKELGYGIIADKKGYKLVYEPKKPYPWEIDVQSYYLKKTTSTMEVAKKLAEKGEKSFTVIIAEEQTQGRGKLKKKWESKPGGLYFSIILRPKIKLVDVKNLAPILSSAILNTLKKLGIEGNANDKGEIFVNGKKIGGILIEAKGELDIVEYVIIGVGINVNNDVTYPLATSLKKELGREVDLLKFSKDLLSNMLNALRGNFN

SEQ ID NO: 6788 - protein, 671 aa, Methanosarcina barkeri str. fusaro
MVSSLLANVDVLLGFAILILTIFYRFQVPPVLGFLVTGMLIGPYGLGILNGGQNELNADLGVIFLLFTIGVDLSLKELWKMKKALFLGGILQILLTTFLTLIICSSLGFSSATSVFFGFLISLSSTAIVLKVLQDRNEVYTQHGKTSLAILIFQDLAIVPLILITPLLAGDSLNFEGSLSTVFLKGSLVILVFILSAKFLIPYIFYHVGRTGNKELFLVSVVFICLSTALFTSSIGLSLALGAFLAGIVISGSQYSQQAMGNIVPLRDMFMSFFFVSVGMLLNVGYLLDHLPILILASIALIFVKSIAGVTITFLLGYPLRTAILAGLALSQVGEFSFVLSRLGVEYSLLTEETYQAFLAVSILTMGVTPFLINASYKPVDFLVTKVSGTTNGLKLIHGLYSEPIKEEEQAEPEMKDHLIIVGFGFSGRTVSKAAKAAGIPYIIVEANPETVIQEKQNGGNIHYGDATFEAVLEHAGVKSARVLIIGISDSTATGKIVEIAKKLNPNICIIAKVRDLQEMKRLNSLGADEIIPEEYETSVEIFVRVLEKYLVPRENIEKLVNDVRANDYRMLRKLSGNICDDSEFSIKEGLPGVDIQVLKVEDGSSFDGKALEDLNFRKKHGVTVLSVRRGSDLIYTPEGNFILQAKDACILLGKPEDLCNIRRFFESIHG

SEQ ID NO: 6789 - protein, 445 aa, Vibrio vulnificus CMCP6
MPATWSEQSEEDKPMTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDIERFKRFFHLMIDHGVYLAPSAFEASFTSLAHGSKEIEATLEAADRCFAILAAESK

SEQ ID NO: 6790 - protein, 531 aa, Magnetococcus sp. MC-1
MDILESIQIQDPAWIAVAFFFGLIFKKLHLAPMLGFLAAGFALNILGVSNDSFLNELADLGVTLLLFTIGLKLQLKSLARTEIWGTATAHMGIIVIATTLILLLLSLTAIQTFADLGWEEALIVAFALSFSSTVFAIKTLEGRGAMSAQYAHVSIGILVIQDIAAVIFLAASSGKVPSIWAVLLLALIPGRHLLGYILSQSGHRELLALFGFVTALGGAAVFELVGMKGDLGALVFGVLLANHPQAGELSKNLLGFKEIFLVGFFLTIGLSGLPTWETAIAALILLLIMPIKGALFYLLLTRLKLRARSATQSSAILTNYSEFGLIVAAIALNVGWLPAEWVTILALALSFSFLIASPLNSHADDLYEKIRGWLVRWERDERLPEDREIFITGNDLLILGMGKVGQAAYDEMSKQEQSKIMGIDVDHSVVMRNKAAGRNVVVGDASHPEFWSLFTDGHQGVKTVLLSMPNQQSNIIVADNLRKHGYQGSLVAIALYPDQEARLKEHGITQVYNVYNEVGLGVATHLLETKQ

SEQ ID NO: 6791 - protein, 509 aa, Arabidopsis thaliana
MGDFNLALVIVAIVVCVIVFISSIYLLVNYQHPDDANQAYFPKFVVVFGLSIAMISILMLPADVANRHACRHSIYNGACNLTLPMKDLWLAVYIVDAVLVFFIIPFAMFFYEGDQDKALGKRIKSALIWVVTTAVVCALVLGILYGVIGKVDFSVRHLSSATTTFPTSWQFSNNQPCIGNTARQCSAYTANAASEKTWSMRTTFPEYVVALATIVGSVLFTIFGGVGIACLPLGLITAFIRRPKAVITRSQYIKEATELGKKARDLKKAADALHQEERSGAKGRKWRKNVKAVEKELLQLEEDVNLLEEMYPQGEQAETAWAFTVLGYLAKFVLGILGLIVSVAWIAHIIIYLLVDPPLSPFLNEVFIKLDDVWGLLGTAAFAFFCFYLLLAVIAGAMMLGLKLVFITIHPMKWGATLMNSFLFNVGLILLCSISVIQFCATAFGYYAQATAAQEIFGHTLQSLRGIKYLYKYNVFQIGFVVLAGLTFLYYIAFGWRRKKPSGRFQLST

SEQ ID NO: 6792 - protein, 504 aa, Bacteroides fragilis YCH46
MSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDEFIKPIVNAGVDGTIKEGDVVIFFNYRNDRAKELTVVLTQQDMPEAGMHTIPGLQYYCMTPYDASFKGVHILFDKENVANTLGEYLAANGKKQLHIAETEKYAHVTFFFNGGRETPYDNEDRILVPSPKVATYDLKPEMSAYEVKDKLVAAINENKYDFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 6793 - protein, 669 aa, Burkholderia mallei ATCC 23344
MISPLEMTLLLLLASVVGVVVFRSLNLPPMLGYLTVGILVGPHALGFAADLERAEHLAEFGVVFLMFSIGLEFSLSKLRAMRRLVFGLGLAQVLGTIAIALVLGALFERWMHITWEGSVALGGALAMSSTAIVSKMLAERLEIETEHGRNIFGVLLFQDLAVVPLLIVIAAFGGESSKDLAMSLGFAAVKIVVALALLLIVGQRFMTRWLNVVARRRSQELFVLNLLLVTLGAAFITDRFGLSLALGAFIAGMLISETPYRHQVEEDIKPFRDVLLGLFFVTTGMLLDPSVIWRHPLLVLAFFVGQVLLKSVMITGLARAFGATPGVAMRTGLGLAQAGEFGFVLLNLILDRHLVDATLLQSILASMLLSMLAAPFLIQNADRIVMRLSAAEWMQQSLQMTRIATQSIKQKGHVIICGYGRAGQNLARMLEQEGIAYVALDLDPDRVAAAAAAGESVVFGDAARRESLLAAGIHRAAAVAVTYANTPSALRVLHNVHELEPTLPAIVRTVDDADLEKLLAAGATEVIPEIVEGSLMLASHTLVLMGVPMRRVVRRVEEMRDARYSLLRGYFHGADDADDDDHEQVRLQSVPVDARADAVGRSLSELGLFALGLEVTAIRRHGIRGVEPDPETKLRASDIVVLRGLPEALAQAEERLSRHRREGGSAAVA

SEQ ID NO: 6794 - protein, 89 aa, Brassica napus
MSSRSKAWLVAATIGAVEASKDQLGLCRWNYMIRSVNQRIRNNVRSAAQANRFSSSSTTVVDSGKDGDKAKQAEESLRTVMYLSCWGPN

SEQ ID NO: 6795 - protein, 644 aa, Xanthomonas axonopodis pv. glycines
MSTCPIDPPALRAAFAGPLDPQHAEVLLSRYDQHASRLLDALHALYGQRADYASWLAQWLGEVGDIARQRPQALQTLDSTRHAGWFGQPHMLGYSAYADRFAGTLQGVAERVPYLQELGVRYLHLLPFLRARAGDNDGGFAVSDYGQVEPSLGSNDDLVALTSRLREAGISLCADFVLNHTADDHAWAQAARAGDARYLDYYHHFADRTVPDRYEATLGQVFPHTAPGNFTWVDDTAQWMWTTFYPYQWDLNWSNPAVFGDMALAMLRLANLGVEAFRLDSTAYLWKRIGTDCMNQSEAHTLLVALRAVTDIVAPAVVMKAEAIVPMTQLPPYFGSGVDEGHECHLAYHSTLMAAGWSALALQRGDILHNVIAHSPPLPRHCAWLSYVRCHDDIGWNVLQHEACGNAAQPPFSLRDVARFYANAVPGSYARGESFQSSGDGVHGTNGMAAALAGIQAAQEAGDAAALAVAVDRLVLLYAIALAMPGVPLIYMGDELAMVNDPGYRDDPHRQHEGRWLHRPAMDWQLAAQRHDAKSLSGTVYRRLRGLIRQRAALGALAADQALASIALNDPRVFALTRGDSFIALHNFSDQLLDVELAAIGVDGWTLLAIDDAIGGAAARGDGSIVLPPYGVRWLQRGTEHAPE

SEQ ID NO: 6796 - protein, 251 aa, Mesorhizobium loti MAFF303099
MDMTTKANVLITGANKGIGLETARRLAAMGFNVWLGARDAERGEAAAKALRNEGLDVEWLALDVASDDSVAAAARTLTARVSSLDVLVNNAGIAPGYVDALGPDGRYERAPSRENVADMKATFDVNVFGPVRVTQAFLPLLLAAPAARIVMVSSYLGSIARAAGNSQSPNVMGYGSSKTALNAITVAFARELSPRGMMVNAAAPGYTATDLNAHRGTRTVQQAAEIIVQLAALKAGGPTGGYFDENGPLPW

SEQ ID NO: 6797 - protein, 334 aa, Xanthomonas campestris pv. vesicatoria str. 85-10
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRTRLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 6798 - protein, 314 aa, Zea mays
MSATGRAPCGLPRIGLGTAVQGPRPDPVRAAVLRAIQLGYRHFDTAAHYATEAPIGEAAAEAVRTGLVASREDLFVTSKVWCADAHRDRVLPALRRTLSNLQMEYVDLYMVHWPVTMKAGRFTAPFTPEDYEPFDMRAVWEAMEECHRLGLAKAIGVCNFSCKKLETLLSFATIPPVVNQVEINPVWQQRKLREFCRAKGIQLCAYSPLGAKGTHWGSDSVMDSGVLHEIAMSKGKTVAQVCLRWVYEQGDCLIVKSFDEGRMKENLDIVDWELSEEERQRISKIPQRKINQGRRYVSEHGPYKSFEELWDGEI

SEQ ID NO: 6799 - protein, 488 aa, Xanthomonas campestris pv. vesicatoria str. 85-10
MKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGERIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 6800 - protein, 328 aa, Bdellovibrio bacteriovorus HD100
MKKKILITDRFAQDSFLYLQQHSQFEVVRSDNPQHLPLEHLVSAHALIIRSRTKIDEELLKKARQLQLIVTCTSGFDHIDLEATQKWGVTVMHTPTANIESAAQLTWGLVLSCVNNIQAAHKMVKAGEWNRDQITGIELAGRNYGIVGLGRIGSRVAELAQAFGMNVVAYDPYQEDEVFERLHIPRLSYEEVLKTADVISFHVPKTLETEHMLNRSQFEYIHRGIVLINTSRGSVINENDLCEALEKGWLRSVGLDVYEKEPLNRNSNLLKYPNLVLTPHIGANTEDAFFKASQIAANKLMAFFVDGSTSDTLPPRAPWYGAAPFKGE

SEQ ID NO: 6801 - protein, 619 aa, Brucella melitensis 16M
MPHDTPLIATIVIGLCLAFIFGAIATRLKISPLVGYLLAGVIAGPHTPGFVADQDLILQLAEIGVILLMFGVGLHFSLKDLLSVKAIAVPGALAQIAAAAALGTGLGLALGWDVQAGMVFGLALSTASTVVLLRAMQERRLIDTERGRIAIGWLIVEDLAMVMALVLLPAIASVTGRAQGMAASDTIVTWLGLGIGGTILLTVAKVVLFIVLMLVVGRKVIPWLLNVVAQTGSRELFRLGVLAIALGVAFGAAHLFGVSFALGAFFAGMVMSESELSHRAAEESLPLRDAFAVLFFISVGMLFDPMSLLKDPLPLLGTLAIILIGKSVAAFFIVRAFRRPVSTALTISASLAQIGEFSFILAGLGVSLNLLPPAGRDLILAGAILSIFLNPVMFIVAERMRPWLEKRGATNLTADESNATEHNIAEPEPLPHTLLTGHTIIVGYGQIGGRLAAGLQEKEVPFLVIEDSPKICISLKEKGIETIAGNASNTEILEAANPGVARNLVIAIPNAFEAGRVTALGRAANSGLHIVVRACSQAEAQYLRDLGADSVILGEEEIAGAMANAIGADPRSERNEHVPAPIEVPAGPKENMPEKAEDTATDIVNENGGDMKREGMVIG

SEQ ID NO: 6802 - protein, 256 aa, Glycine max
  misc_feature (254)..(254): Xaa can be any naturally occurring amino acid
  unsure (1)..(256): unsure at all Xaa locations
MSEEAGSMLVVYDDPSDQRSLSLDDASSTEESPDETRLSLETTNDAIPYIGQRFATHDAAYEFYSEFAKRSGFSIRRHRTEGKDGVGKGLTRRYFVCHRAGNTPVKTSTESKPQRNRKSSRCGCQAYMRISKTTEFGAPEWRVTGFANHHNHELLEPNQVRFLPAYRTISDADKNRILMFAKTGISVHQMMRLMELEKCVEPGYLPFTEKDVRNLLQSFRKLDPEEESLDLLRMCRNIKEKDPNFKFEYTLDAXNR

SEQ ID NO: 6803 - protein, 330 aa, Mesorhizobium loti
MPDYDVLCIGNAIVDIIAQCDEEFLETNGIIKGAMNLIDTHRAELLYSRMGPAIEASGGSAGNTAAGVASFGGRAAFFGKVSNDALGEIYAHDIHAQGVAFDTRPLAGLPPTARSMIFVTPDGERSMNTYLGAATELGPEDVEADKASGAAVTYFEGYLWDPPRAKEAIRQTAKLAHAAGREVSMTLSDSFCVDRYRDEFLKLMRSGTVDIVFANSHEIKSLYQTASFDEALAQIRKDCKIAAVTRSEKGSVIVRGDETVVIQATAIKELVDTTGAGDLYAAGFLHGYTQGRDLKTCGDLGSLAAGLVIQQIGPRPRQNLRREAEQAGLL

SEQ ID NO: 6804 - protein, 93 aa, Zea mays
  misc_feature (85)..(85): Xaa can be any naturally occurring amino acid
  unsure (1)..(93): unsure at all Xaa locations
TYYATSSLLAPTVMMASSATAVAPFQGLKSTASLPIARRSSRSLGNDRNGGRIRCMQVWPAYGNKKVKTLSYLPPLSTDNLLKQXVDYLLHNR

SEQ ID NO: 6805 - protein, 483 aa, Pseudomonas aeruginosa UCBPP-PA14
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVTKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 6806 - protein, 633 aa, Oryza sativa
MATAAAASRAALSRPHAAAAAGRASPAAGARVTLPRRRSVRSAGISSSASAAAVAASEPAAGRVTLGAGTDGALWPKPAVLVAEKLSEAGLAVLRGFADVECAYGMSPAELLAKVAQLDALIVRSGTKVTREVLEAGRGRLRVVGRAGVGIDNVDLQAATEAGCLVVNAPTANTVAAAEHGIALLASMARNVSQADAALKAVYSRTLTVFTAQGKWQRTKYVGVSLVGKTLAVMGFGKVGSEVARRAKGLGMHVIAHDPYAPADRARAIGAELVSFDEAIGRADFISLHMPLTPATSKVFNDESFSRMKNGVRIINVARGGVIDEDALVRALDSGKVAQAALDVFTEEPPAKDSKLVLHENVTVTPHLGASTVEAQEGVAIEIAEAVVGALRGELAATAVNAPMVPAEVMSELAPYVSLAEKLGKLAVQLVAGESGGIKGVKVVYTTARGPDDLDTRLLRAMVTKGIVEPVSSTFVNLVNADYTAKQRGLRITEERVSHESPAAEAPLESIQVRLSHVQSKFAGAISDGGDIVLEGRVKYGVPHLTVVGPYEVDVSLEGNLILCRQIDQPGMIGKVGNILGQTNVNISFMSVGRTFRGKQAIMAIGVDEEPDKETLEHIGHIPAIEEFVFLEL

SEQ ID NO: 6807 - protein, 426 aa, Hordeum vulgare subsp. vulgare
MAAADTSRVFLILIIALVMVIVVLLGICWRFLGPGIMRRLLRPRRCPSEVPEYFSGNMSGNLRTITYFDYVTLKKATKDFHQKNQLGRGGFGPVYLGKLDDGRKVAVKQLSVGKSGQGESEFFMEVNMITSIQHKNLVRLVGCCSEGTERLLVYEYMKNKSLDKILFAAADAPAPASAPPFLNWRTRHQIIIGIGRGLQYLHEESNLRIVHRDIKASNILLDDKFQPKISDFGLARFFPEDQTYLSTAFAGTLGYTAPEYAIRGELTVKADTYSFGVLVLEIISSRKNTDLNLPNEMQYLPEHAWRLYEQSKILELVDGRVQGGEGFEEKEVMLVCQIALLCVQPYPNSRPAMSEVVRMLTMKTDQSIPAPAKPAFLDRKNLNGDRDAASSDTATMEMMRSPAGYWMMTPSPMLEVDRPYDMSFGK

SEQ ID NO: 6808 - protein, 323 aa, Coxiella burnetii RSA 493
MKNSQNHLAQIVALLNDRRFHPGTAIGQALNISRTAVWKTVQKLKKYEIPITADKSKGYRLERPFLLLDPQKIKNAVQAEPVRIDLFEQINSTNEYLKRVNHPQQLNICLAEMQTQGKGRFQRAWHSPFGQNIYLSLKYPFHKDVSELAGLSLVCGLAVCNAIEENCPLTKPIFVKWPNDIICEDKKLAGILIEIEAETHGFCSAIIGIGLNVNMEKEQDKINQPWISIKNLTATDQDRNQLCAALINQLVNCIDCFEKKGFNEFLASWKTKDYLLNKQIQLKSGRQELQGKSLGINPQGYLTVQLSDGSERIFSSGDTTLLK

SEQ ID NO: 6809 - protein, 1101 aa, Oceanicola granulosus HTCC2516
MTIADRKLLAAEPGATEADWYKDAVIYQVHVKAYQDSNNDGIGDFAGLMRRLDHVQELGATAIWLLPFYPSPLRDDGYDIAEFKAVNPQYGTMDDFQGFVDEAHRRGLKVITELVINHTSDQHEWFQRARRAPKGSPERDFYVWSDDPSRWMDKTRVIFNDTHDSNWSWDPVAEQFYWHRFFDHQPDLNFDNPKVLEEVLDVMHFWLDKGVDGLRLDAIPYLVERDGTNNENLPETHDVLKAIRADLDKHYENRMLLAEANQWPEDTRPYFGEGDECHMGFHFPLMPRMYMAVAQEDRYPITDIIRQTPAIPEDCQWAIFLRNHDELTLEMVTDRERDYLWNFYAEDRRARINMGIRRRLAPLLQNDRRKIELLNSLLMSMPGTPIVYYGDEIGMGDNYYLGDRDGVRTPMQWSADRNAGFSRANPQQLYLPTIQDPVHGYEAINVEAQQSSPTSLLNWVKRMIAVRQRHPVFGRGEIELLYPRNRKVLAYLRRHEGETVLCVANLSRQAQAAEIDLSEFSGRVPVELTAQSPFPPVGELPYLLTLPAYGFYWFLLADEEAAPEWHTPYTQMLPDFLTLTTRDGTIGSALRDASAAQFERQTLREYLPLQRWFAAKEERIGKVTMHKLAEMGQGRHMLSVVDVASSGGEARYFLPVSAVWGEDALTIGPRLPATLAKLRQANRVGAVLDGAVDEEMARTLLGAMVESTTMPASEGSIEFRGSPGLAELAADPGEPRLLSAEQSNASIAFSDKVILKLYRRLRGGVQPDIEVARFLTEETDFEASPALLGTLDWIAPDGTPTTLAAASEFVRNQGDAWRYVTEALERDMEREEMTEAASQEGDEEEAHVMGGPLDLGAVLGRRTGELHLALASGAPGSAFAEEPMGEDDLASLVDDVRGELADVFDRLAAHRDGLDETGRALADEVLDARGRFDARLEALRGLTPSGGRCRIHGDYHLGQVLVVETDVMIIDFEGEPTRSLAERQAKSSPLRDVAGMLRSFDYALWSTVRRRLELGADPERTLAGIEGWRAVTQGAFLDAYRETLGDASLRPDAEFEEALLDLFLIQKAAYEVAYEMSMRPDWIDIPLRGLLSLLGENGESS

SEQ ID NO: 6810 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 6811 - protein, 330 aa, Debaryomyces hansenii CBS767
MNVDTDIITLTRFILQEQQKEAPNATGELSLLLNSLQFAFKFIAHNIRRAELVNLIGISGSANSTGDVQKKLDVIGDEIFINAMKSSNNVKVLVSEEQEDLIVFEGGGRYAVCTDPIDGSSNIDAGVSVGTIFGIYRLKEDSQGSIKDVLRKGTEMVAAGYTMYGASAHLMLTTGQGVNGFTLDTQLGEFILTQPHLTIPKTRAIYSVNEGNSHYWADSAKQYIADLKKPQEDGKPYSARYIGSMVADIHRTILYGGIFAYPADSKLKNGKLRILYECFPMAMLMEQAGGAAINDKGERILEILPKGIHDKSGIWLGSTGEVDRYLTYLK

SEQ ID NO: 6812 - protein, 364 aa, Oryza sativa
MMMMMRRAFRHLARQQRRPLSHVPESAVYGGPRPQDVGAAAGAGAGAGATRRVTVTTLRGKHRRGEPITVVTAYDYPSAVHVDSAGIDVCLVGDSAAMVVHGHDTTLPISLDVMLEHCRAVARGATRPLLVGDLPFGCYESSSTRAVDSAVRVLKEGGMDAIKLEGGAPSRISAAKAIVEAGIAVMGHVGLTPQAISVLGGFRPQGKTVDSAVKVVETALALQEAGCFSVVLECVPAPVAAAATSALQIPTIGIGAGPFCSGQVLVYHDLLGMMQHPHHAKVTPKFCKQFGNVGHVINKALSEYKQEVETRSFPGPSHTPYKIAAADVDGFANALQKMGLDEAANAAAAAAENAEKDGELPENK

SEQ ID NO: 6813 - protein, 136 aa, Euglena gracilis
MSTTTPPPAKGGKDKKGAKAGVKKGKTGGSGQSKKAGLTFPVGRTGSLLRAGRYAKRVGKGAPVYLAAVLEYLSAELLELAGNASRDNKKKRITPRFLTLAVRNDEELNKLLSGVTIASGGVLPNIQQVLLKKKGK

SEQ ID NO: 6814 - protein, 466 aa, Leptospira interrogans serovar Copenhageni str. Fiocruz L1-130
MRSVTGFYPRKGKKGYNRFWLSNEGIEHEIVEYSEKEAFEDTANPIWILRHSLGVDQGEEDYSSYDFERYITADRKTDLEKFVTKKGIKDLVYKGLKVPIPASHYSHAVGPIHAGVIEPGHFRFIVKGEEIRSLDIRLGFQKRGLIDLIKGKGPKDSIPYAEAISGDSTISYAIAFSRIFEEAQNIAVPQELDFARLVLLELERVATHIGDMGAIAGDIGYYPLQGVCSLQRGIPLGVMEALTGNRFGRGALSPGKIFFRKGLDRNKLKELSERIRSVTEEVVGHFERAAGRSTNRERLQSCGVIRQKQVRHLGFIGMVEKCTGLNRDLRNLEKSYAFSSPISLELNRDQMRGDAWARFYLRYEELKNSSKWLVEAIPKLEAALDLKFGKSNPVKKGMYYSAVEGWRGPVLVSLDLDSNGTIENTYIREVSVPNWHALELAVRGEYIGDFPLNNKSFNLSYVGVDL

SEQ ID NO: 6815 - protein, 245 aa, Polaromonas sp. JS666
MNGSLAANAALLEALGEGLKDLSLPLTCEVAVCVPAPYLAQVQGLKSSRSSLSALAVGAQDVSAQASGAYTGEVSAAMLQDFGCRYVIVGHSERRQYHGESDALVADKAKAALAAGITPIVCIGETLAEREGGHTEEVVKRQLAAVIHVNGHCISEIVVAYEPVWAIGTGKTASPEEAQAVHAVLRAQLRAATDHPMRVKILYGGSMNAANAAALLSQPDIDGGLIGGASLKAPDFLKIIAAAQI

SEQ ID NO: 6816 - protein, 429 aa, Xanthobacter autotrophicus Py2
MLKDAAIVHDSHSPTPHLSLSKDKIKVLLLEGVNDSAVELLTNAGYTNLTRLPKALDGDALKEAIKGVHILGIRSRTQITPDVLEAADRLIAIGCFSVGTNQVDLDASRISGVPVFNAPFSNTRSVAELVIGEIVMLLRRIPTRSHAAHEGRWDKSATNSVEVRGKTLGIVGYGNIGSQLSILAEAMGLKVIFYDHTDKLRHGQAEPVSTLNALLAQSDIVSLHVPETAATHGMIGRAEIATMKPGAYLINNSRGTVVDLDALAEALKAGHLRGAAVDVFPVEPGSNAERFVSPLQGLDNVILTPHIGGSTEEAQERIGAEVARKLVDYSDTGSTMGAVNFPEVQLPARPTGTRFIQIHRNLPGMLGRLNEVLARHSVNIAAQYLETYADVGYVVLDADASTADSQSVLADIREIEGTIRARLLYERKI

SEQ ID NO: 6817 - protein, 389 aa, Coccidioides immitis RS
MSNQLVGIVFDRVIQEVCDSSQIDFEEGGVDQQTLEDLRKGWQKKLSSLGVAQFPWDPPPQPPPPPPQQAPIPPPPVTVPSNAPRTSPPPPQEFPEQIPQSQPPLAPANGSGQAAGEVRVKTEPGYPTTSTGIPTTAAHIAQQRAADALHQRYGAAAASQIHQLQAQSQAALSLPGQQRLQTSQFNGPQSQDPKVSQQGSQSNTVGNGQTDGAGDSEIDALSEWKAEVARRREEATKNGAQADRVMRKYVELRGLQMEGNGLLAPLHERYPRANGKKRKVTIKEESAIPGPSIASEATIPSQAGGYDGVDEFGIKKDEDEDAINSDLDDPDDLLDDPEGDDAVGQVMLCTYDKVQRVKSKWKCTLKDGILTTGGKEYVFHKGTGEFEWY

SEQ ID NO: 6818 - protein, 333 aa, Xanthomonas campestris pv. vesicatoria str. 85-10
MAIKVGINGFGRIGRNVLRSAAQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDSPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 6819 - protein, 470 aa, Bradyrhizobium sp. BTAi1
MTRRIIPLIMCGGAGTRLWPASREVRPKQFLPLFGTRSTFQDTLLRVSDADLFARPIIITNAAYRFMVLEQLAEIGIEADVLLEPMRRDSGPAIVAGAAFAQTRDQDAVVLALAADHVVRDSAAFLAACRAGLAAAETGLIVTFGINPERAATEYGYISPGAPVSGDVRAVAKFVEKPDQPTAERYIREGYLWNSGNFMFRAGVLLDEYRKSDAGSVQTVTDSVTKAGRDLSFIILESDAFAAAKPISIDYAVMEKTERAAVAPVSCGWSDVGSWHAVWELSDKDEQGNAARGTAVFEDSRNCNVVTDKALVALEGVDDLVVVAAQDAVLVSRQRDANGLKRLVAKLKTVAPEVTEAHIKVHRPWGSYQSVDNGERHQVKRIVVKPGQRLSLQRHYHRSEHWIVVRGAARVTVNETVKTVHENESIYIPMGAVHRLENPGKILLELIEVQTGSYLGEDDIIRLEDDYRRE

SEQ ID NO: 6820 - protein, 733 aa, Coccidioides immitis RS
MSLGALSTPAGGGSRQENSGLTALHRTPVTLASPTSNTTPNTYLMPTSPSKISRGSDGYRPTVKKSAGQVPACLVNASVTYCGNNQIYAFGGFDQYTDEVYNHVRRLDLNTLTWTLVNNYGDIPGVRMGHTASLYQDDKLIVFGGENERREYLSDIIILDLNTYTWTSPEVRGPIPRGRARHASVIYEDKLFVVGGVTGETNYILDEMCYLDLKTWTWSRTWSFVARFDHTAWVWGGRLWVFGGLGIDMERGTDLWWLDLKGNPSFMGTSAASQGTVGSPGMANRMTYSPDMHFSTPSQISGRPNGYAPNSGSVQVRSLGRRRPNAPGAVSSIKFHSGPYTPVLLSGTHFHVYSSGVLLDLVTPSETVRPWECNLSSLELDSLRWQRLADGPEIFKAGYRWHYCTVNEDGTKAWLLGCNLNVANAPGLGDENHLSEVLPIDLERYGVLGNESLNQRSLNVDSEHNSQLSSLGAELAAVFDQPPESGSGTDFIITADCDDPGYSSDEESSGMADSSQPTSTFLPPDAATSAPIHVHRIILQARWPHFKRLYAAQMAEYHTKRMHIPEPYKVVRAFLHYLYTDSISCHPELCPGVTEVAGMLVMANLYDMPRLRQLCVHRLSRELAVENAAIVWERAGRTNEEWLKRRAAVFCMANWGRIVRTEGFRSLNRQSLMELCEVVDTEGRVVGGHELEFTGSWGSDRYDPNGDMKRTRLPLLGDGEDIDGEEDDGMELT

SEQ ID NO: 6821 - protein, 389 aa, Rubrobacter xylanophilus DSM 9941
MKAVVWHGRQDVRVESVPDPELREPTDAIVRVTSTAICGSDLHLYGKLAPIMREGDILGHEPMGVVEEVGSGVEHIKPGDRVVVPFNISCGSCYFCNMQLYSQCERTRDRGRLAEAASLLGRGKGASLFGYTHVYGAVPGGQAEYLRVPQAHFGPIKVPEGPPDERFLYLSDVLPTSWQAVAYADVPEGGTLAVWGLGPIGQMCCRIALHRGAGRVIGVDAVPERLDLASRYGVETLDYSAVDRAGLAVVEMTGGRGVDAAIDAVGMEAGGSLVDAVLQATRVQLDRARALRECAASVRRGGTLSIVGVYAGPIQMFPLGDLFDMQVQLRMGQANVRRWTDEILPLLADEDPLGVEELATHRLPLEEAPRAYETFQRKQDGCIKCVLRP

SEQ ID NO: 6822 - protein, 238 aa, Brassica napus
  misc_feature (122)..(123): Xaa can be any naturally occurring amino acid
  misc_feature (165)..(165): Xaa can be any naturally occurring amino acid
  misc_feature (203)..(203): Xaa can be any naturally occurring amino acid
  unsure (1)..(238): unsure at all Xaa locations
MSSLICRSASKAARSLLSSAKNARFFSEGRAIGAAAAVTASAKIPLYASNFARSSSGSSKSWITGLLALPAAAYMVQEQEVLAAEMERTFIAIKPDGVQRGLISEIVARFERKGFKLVGIKXXVVPSKDFAQKHYHDLKERPFFNGLCDFLSSGPVIAMVWEGEXVIRYGRKLIGATDPQKSEPGTIRGDLAVVVGRNIIHGXSDGPETAKDEINLWFKPQELVSYTNNAEKWIYGDN

SEQ ID NO: 6823 - protein, 532 aa, Schizosaccharomyces pombe
MQTPSSASAESEKDSGNTYVGPWLLGRTLGQGNLAKVKLGKHFQTNEKVALKMVYNDELEDKDTWKRLQREVTILRQLHHPNIITLYQVFRVPKYTVLALEYMDTDLHSMVVKHNRLDECTTRKIFRQIVHAIDYCHLHRVAHRDLKLENILLNKDLVVKLTDFGLSNFMLDGSFLSTSCGTPHYAAPEVIQGRYYDGCDVDVWGCGILLYLMLVGEFPFEDVTISNVLSRVCKGIYTIPSFVSSSASDLIRQMLMVLPTSRIKVAEIMQHPWFIADLPTHSRLPSRTSSFSSKHRSVTFSPPDLAILFDPSITSPSSSVGQIPQPTDHSALSPSKPMSISGTESPNPDPASLCYSSYEDLYSATSWHSDMAESSGFLDPTDIPPIPSNVETLRSSLPQRHASFMNKVYNHPLSRPPAPNRLRSLRWHYGIQTAKNPIEVLRKLCEALLELGARFRPCDEESFLKENKYKVFSCITCHNSPVYLVIELFSIGPSASVIDIRFSSSDDSIKYTSSYSPMPFLEVVKQLILKIA

SEQ ID NO: 6824 - protein, 298 aa, Clostridium tetani E88
MGYVICYNKLTSERKINMDINWFPGHMAKTRRELKENLKMVDAIIEIRDARIVKSSANPEIENICGNKPRIILLNKSDLGEEKVTNEWIKALSGENTKVIAINSLKDSGMKKIKNAIDDLLKEKTEKLKAKGLKNIVNRVMVVGIPNVGKSTFINRMAKSSIAKTGDRPGVTKSRQWIKTKIGVELMDTPGILWPKFEDEKVGLNLAFTGAIKDEIMDIETLALNLIERLSEDYGENLKERYKLDKLEEIPLDNMENIAKKRGAILGRGEIDYNRVAIMILDEFRGGKLGRISLEKPE

SEQ ID NO: 6825 - protein, 560 aa, Oryza sativa (japonica cultivar-group)
MICFMAWFVAAWSCLLVVVMVSSMRLSRSASSSCGSSCGHGGWGPRSYPVIGCLVAFYRNRRRLLDWYTEMLAASPSQTIVVDRLGARRTVVTANPANVEHILRARFANYPKGKPFTDVLGDLLGMGIFNVDGELWHAQRKLVSHEFSARALRDLEVTVLEAEARDRLVPALAAASRGGGVVDMQDVLRRFAFDVICRVSLGVDPGCLDPALPAPRLAAAFDTAAGIIARRGAAPVAAVWKVKRALDAGSERRLREEVGVIHEAVMGLIRSRRKERALLLVNGNGVGGGGGARSDLLSRMIECGYPDEAIRDMVISFIMAGRDTTSSALTWFFWLLMRHRGVEAQVLDEIAATRRARGAGEEGGDDGEGEGLDLDDYRRMRVLHAALCETMRLYPPVAWDSKHAAADDVLPDGTAVGRGDRVTYFQYGMGRMEAIWGADAADFSLDRWLSLPRGGGDGAAAASPAAAAFAGVSPFKYPVFQGGPRTCLGKEMAFVQMKFVASAVLRRFELRPVDEGRTPAFVPLMTAHMAGGLNVTVRRRTPAPATSTAANGTGGELTSS

SEQ ID NO: 6826 - protein, 398 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWGQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMFLSGGQSEVEATLNLNAMNQAPNPWHVSFSYARALQNTCLKTWGGRPENVNAAQTTLLARAKANSLAQLGKYTGEGESEEAKEGMFVKGYTY

SEQ ID NO: 6827 - protein, 473 aa, Sulfolobus acidocaldarius
MPGLPKNEHEALEFLKSNNIKWVDLQFTDLLGKLQHITIPSNEFDESSFKVGFGKLDGSSIKGFTSIYESDMVLLPIPQTMTLIPWMQGVARVLTKVFWGGGKGRFERDPRGIAEEAEKYQSEQGYVSYFGPELEFFVFDKVEVDASLPQSGTGYKIHSREAPWSKNGGYVIRYKEGYYPASPVVQLMDIRLEIISTLVDYFGTIEAAHHEVATAGQGDIDFRFSTLADTADKVQVLKYVTKNIASKRGMIATFMPKPFFGDNGSGMHTHFSLWTKDGKNLMYDPNDEYAELSQIGRYIIGPLLEHGRALSAIVVAGTTNSYRRLVPGYEAPVYLVWSKSNRSAAIRIPAYYKGMEKAKRLEYRPPDPSSNPYLVFSAILMAGLDGIRRKLDPGDPVDENIYHMSEEKKRSLKIRELPGSLDEALNELESDNEFLKPVFNSSILQAYLDLKKEEAKMMQLYPHPMEIYQYLDS

SEQ ID NO: 6828 - protein, 277 aa, Anaplasma marginale str. St. Maries
MLLNILDIQAKKGLEKIACLTAYTFPMARILDEHCDLILVGDSVGQTVYGMESTLSVTLDMMIAHGKAVVKARSKALVVVDMPFASYYTPELAYKNASRILSETGCDAVKLEGGVCVAEEIAFLVARGIPVMGHVGLMPQHFNQLGGYKCQGKTDSSRQHIKEDAKAVCEAGAFCVVLECISPSLAAELTQELPVPTIGIGASNACDGQILVVDDMLGQSSRYPKFVKRFADLEHTIKDAVVGYVRAVKCSEFPGDEHCYSDGPHLRVFRAHPHHAQ

SEQ ID NO: 6829 - protein, 699 aa, Myxococcus xanthus DK 1622
MHGAHEVLQAIAVVLCVAAVTTVLFQKLRQPVVLGYILAGLVVGPYLPIPLVANPEVVTTLSELGVILLMFSLGLEFSLRKLFAVGPTAGVTAVIQCSIMIWLGFVVGRAFGWTTLESLFTGALISVSSTTIIAKAFDEQNIRGRLRELVVGVLIVEDLIAVLLMATLTAISSGTGLSVGELSLTTGRLVAFLVGLVVVGLFIIPRAVRYVVKLNKPETTLVASVGICFAVALLAQAFGYSVALGAFLAGSLVAESGEEKVVEHLVQPVKDIFAAIFFVSVGMLINPALIAEHWAAILVLTVVVIVGKLFSVTLGAFLTGHSTRTSVQAGMSLAQIGEFSFIIAGLGLSLKATGNFIYPVAVAVSAITTLTTPLLIRVSGPVASYVDRKLPKPLQTFVTLYGTWVERLRDAPRRQTFGASVRRLARLMVLDAVLLIVLVIGTSLTAGKLGSLIEQRLGIDENLSRYIILGGAVLLSIPFLVGVVQVARRLGEELAEAALPGRKDGRVDLAAAPRRVLLVTLQLGIILLVSVPVVAITQPFVRGAMGPLILLALIGALGVTFWRGATNLHGHVRAGAQVIVEALAAQSHSREPGADEHALDHVSKVLPGLGEPVPVRLETSSPAAGKTLAEVNLRGLTGATVLAIRRGDSSVSVPSAQEVLQPGDVLALTGTQDAVEAAKSLLTGAPAPTSEPEPTGAQV

SEQ ID NO: 6830 - protein, 237 aa, Prochlorococcus marinus subsp. marinus str. CCMP1375
MTDLQTQMKIAVAQEAIGEIKDGMILGLGSGSTAALMIKSLGEKLKEGSLKEIIGVPTSFQGEVLASQLGIPLRAFSAVSKIDLAIDGADEVDPNFQLIKGGGACHVQEKLVASIADRFVVVVDSTKIVEKLNLEFKLPVEVLPAAWKLVQKELNDLGAKSDLRMAEKKAGPIVTDQGNLVLDVQFADGISDPQNLEKQINNFPGVLENGLFVNLTDEVLVGEIKNGVSSVNRLKKA

SEQ ID NO: 6831 - protein, 304 aa, Triticum aestivum
  misc_feature (116)..(116): Xaa can be any naturally occurring amino acid
  misc_feature (203)..(203): Xaa can be any naturally occurring amino acid
  unsure (1)..(304): unsure at all Xaa locations
TRRLNGLATHGTSRSRTNSWISGDNKGAAARFMEDWAEQNGLPKQTGHANSVEFGPLHLPRRVSTIIPEPDEITDDLMQLASSYKATGGRILASSNITRRIRNTRGNNAKLVSAFXKSNCGDVSPNVWGAFGIDTNLPGDFNHSTCNGKNELGYGRGPGYPNEFESTRIMGNRQFLKAVDLFNSASEELQGKLDYRHTYLRFXRQLEVSVSTSTGSQQVVKTCPATMGFQLLLEHRWPGALIQTRRRQTYSNQIIGNWLVLENHDNGRKAVPMRKNVNGTMGINSHPNCLRVKISSKHPDKRHP

SEQ ID NO: 6832 - protein, 447 aa, Mycobacterium sp. JLS
MTLPRTRAIAALPPGPRLPPSVQTVLLMRSWSRFVAACRRRYGPVFTLRISSIGTMVYLADPADIKTVFAGDPRVYHAGEANAMLRGLLGDTSVLVIDDDVHRDRRRLMMAPFHREAVARQVEVMTEIAADNVSRWPVGEVFPVAPKMSEITLEVILRTVIGASDPARLAALRAIMPKLLQVTPWTTPALANPGLQRLPLWRSLRERIEEADRLLYAEIAERRADPELRWRTDVLAMLVRSAGEDGRTMTDRELRDQLMTLLVAGHDTTATGLSWALERLTRHPAVLTAAVRAADRSAAGDPSGDEYLDAVVKEALRIRPVVFDVGRVLTEPTEVAGYRLPAGVMVVPGIGLVHDDPAVYPEPDRFDPDRMLGASLTPTTWLPFGGGNRRCLGATFAMVEMRVVLREILRRAELCTTTAPGERRRVKHVIMVPARGARVRVRAMRPT

SEQ ID NO: 6833 - protein, 353 aa, Burkholderia mallei ATCC 23344
MTAIVCHAPEDYRVERVAKPRANARELVIRIGACGICASDCKCHAGAKMFWGGPSPWVKAPVIPGHEFFGYVEALGEGAAEHFGVALGDRVIAEQIVPCGTCRYCKSGQYWMCEVHHIFGFQREVADGGMAEYMRIPSGAIVHPIPLGISLEDAAIIEPLACAIHTVNRGDIQLDDVVVIAGAGPLGLMMTQVAKLKTPRRLVVVDPVEARRALARAYGADVTIDPAREDAPAIVRALTGGYGCDVYIETTGVPAGVTQGMALIRKLGRFVEFSVFGKDTALDWSIIGDRKELDVRGAHLGPYCYPVAIDLLARGLVTSKGIVTHGFSLDEWDEAIRVANSLDSIKVLMKPRG

SEQ ID NO: 6834 - protein, 1479 aa, Oryza sativa
MAGAAKASWMVAMSVGAVEALKDQGGLCRWNYALRSIHKAAKANAAGVSQGKKLPASAAAVAERRRAEKAEEGLRTVMYLSCWGPNCGYSLMGCIKDIPTLKGDNYAEWKRKLDLAFILGEVDWVLTTPCPIEPADLVRGENESDADWQKRQRDNAPLVMSYDIEQKKWSLANKKCLAVVKNTIEPTILGSIPECDAVSEYLERIKSQFTGSSKTYATQLIKQLVTERYHGGGVRDHILRMSNMASKLKPMDLGITDDFLVHLVMASLPKQFDNFIVNYNISPEKWNFEKLIANCVQEEERIKESNGGSINYVKDKKKNHKSPTSKGKQSQHLPQQQQFAVEKDQCLHCKKTGHYKKDCPDFLKMIMAKKGENIITFVNESHYVGYSRSTWWIDSGATIHACNCLKAFRSTRTTQRRESTIRVANGVEEKVEAVGDLPLELANGFILLLRDVFYVPSLQRNLISVSKLDFDGYDCRFGSGKCELWHNNACIGLAVLRDELYLLSLSENVNVVSSLTKENKKRKRTPDVSSKLWHCRLGHISRGRIERLVKNEILPPLEFSDLEQCIECIKGKFVKSIKKGAKRSAGILEIIHTDICGPFPVKSVDGYDSFITFTDDYSRYGYIYPIKERSEALDKFKIFKAEVENQHDIKIKVVRSDRGGEYYGRHTPYGQVPGPFARFLLENGIVAQYSTPGEPQQNGVAERRNRTLMDMVRSMMSYSTLPLGLWMEALKTAIHILNRVPSKSVPKTPYELWTGRVPSLTHLRVWGSPAEAKVFNPNIGKLDPKTVSCHFIGYPERSKGYRFYCPNSYTKFVETRHAVFLEDEMIRGSSVVREIDLEERRVSVPAPSTQEPFFSLPADVVPAMPVIEVPAPVVTPPVATMNESEEPVIQDSTEMVATPEEELQQPQIDNVPVQETHQEPQVQDVPNVQAPRRSERVRRSAIRDDYKVYNIEESHMEDDPTSYEEAMRSARSSEWLEAMKDEMKSMKLNDVWDLEEIPKGAKTVGCKWVYKTKYDSRGNIEKFKARLVAKGFTQREGIDYNETFSPVSCKDSFRIIMALVAHYDLELHQMDVKTAFLNGDLEEKVYMAQPKGFVMKGNENMGCRLKRSIYGLKQASRQWYLKFDGTIKKFGFQENVEDNCIYSKFKNGRFIFLILYVDDILLASSDVSLLQETKKFLSSNFDMKDLGEASYVLGIEIHRDRTKYALGLSQKTYIEKVLKKFNMYRCSATPAPIMKGEKYGASQCPRNQYELNEMKTKPYASAVGSLQYAQVCTRPDLAFVTGLLGRFQSNPGLEHWKLVKKVLRYLQGTKGLMLSYRRSESLQIVGYSDSDFAKDNTKSTSGYVFTLAGGAISWKSSKQTITAGSTMYAEFIACYEATGQVNWLKKFIPGLKVVDSIEKPLKLYCDNEPAVMYAHNNQSSGAAKHIDIKYYVVKDKVRDQTISLEHIKTERMLADPLTKGLPPNVFKEHVAGMGLREAL

SEQ ID NO: 6835 - protein, 446 aa, Staphylococcus epidermidis RP62A
MKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 6836 - protein, 330 aa, Nostoc sp. PCC 7120
MSWLFSTLVFFLTLLTAGIALYLITARRYQSSNSVANSYDQWTEDGILEFYWGEHIHLGHYGSPPQRKDFLVAKSDFVHEMVRWGGLDKLPPGTTLLDVGCGIGGSSRILARDYGFAVTGITISPQQVQRAQELTPQELNAQFLVDDAMALSFPDNSFDVVWSIEAGPHMPDKAIFAKELMRVLKPGGIMVLADWNQRDDRQKPLNFWEKPVMQQLLDQWSHPAFSSIEGFSELLAATGLVEGEVITADWTKQTLPSWLDSIWQGIVRPEGLVRFGLSGFIKSLREVPTLLLMRLAFGTGLCRFGMFRALRADTVRSSAEQTSAIKVAQK

SEQ ID NO: 6837 - protein, 257 aa, Zea mays
MASRKFFVGGNWKCNGTGEDVKKIVTVLNQAEVPSEDVVAEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 6838 - protein, 231 aa, Rubrobacter xylanophilus DSM 9941
MSPDGMERLKRAAAREAVDRYVESGMVVGLGTGTTASWAVRRIGERLLEGSLSGVRGVPTSEYTAALARECGVPLVSLSERRPELTIDGADEIAPDLSVIKGRGGALLREKIVAAASRRGVVIVADGSKQVSLLGNGPLPVEVEPFGWEATAEALAALGCEPELRRVKTQPFVTDGGHYTLDCRFPGIPDPPGLACKIKRVPGALECGLFVGLARAAVIARPEGVEVLEAA

SEQ ID NO: 6839 - protein, 416 aa, Thauera aromatica
MNAPAEHATIARQHLIDPEVCIRCNTCEEMCPINAITHDARNYVVKFDVCKGCLACISPCPTGAIDSWRNVDGTRSYTIEEQLSWDALPDTTEFDNFEATLGALSGEETPPEVQQITDVATAGQGGPELAPWSASHPYVNLYTPTRPLTATVSGNYQATADDASSDIHHIVLDFGATPFPVLEGQSIGIIPPGTDANGKPHLLRMYSVASPREGERPHHNNLSLTVKRVTEDHDGHPARGIASNYVCDLKKGDKVQVTGPYGSTFLMPNHPGSSLLMICTGTGSAPMRAMTERRRRRMEQKEGGELMLFFGARAPGELPYFGPLKKLPEDFIDINFAFSRVPDEPKRYVQDRIRERADKVFRMLTDDNAFIYICGLKGMEAGVLEAFRDICRAHGTDWEALRPELLAKGRFHVETY

SEQ ID NO: 6840 - protein, 414 aa, Azoarcus evansii
MNAPAEHANLARQHLIDPEICIRCNTCEEICPVDAITHDSRNYVVKFETCNGCLACISPCPTGAIDSWRNVDKATPHSLADQYSWDYLPDTTELDQFEATVMGAAELPAEVQQITEVATAGQGGPAMAPWSASHPYVNLYTPANPITATVTGNYRLTAEDASSDIHHIVLDFGTTPFPVLEGQSIGIIPPGVDEKGKPHLLRMYSVASPRDGERPHYNNLSLTVKRVVEDHEGNPTRGVASNYVCDLKKGDKVQVTGPYGSTYLMPNHPGSSIMMICTGTGSAPMRAMTERRRRRMDRKEGGELVLFFGARAPEELPYFGPLQKLPKEFIDINFAFSRVPGEPKRYVQDAIRERADKVFQMLQDDNCYIYICGLKGMEAGVLEAFRDICRAKGADWDALRPQLLSKARFHVETY

SEQ ID NO: 6841 - protein, 239 aa, Listeria grayi
MTKSALVTGANKGIGLETVRRLAGKGWKVVLGARDAEKGKQAVTELQAQGLDVAFLEIDLVDKESVESAVKIITQEYPDISLLINNAGMPGEFAKGFSKTTEEGLRNAFEVNFFGTFRLNQLLLPSLKGNGATIVNVSIDMASLSLMMDHQERTAALNSFDYNASKTANNAMTVSMALELKDSPAQVFAVTPGFTTTDLNNNAPGGITKEEAAGIILKHTLDGERHNGVFFDKNGVLAW

SEQ ID NO: 6842 - protein, 253 aa, Listeria grayi
MDKSTKVTLITGANRGMGFELAKEIGEFGHHILVGARSSESGSEATEKLKKLGINAAFIQLDVTDKASIEKATRKIAQDYGYLSVLINNAGIALDNFEQPTTMKTEIMRKDFDVNFFGVVDTTQAMLPLLKKSQQAKIINMSSIMGSLGAATDPGSRVYNASAVGYQASKAALNMFTIRLARELEGLEDSKITVNAVSPGMVATEFGGGDPEAAKKMGAKSVEEGVKRLVELATDEDNTTNITFSDTDGIVPW

SEQ ID NO: 6843 - protein, 250 aa, Malus x domestica
KIQTLEEQMSSVSEKSSKYGQIAAEEVPKSLYCLGIQLTSEWFRSPNIQRKIKDRKQIEMKLKDNNLYHFCVFSDNILATSVVVNSTSMNSKNPDKIVFHLVTDEINYAAMKAWFSINSFRGVAVEVQKFEDFTWLNASYVPVLKQLQDTDTQSYYFSGNSDDGRTPIKFRNPKYLSMLNHLRFYIPEVFPALKKVVFLDDDVVVQKDLSDLFSIDLKGNVNGAVETCMETFHRYHKYLNYSHPLIRAHF

SEQ ID NO: 6844 - protein, 481 aa, Bacillus licheniformis ATCC 14580
MNHENREQYTLKRTMKSRHLFMISLGGVIGTGFFLGTGYTINEAGPIGAILSYLAGGMIMYFTMLCLGELAVAMPVSGSFQTYATKFIGPATGFAVGWIYWLGWSVTVALEFLSAGQLMKRWFPDVGVWIWCLIFGLLLFSLNALSAKAFGESEFWLSGIKIIVILLFIILGGGAMFGLIDLKDGQAAPFFSNLIGDGIFPNGFGAIFITMITVNFAFQGTELIGIAAGESENPEKTVPRSIKQTVWRTLVFFGLSVFVLAGLIPWEKAGVVESPFVVVFEQIGIPYAADLMNFVILIALLSVANSGLYASTRMLYSLAKEGMAAQALSRVNKRGIPMNALWITLGFAGLSLISSVVAAETLYIWLLSLAGLSAQVGWITITVSQLLFRRRYVKEGGKVEDLKFKTPLYPYLPLTGFILNSAVLVSLAFDSEQRMALYCGILFMSACYFVYHVFVKKRQALDRQEAMIYQNKTNDEVVIDE

SEQ ID NO: 6845 - protein, 181 aa, Zea mays
  misc_feature (40)..(40): Xaa can be any naturally occurring amino acid
  unsure (1)..(181): unsure at all Xaa locations
MASSMLSNAAVATTVVNRNAGAQASMVGLKSVAAFPLTKXKSTNDLSSLPTNGGRVQCMKVWPTQNMKRYETLSYLPPLTTDQLARQVDYLLNNKWVPCLEFETEHGFVYREHHNSPGYYDGRYWTMWKLPMFGCTDPAQVLNELEECKKEYPNAFIRIIGFDSNRQVQCVSFIAYKPEGY

SEQ ID NO: 6846 - protein, 81 aa, Brassica napus
  misc_feature (45)..(45): Xaa can be any naturally occurring amino acid
  misc_feature (48)..(48): Xaa can be any naturally occurring amino acid
  misc_feature (68)..(68): Xaa can be any naturally occurring amino acid
  unsure (1)..(81): unsure at all Xaa locations
ILRPDGCTWKPWGRLEAWSESGYSSDALGYRFELFQDGIATAVSXRRXYSLKNGGSFVIDVTGGNTTXASTPTTSPQGSWD

SEQ ID NO: 6847 - protein, 482 aa, Prochlorococcus marinus str. MIT 9211
MTDRPLIPVILCGGSGTRLWPLSRASYPKQYWSLCGNENESLLQQTHKRLEGLPELEQPLLICHEEHRFIVAEQMREINIEPKEIILEPVGRNTAAAIAVAAIKATESGEDPQLLVLSADHEIRNVEEFQKSIAAGRIEAQKGKLITFGIIPTCAETGYGYIQAKEPIDHSNPKAVKINKFFEKPTQEKAEEFIANPCFSWNSGMFLFQASTILKELEKLAPKILKSCKSALQGELSDLDFLRLEKKAFSECPNLSIDIAVMEKTNLGTVLPLNAGWNDVGNWHSLWETASKDSNGNFSKGKVIIKRSKNCYFRSEHRLIVGLGVEDLILIETDDAVLVTNQKDAQSVKDIVNELEHKKLSESKAHRKIYRPWGHYTSIVEGKRWQVKRIEVKPGEFLSLQMHHHRAEHWVIVKGTALIERDGKEELLGENQSTYIPLGCKHRLGNPGKMPLELIEIQSGAYIGEDDILRLEDRYGRVNKNK

SEQ ID NO: 6848 - protein, 598 aa, Leptospira interrogans serovar Copenhageni str. Fiocruz L1-130
MLDHNLLINLIVFLSAAVISVPLFKKIGLGSVVGYLVGGTIIGPWGIGLITDVDSILHLSEFGVVLLLFLIGLELKPQRLWILRRPVFGLGGLQVILTSLTFFILFSLLGLEKRQAIVISISISLSSTAFALQVLGEKNELNTTHGRSAFAILLFQDLAIIPIMATLSFLTESSSNPGSHGSIKEILFPIGTIIAVILAGRFLARPLFKLVASSANHEIFTALSLLIVIGVSILMNQVGLSMALGSFLGGVILADSEYRHELESNLEPFKGLFLGLFFLAVGMSINLGEVLKDPILVILLAFILILVKTIILYFIGIITKHSKEVSLNLSTIISQGGEFAFVILGVGVSLSILPKERADLVIAVVTLSMGLTPILGILKDKTSKWILKEDQNIKEDTIEEQNRVIVAGFGRFGQIIARMLFVHKIGFTALEHNPDQVNLARKFGYKIYYGDASKLSLLRSAGAEHADLFILAIQDIDVSVKIAELIKKNFPNLTIIARARNREHVFKLMELGIQIIRRDTFASALELAGETLSQLGFIDSEVEKKVKKFRAHDELTLKGQFQIRGDEKEFIQFSKNSMRQLEDAFEADRQEKEGKIAG

SEQ ID NO: 6849 - protein, 558 aa, Zea mays
TREKEMAKKKEKAVNVSGKPRHSNDVNRPNDKKGAGGGAGGGSRSAATVRRLKMYKTRPKRDRAGKVLRNDFQSKELPNTRIEPDRRWFGNTRVVGQPQLEMFREELQSRLSDNFSVILKERKLPLSLLQDHQKQAKAHLLEVEPFEHAFGPKGKRKRPKLTALDYESLLKRADDSQDVFEQKYASSKLPREEEEDGLRDLVRHTMFEKGQSKRIWGELYKVIDSSDVVVQVLDARDPMGTRCYHLERHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLADAAEHIGEVLRRVKKEHLQRAYKIQDWSDDNDFLVQLCRTTGKLLKGGEPDLTTAAKMILHDWQRGKIPFFVPPPQQSDGGASESAEPIGITKEDGVSSDRTAAAMKAIAGIISSQQNMNVPCHKENNADNEDTTENADNEDIESSDNEDNDDIEPAERSE

SEQ ID NO: 6850 - protein, 60 aa, Oryza sativa
MALEQTFIMIKPDGDFAVDIGRNVIHGSDSVENARKEIALWFPEGIAEWRSNQHPWIYEV

SEQ ID NO: 6851 - protein, 571 aa, Arabidopsis thaliana
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKTCSADISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 6852 - protein, 840 aa, Prochlorococcus marinus str. MIT 9211
MSSSQPIDLRLPTPGCYADPIKAGIDADAVFDGMTEHLFFTLGKLATSASLRDLYMALSYAVRDRLMTRYLASQEAIRAKPHKTVAYFSAEFLIGPQLNNNLLNLGIQEEAEEAVKRFGIESLNDILEVEEEPGLGNGGLGRLAACYMESLASLQVPAIGYGIRYEFGIFNQIIRDGWQIEVTDKWLKGGWPWELPQPDESCFVGFGGRTENYIDDQGNYRSRWIPSEHAIGVPHDIPILGYRVNNCDRLRLWRADATESFDFYAFNIGDYYGAVEEKVASETISKVLYPNDGTDEGRRLRLKQQHFFVSCSLQDMIRSLETRNIPVEQFSENWTVQLNDTHPAIAVAELMRLLIDNHHFEWDQAWDITNRSVAYTNHTLLPEALEKWDLNLFKSLLPRHLELIYEINKRFLQQVRLRYPGNDLILRKLSIIDEEGSKAVRMAHLATIGAHNVNGVAALHSDLIKRQLMPEFADLWPEKFTNVTNGVTPRRWVALSNPELASLLDQEIGSNWITNMDLLTQLEEKENDSNFLDVFGATKLLGKRKLAGYIHRQTGILVDPSTLFDVQVKRIHQYKRQHLNALQIIAQYLRIKNGTAHSIAPRTVIFGGKAAPGYLMAKLMIRFINGIAEVVNADPDMDGKLRVVFLPDYNVKLGEQVYSATDLSEQISTAGKEASGTGNMKFAMNGALTIGTLDGANVEIRDRVGKENFFLFGKTESEIMKLRKNGYDPKQYIEKSPELSEAIRLIELGHFSNGDNELFRPLLNSLTGYDPFFVMADFDDYLLAQDRVSKAWQNHKEWNRMALLNTARSGFFSSDRSIREYCSSIWKVNPLEVEITCNIN

SEQ ID NO: 6853 - protein, 288 aa, Vibrio fischeri ES114
MSFCRYIYINGHVSIISFMTKIELLMKKITISDLNNWKEVGEKFASITAYDASFAKIFEEQSMPVIIVGDSLGSVIQGKPTTLDVSIEELVYHTKCVRAGSPNAFIISDLPFMSYHTPEAACGSAAKLMKAGANMVKIEGGSWLINTVKMLTERAVPVCAHLGLMPQAVNIYGGYKLQGKTEEQATKMLENAKELQRAGAQALILECIPAKLARQITLELHIPVIGIGAGNDTDGQVLVMHDILGISANYIPRFSRNFLAETGSIEAAVKKYIDEVKQQTFPGEKHCF

SEQ ID NO: 6854 - protein, 344 aa, Oryza sativa
MESGSYEGVLLGMGNPLLDISAVVDEAFLAKYDIKPGNAILAEEKHLPMYNELASKVNVEYIAGGSTQNSIRVAQWMLQIPGATSYMGCIGKDKFGEEMKKDAQTAGVNAHYYEDDNAPTGTCAVCIVGGERSLVANLSAANCYRSEHLKRPENWTLVEKAKYIYIAGFFLTVSPDSIQLVAEHAAATNKVFMMNLSAPFICEFFRDAQEKALPYADYIFGNETEARTFAKVRGWETENTEEIALKISQLPKASGAHKRITVITQGCDPVVVADDGKVKTFPVIVLPEEKLVDTNGAGDAFVGGFLSQLVQEKSIDECVRAACYAANVIIQRSGCTYPEKPDFN

SEQ ID NO: 6855 - protein, 173 aa, Fagopyrum esculentum
MADQHYYHQAKDHTSQAQQHGQQALSNMAGYLQEKTPPTQHIIAAAALIPLGGFMLVLAALTLTGTVIGLAVATPLFVICSPVLVPAALALGLATMGFIVSGALGLTALSALSWMISYIRQIRASGGPGIMGEARWRVAQGIDRLGEKTKDLGRGIQDRAYDARAHEVGRTTA

SEQ ID NO: 6856 - protein, 281 aa, Clostridium perfringens str. 13
MAINWFPGHMVKTKREIQNNLKLVDAVIEIRDARIPKSSKNPDIDTLCAGKPRVILLNKSDLTDPKVTKAWKDSLTNDETIVLEVNALKGEGLNAIKPALLKLLKEKHDRLKAKGLAKITTRAMVVGIPNVGKSTFINKMAKNNIAKTGDRPGVTKNKQWIKTKLGIELMDTPGVLWPKFEDEIVGLNLAFTGAIKDEIMDTEELALKLVERLQETNPEELMTRYKLTELHENPLDNLDAIARKRGAIMSGNQIDYNRIAGIILDEFRGGKIGKISLEKPE

SEQ ID NO: 6857 - protein, 458 aa, Listeria monocytogenes
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 6858 - protein, 439 aa, Selenomonas ruminantium subsp. ruminantium
MLNLTKSAAAFAEAKELMPGGVNSPVRSYKSVDCNPPFIDHALGDKIYDIDGNEYIDYVGSWGPMVVGHAHPKVVKALQEAATRGTSYGAPTCIESELAKLVMEVYPSIETIRMVNSGTEATMSALRLARGYTGREKIVKFIGCYHGHSDSLLVNAGSGMATFGVPSSPGVTKGTAQDTISVPYNDEEAITKVMEEVGDEVAAVIVEPVAGNMGLVLPKQGYVRKLRDLTEKHGALLIFDEVMCGFRASLGGAQAAYGITPDLTCLGKIIGGGLPVAAYGGRKDIMAKVSPSGPVYQAGTLSGNPLAMTAGLATLQIITAEPEDGKADYSRELTLKTKKLLLGWQEKAKAAGVAIQVHQAGSMFGIFFSEKDVLNYEDSCNADQEKFKVWFKSMLEQGVYLAPSQFETLFMSGAHTDEDIDRTIAAAEKAFAAVAAMEK

SEQ ID NO: 6859 - protein, 232 aa, Oryza sativa
  misc_feature (22)..(23): Xaa can be any naturally occurring amino acid
  misc_feature (28)..(28): Xaa can be any naturally occurring amino acid
  misc_feature (36)..(36): Xaa can be any naturally occurring amino acid
  misc_feature (44)..(44): Xaa can be any naturally occurring amino acid
  unsure (1)..(232): unsure at all Xaa locations
MASATLLKSSFLPKKSEWGATXXAAAPXPVTVSMVXRAGAYDDXLVKTAKTIASPLRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEV

SEQ ID NO: 6860 - protein, 405 aa, Cytophaga hutchinsonii ATCC 33406
MEQIKLDSIADAIEAIRKGEVIIVVDDEDRENEGDFICAAECVTPEIINFMSKEGRGLICAPISEARCTELKLDLMVGSNTATHETPFTVSVDLLGNGCTTGISASDRSKTIRALVDPDTKPEDLGRPGHIFPLKAKDEGVLRRVGHTEAAVDLARLAGFKPAGVLIEIMSEDGSMARLPELKQIATKFNLKLISIKDLIEYRLTHESLVKREIGVDMPTNLGDFDLIAFRQISTGEVHLALIKGTWEKDEPVMVRVHSSCVTGDIFGSCRCDCGPQLHKAMEMIQQEGKGVILYMNQEGRGIGLLNKLKAYKLQEQGRDTVEANLELGFKMDQRDYGTGAQILRDLNISKLRLITNNPVKRAALAGYGLEITEAVPIEIPSNPHNLEYLKTKRDKMGHTILKKD

SEQ ID NO: 6861 - protein, 111 aa, Brassica napus
MPQGDYIELHQKRHGRRLDYEERKRKKEARAVHKRSKQAQNSIGIKGKMIAKKNYAEKAQMKKTLKMHEESSSRRKADEDVQEGAVPAYLLDRENTSRAKVCLCFRVDDSW

SEQ ID NO: 6862 - protein, 455 aa, Prochlorococcus marinus str. MIT 9211
MSSLLSVLSTHDIEVAETLIGVIRFLLIFVAARTLAEILVRLSLPTIVGELLAGVLIGASGLHLLLPPSAHASLNEGFINVISSLASIPAEAVPDLYFETFPSLQAVATLGLYALLFLTGLESELEELVAVGAQAFTVAMAGVILPFAFGTFGLMFLFQVDLIPAIFAGASMTATSIGITASVFGELGYLKTREGQIVIGAAVLDDILGIVILAVVVALATGGALEIAPIVKLVLAATVFVIAAIALSRTAAPGFDWLLDRLKAPGAVVVASFVILVLSCFVATAIGLEAALGAFAAGLILSSSKNNHAIQQSVLPLVSLFATIFFVLVGAGMDLSVINPLDPSSRSALIVAGFLLVVAILGKIASGWSFVIDKPTNRLVVGLGMMPRGEVGLIFLGLGTSAGLLTPSLEAAILLMVIGTTFLAPVLLRLVLKDKKPGGGNSIPDEVAADPVGLI

SEQ ID NO: 6863 - protein, 430 aa, Cytophaga hutchinsonii ATCC 33406
MKNKTSAGLFSRAKEVIPGGVNSPVRAFRAVGGNPLFIKRAHGAYLVDEDDNQYIELINSWGPMILGHGNELIEKAVRDALSNSLSFGAPSRKEVEMAELIVSMVPSVEMVRMVNSGTEATMSAIRVARGYTGKEKIIKFEGCYHGHGDSFLIAAGSGAVTMGVPDSPGVPQGVANDTLTAPYNDIEAVRILVEKNKNKIAAIIIEPVAGNMGCVLPKAGFLEALREICDQENIVLIFDEVMSGFRLSVSGAQGVYGVQPDMTTMGKIIGGGMPVGAYGGKKEIMQNVSPSGPIYQAGTLSGNPIAMSAGLAILQYLQASPALYTQLNDQTDYLIHGMRKANNLLGLDYTFNHVGSMFTMFFTNIGVYDFETAKKSDLSKFAAYFQAMLSRGIYLAPSQFESLFISSAITKQLADQIIQAHAESMKEIHN

SEQ ID NO: 6864 - protein, 268 aa, Populus alba
RATMIMRLKTKIQTLDEQMAAVSEKSSKYGQIAAEEIPKGLYCLGIRLTTEWFGNSNLHRRMNERMHIETKLRDNSLYHFCVFSDNILATSVVVNSTTLNSKNPDMVVFHLVTDEINYAAMKAWFSMNTFRGVTTEVQKFEDFKWLNASYVPVLKQLQDSETQSYYFSGHNNDGQTPIKFRNPKYLSMLNHLRFYIPEVFPALEKVVFLDDDVVVQKDLSGLFSIDLNSNVNGAVETCMETFHRYHKYLNYSHPLIREHFDPDACGCA

SEQ ID NO: 6865 - protein, 268 aa, Cytophaga hutchinsonii ATCC 33406
MKIAILGGGNMGMTYAKAFVSRKIVSKDELLIIEKHDEKREQLKQEGVASLSADIDDSIKNYDILIVAVKPQDFRVLSETLKKYLTENQMILSIMAGIQIAQIQTLLEHKNVVRAMPNTPAQLGFGITAFTVAKDASFENISVVDMLLETTGKAIFMKDETMLDAVTALSGSGPAYFYYIVQNMIEAGKQMGVDENVAGMLVKETMMGAFQILNHSKSSIDELIAMVASKGGTTEAALNTLKQREVGAHIIEALKNAEKRAKELSGNA

SEQ ID NO: 6866 - protein, 268 aa, Populus alba
RATMIMRLKTKIQTLDEQMAAVSEKSSKYGQIAAEEIPKGLYCLGIRLTTEWFGNSNLHRRMNERMHIETKLRDNSLYHFCVFSDNILATSVVVNSTTLNSKNPDMVVFHLVTDEINYAAMKAWFSMNTFRGVTIEVQKFEDFKWLNASYVPVLKQLQDSETQSYYFSGHNNNGQTPIKFRNPKYLSMLNHLRFYIPEVFPALEKVVFLDDDVVVQKDLSGLFSIDLNSNVNGAVETCMETFHRYHKYLNYSHPLIREHFDPDACGCA

SEQ ID NO: 6867 - protein, 175 aa, Triticum aestivum
MAPTVMASSVTSVAPFQGLKSTAGLPVSRRSNGASLGSVSNGGRIRCMQVWPIKGIKKCETLSYLPPLRTEALLKQVDYLIRSKWVPCLEFSKVGFIFREHNASPGYYDGRYWTMWKLPMFGCTDATQVINEVEQVRKEYPDAYFRIIGFDNMRHVQCVRFIAFKPPGCDESVKD

SEQ ID NO: 6868 - protein, 471 aa, Escherichia coli
MLLPVIMAGGTGSRLWPMSRELYPKQFLRLFGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 6869 - protein, 737 aa, Coccidioides immitis RS
MASIPHDEILTTSAALPAAESGAARPDSPPKLKGRRRLLNRLQRMTSSPSLEQTGRSRSSSTGVRRLGKGSMSCISLSSTLSHGQCWESSSSSQFYGKFSGKPHGDDTGPIRVVETELISANGSQQTTIPLPAEMRPCSRGSLLRSAVAVLEDGENTPDTKGEKLLKMQNKNYWDYLPVEIQLRILSWLMPKELGKVACVSRSWRQLCFDGQLWAKFDTSTYYSDIPRDALVRLIFSAGPFIKHLNLRGCIQMAEAWFQCGEQIADACRNLVSVNLEGTHIDKPTITYFLVRNPKLVRISMTGLATVTNSEMNVISKSCPLLEYLDISWCRNLINANGLRRVVRACHRLKELRIDEFRAVDDEEFMLELFQTNTLETLVMSHCSSLTDSALKALLHGKNPEIDILTGRPIAPPRKLKHLNLSHCQGVSDFGIGHLAGFVPELESLQLSFCPALGNDSIINLIGTTPNLTRLDLEELEELTNNVLLALSKAPCAARLEHLNISYCEKLGDTGMMQIVKNCPNLKSLDLDNTRVSDLTLIELCSQMRKRGFGMQPPRCGLRVAVFDCGNVTWAGIREILSNNTFVPRYAEAAVLASRAEEEEESGSGSSSPSSSTTSVTILPSPPPETTQCKADLYPNEIIQLKCFYGWQTTVDIHTKRVLNGNLGAAMRLERRWTDCMMTNEEAEAGGIGARRRRRRARNAEMMYNLDDDDDADYGWSIHRKLGNMRERDRVRLASIS

SEQ ID NO: 6870 - protein, 472 aa, Staphylococcus epidermidis ATCC 12228
MPHIIFLTFLYVGGKKLETIKKNEVKTGKVIDLTHEGHGVVKVDRYPIFIPNALIDEEIKFKLIKVKKNFAIGKLIEVISESDDRVTPPCIYYAKCGGCQLQHMTYRAQLDMKREQVVNLFHRKGPFENTVIKETIGMVNPWRYRNKSQIPVGQSNSNQVIMGFYRQRSHDIIDMDSCLIQDRQHQEVMNRVKYWLNELNISIYNEKTKTGLIRHLVVRTGYHTDEMMVIFVTNGATFKQSELLVNKLKKEFPNITSIKQNINNSHSNVIMGRQSMTLYGKDKIEDQLSEVTYHISDLSFYQINSSQTEKLYQQALNYAQLTGKEIVLDTYCGIGTIGLYMAPLAKHVYGVEVVPQAIKDAEDNATKNQLKNTTFECGKAEDVILTWKSQGIKPDVVMVDPPRKGCDETFLTTLLKLNPKRIVYISCNPSTQQRDAQILAEQYELVEITPVDMFPQTTHIETVALFVRKEEE

SEQ ID NO: 6871 - protein, 733 aa, Frankia sp. EAN1pec
MGSRRTSANVVPGAGPIVIVDRAHVAAALPGYELGDQIGAGAFGLVLAGWHRRLGRDVAIKVLAARDRSGLTASFAAEAQILASLDHPHIVRVYDYVETDDLRLIVMEMLAGGTLTRHQASISQPGACAVGLAAAGALSCAHSRGVLHRDIKPDNMLFDAAGLIKVADFGIAKLVSGSAATASSVVGTPLFMAPEQIAGGRLGPTTDLYALGVVLYLLLAGTRSFGPAAATQPPWPNPIDQHILPPPIGVPEPVATVVLRMLSPVPADRPPSAHAFAVDLAQAAATAYGPGWIATAGVSLRLDDDVRAAAERPARLTRLPPSSAADDMSPSHPADSSPEDGPASESVASRGRHARSHPRLASSPRHRLAAGVVLLLLAVAGTVLIPVAARSGNPNEPSSHPVALGASAKETPAPAAQALGQPLTDHTDWVASVAFSPDGHTLASSSKDTTVRLWDITDRTRPHPLGQPLAGHTLGVMSVAFSPDGNTLASSSRDTTIRLWDITDRTRPHPLGQPLTGHTDAVTSVAFFSDGRTLASSSRDTTIRLWDITDRTRTRPLGSPLSGHSDWVTSLALTMDGRTLASSSLDSTVRLWNMADRSHPQPIGLPLTGHTGGVNSVAFSLDSRTLASSGRDTTIRLWDVTDRSTPRLLGAPITGHANTVGPLTFSQDGDTLVSGSYDDTVRIWDVTDRSHPRLLGLPLTGHTDWIWSVALSPDGQTLASGSKDNTIRLWALP

SEQ ID NO: 6872 - protein, 636 aa, Neisseria polysaccharea
MLTPTQQVGLILQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 6873 - protein, 382 aa, Medicago truncatula
MLTQKMADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTSAEREIVRDIKEKLAYVALDYEQELETAKSSSSIEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 6874 - protein, 507 aa, Yersinia pestis
SGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 6875 - protein, 337 aa, Oryza sativa
  misc_feature (91)..(91): Xaa can be any naturally occurring amino acid
  unsure (1)..(337): unsure at all Xaa locations
MGKIKIGINGFGRIGRLVARVALQSEDVELVAVNDPFITTEYMTYMFKYDTVHGQWKHHEVKVKDSKTLIFGTKEVAVFGCRNPEEIPWGXAGAEYVVESTGVFTDKDKAAAHLKGGAKKVVISAPSKDAPMFVVGVNEKEYKSDVNIVSNASCTTNCLAPLAKVINDRFGIVEGLMTTVHAITATQKTVDGPSMKDWRGGRAASFNIIPSSTGAAKAVGKVLPALNGKLTGMAFRVPTVDVSVVDLTVRLEKPASYDQIKAAIKEEAEGKLKGILGYVEEDLVSTDFQGDSRSSIFDAKAGIALSDTFVKLVSWYDNEWGYSTRVIDLIRHMHSTN

SEQ ID NO: 6876 - protein, 486 aa, Listeria monocytogenes
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 6877 - protein, 170 aa, Triticum aestivum
  misc_feature (114)..(114): Xaa can be any naturally occurring amino acid
  misc_feature (130)..(130): Xaa can be any naturally occurring amino acid
  misc_feature (137)..(137): Xaa can be any naturally occurring amino acid
  unsure (1)..(170): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDCRYWXTMWKLPMFGCTDATQXINEVEEXKKEYLTRTSHIGFTTSQVQCSTQCLKHGLQDPG

SEQ ID NO: 6878 - protein, 397 aa, Clostridium tetani E88
MLSKKGKEISPSVTLAITAKANEMKKDGIDVVGFGAGEPDFNTPENIQNAAIKAMREGYTKYTPVSGVVELKDAIVNKFKKENNLIYKSSQIIVSTGAKQCIANLFMAILNPGDEVLISAPYWVSYPELVKLADGVPVFVDCKKENDYKYSIDELEKRVSSKTKAIIISSPNNPTGSIYYEEELRDIAEFCKKHNLIILSDEIYEKLIYGHNKHISIASLNEDTYNRTVVINGVSKTYAMTGWRIGYAAGPGNVIKLMNNIQSHMTSNPNSIAQYAALEALTGEQESINSMVSEFEKRRNYMVERINSINGIECIEPKGAFYMFADINKVIGKKINGEEIKNSVDFCEKLLELYKVAVVPGAAFGLENHIRLSYAISMENIEKGLDRISNCVSELQS

SEQ ID NO: 6879 - protein, 393 aa, Prochlorococcus marinus subsp. marinus str. CCMP1375
MSNLDVISERALSLKPSLTLEISSLAQSLKQKGRDICSLSAGEPDFDTPNFIVEAAKKALDDGITKYGPAGGDPSLREEVAKKLTEINDVPTSPENVLITNGGKQAIFNLLQVIINPGDEVLIPSPYWLSYPEITKIAGGIPITINSSKGNSFSLDIEEIEKNINHKTKLLILNSPCNPTGRIIQESELQSIANLLRKHPNIYVMSDEIYEFLITDKEVHISLASIAPDLKDKIFIVNGFAKAWAMTGWRVGYLQGSSKIIKKAIALQSQSTSNVCSFAQRGALAAIKGAPKGIDYMIQSYNERRKLLTEELRQISSLSLEAQSGAFYAFPKLSDELPDSLSFCKIALEKEGLAIVPGIAFGNDRCIRLSCSVNTETLNDGITRLNRIIKDIT

SEQ ID NO: 6880 - protein, 275 aa, Trichodesmium erythraeum IMS101
MAITKLGLIGGGVMGEALLSRLIKQNVYLPSEILVSDPQQQRRNLLTQEYGVQVTTDNSLVVTSTTEVLLLAVKPQIFDSVVSQLGDWQVAGKTTTLPLLISIMAGVPLQKLEAFFCGQPVVRVMPNTPATVGVGMSAIALGKNVQPSHRELATCILASIGQVVEVSESLMDAVTAVSGSGPGYVTIFIESLTDGGVRAGLPRAIAYQLALQTVLGTAVLLQESGMHPAQLKDRVTSPGGTTIAGIAELESAGFRSAIIEAVLAAKEKAEELGNS

SEQ ID NO: 6881 - protein, 490 aa, Corynebacterium glutamicum ATCC 13032
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 6882 - protein, 261 aa, Pyrococcus furiosus DSM 3638
MKVAVIGAGTIGSAVAKALAESNYEVIATRRSIEKVKWLEKYGVKLEKDNKKASREADIVIIAVKPNKVGKVLEEIKEEVESKIVISLAAGIPIKLLKRFANAKFVRAMPNIAVLVKESFTAYATEDLSEEEIRTVEKIFESFGKYIRIDEEYMDAITGLSGSGPAYVSVFLEAMIYGGLRVGLPRDIAKLAAAQTLLGTAKLLLNFEGHPAEIRDMVITPGGTTIDGIFELEEGKIRTTIMKAIDAATKKSKILSTRLSP

SEQ ID NO: 6883 - protein, 165 aa, Zea mays
  misc_feature (14)..(14): Xaa can be any naturally occurring amino acid
  misc_feature (26)..(27): Xaa can be any naturally occurring amino acid
  misc_feature (134)..(134): Xaa can be any naturally occurring amino acid
  unsure (1)..(165): unsure at all Xaa locations
MCQDRCIRVMPNTXTAAVESASVMSXXTGAANEYGAIAAMLWDAEEKLLKRDEKTFDAVTRLSRSGPAYISLTSEALADGGVAAGISRELALSLASQTVPGSATMFSKSGKHAGVLKDDVTSPGDTTISGVHEXEKASSRATPINAVVDAVTRNRELSQNSMIHM

SEQ ID NO: 6884 - protein, 348 aa, Prochlorococcus marinus str. MIT 9211
MEQKGINNHEKEIDVVAIGNAIVDVLVYESDSFLEKNSLTKGSMALIDEDEANKLYKSCGPGLETSGGSAANTMAGLSQLGGKAGFIGRVKKDQLGEIFTHDICSTGAIYTTPAIVKGPSTARCFIFVTPDAQRTMCTFLGASVFLNPADLDLSLVRKTKVLYLEGYLWDHDEAKNAFITSAKECKLAGGKVALSLSDSFCIDRHRESFQNLVENHVDILFANESEIISLYESNDFESAKNIIKGKCEVSVLTRGKDGSLILHRSKEYIVRPYKLGELLDTTGAGDIYAAGFLYGYTNNKDLYTCGKIGSFCAGHIVTQLGPRSRESLVKLLDEQLHLKDVNNPKEID

SEQ ID NO: 6885 - protein, 613 aa, Oryza sativa
MLEKEGKLIMSREDEEIMAWFERTTRDAADVQRETLRRILAENAGVEYLRELGLAGLTDAGSFRARVPVVTHADLDPYIQRVADGDASPVLTAKPVTAISLSSGTTQGKRKRLLFNDDLLRSSIRFFHASYAFTNRAFPVEDGRVLQFMYGSRHETTKGGLTATTVMTNLLRSEEFTASMAARSRPRLPSCSPSEVVFSPDFDESLYCHLLCGLLLAGEVRAVSASFAHSIVVALQALERVWRELCADIRRGAASPARVTTPAVRRAVAPILAAPNPALADALERRCAALGDWSGVIPALWPNARYVQATMTGSMEHYVKKLRHYAGGVPLVSGNYASSEGVIGINAEQHAPPESVVFTVLPDAAYFEFIPLKPPCTDAAADDDNPAAAGSSCYVDADDANPVGLTDVVVGEHYEVVMTTFTGLYRYRLGDVVKVAGFHHATPKLRFVCRRSLILSINVDKNSEHDLQLAVDSAAKILAGDGENHKQLEIADYTSHADTSSDPGHYVVFWELNGGGEEDGGGVLQRCCDEMDRAFGADAGYAQSRKTCAIGALELRVLRRGAFQEVLRHYVAGGSSAGQFKMPRCVAPSNAGVLRVLKDNTINIFFSTAYDYD

SEQ ID NO: 6886 - protein, 435 aa, Xanthomonas campestris pv. vesicatoria str. 85-10
MSEFRQATDAFASNPVESKQEIRNYTMNFGPQHPAAHGVLRLILEMDGETVVRADPHIGLLHRGTEKLAESKPFNQSVPYMDRLDYVSMMCNEHAYVRAIESLMGIEAPERAQYIRTMFDEITRIKNHLMWVGSNALDLGAMAVMLYAFREREELMDVYEAVSGARMHAAYYRPGGVYRDLPDRMPQYKESRWHKGGALKKRNAGREGTMLDFLEEFTNTFPARVDEYETLLTDNRIWKQRTVDVGIISPDLARAWGMTGPMLRGSGIEWDLRKKQPYAKYDAVDFDIPVGTNGDCYDRYLVRVAEMRESNRIIKQCVKWLKANPGPVMVTNFKVAPPSREGMKDDMEALIHHFKLFSEGYCVPAGETYSAVEAPKGEFGCYLMSDGANKPFRVHLRAPGFAHLSSMDAVVRGYLLADVVAMIGTYDLVFGEVDR

SEQ ID NO: 6887 - protein, 114 aa, Striga asiatica
FQPSMIGMEAAGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 6888 - protein, 296 aa, Bacillus clausii KSM-K16
MNLNKDIATPARTNAILKKHGFTLKKSLGQNFLIDLNILAKIVEASGFDEQDGIVEIGPGIGALTEQLAKKADKVVAFEIDGRLIPVLEDTLSAYPNVKIIHSDVLKADLPGVLDAEFSKGQAIHVVANLPYYVTTPILMKLLEDRLPFKSITVMIQAEVAERIAAKPGSKEYGALSIAAQYYAEAKPMVVVPASVFVPQPRVDSSVLKLTIREKPLVEVIDERWFFNVFHASFANRRKTILNNLVHNLAGKDAKAAIEQALSEAGIDPKRRGETLSPQEFARLSDALYSTLRKAD

SEQ ID NO: 6889 - protein, 197 aa, Ipomoea nil
CNFSACAVGNRVVLFGGEGVNMQPMNDTFVLDLNSSNPEWKHVKVGSPPPGRWGHTLSCVNGSHLVVFGGCGTQGLLNDVFVLDLDAKQPTWREISSLAPPLPRSWHSSCTLDGTKLIVSGGCADSGVLLSDTFLLDLSMEKPVWREIPVAWTPPSRLGHTLSVYGGRKILMFGGLAKSGPLRFRSSDVFTMDLSEE

SEQ ID NO: 6890 - protein, 543 aa, Synechococcus sp. WH 8102
MDQSSGKGSGRDVGVAPVVLTILDGWGHRNDSEHNAIRQGDTPVMEALWHAYPHALIQASGSHVGLPDHQMGNSEVGHLTIGAGRIIRQELVRISDTVRDDQLNNTPALVELAEHLQNDTGTLHLLGLCSDGGVHSHVNHLCGLIHWAAAAGIKKVAVHAITDGRDTPTQSAMGSITLVQRAMEEAGVGHLASLCGRYWAMDRDKRWDRTEKAYDLYTDPTRSISDQSPQQLLAESYAAGITDEFLKPVRLSDDVMQDGDSVLVFNFRPDRARQIVQTLCLDDFDGFERRTTPKLDVVTFTQVEQDLPVSVAFPPEPLDDLLGQVVAEAGLRQYRTAETEKYPHVTYFMNGGIEQPLPGEERHLVPSPRVATYDLSPAMSADQLTDSCIDAIDQGTYSLIVINYANPDMVGHTGVMDAATEAIATVDRCIGRLLDAVGRRGGTMLITADHGNAELMQGPDGQAWTAHTTNPVPCILVEGEQRKLPGHGNDISLREDGGLADIAPTLLQILNLEQPAAMTGRSLIEPVSNVDPSPLSARLPLPV

SEQ ID NO: 6891 - protein, 314 aa, Leptospira interrogans serovar Copenhageni str. Fiocruz L1-130
MHSLMKPTREPQINLFKKSNPYKAKVISNVLLTPETGTGKRPKKEGEALVHRIVLAIDHSAYPYVIGQSGGVIPPGEDPEKKAKGLADVGYTVRLYSIASPSYSFGMKEDNIEFIIKRDNIYDENGNIQFKGVCSNYMCDLKPGDEVTMTGPSGKKFLLPNTDFSGDIMFLATGTGIAPFIGMSEELLEHKLIKFTGNITLVYGAPYSDELVMMDYLKGLESKHKNFKLVTAISREEKNSFDGGRMYISHRVREQAEAVKKILNGGGRFYICGGPKGMEKGVIEEIQKISGNTGTYEEFKHHLEGAHQLFVETY

SEQ ID NO: 6892 - protein, 585 aa, Emericella nidulans
MARSRQPTRFSSEAPSESSSSTSPERAADDDTDFFTLQANDSQSSIGAGNPRDSHIQNDPETVLPPIAYLPPEILISIFSKLSSPRDLLSCLLVCRIWALNCVGLLWHRPSCNNWDNLKKIAAAVGEEDSFFLYSSLIKRLNLSALTEDVSDGTVVPFSQCNRIERLTLTNCRKLTDIGVSDLVVGSRHLQALDVSELRSLTDHTLFKVAENCNRLQGLNITGCVKVTDDSLIAVSQNCRLLKRLKLNGVSQVTDKAILSFAQNCPSILEIDLQECKLVTNQSVTALMTTLQNLRELRLAHCTEIDDSAFLDLPRHIQMTSLRILDLTACENIRDEAVERIVSSAPRLRNLVLAKCKFITDRAVWAICKLGKNLHYVHLGHCSNINDSAVIQLVKSCNRIRYIDLACCSRLTDRSVQQLATLPKLRRIGLVKCQLITDASILALARPAQDHSVPCSSLERVHLSYCVNLTMVGIHALLNSCPRLTHLSLTGVAAFLREELTVFCREAPPEFTRQQREVFCVFSGEGVNRLRNHLNREAAPQRDANEATMYDDEEELDEDEGQVTGLMHAAAINDDDYINITPPHA

SEQ ID NO: 6893 - protein, 849 aa, Synechocystis sp. PCC 6803
MEHLPMAFNTTNPLIQVEDDRTGLSVETLKRALADNLFYLQGKFPAIATKNDCYMALAYTIRDRLLQRWLNTFQTYLNCDNRVVCYLSAEYLLGPHLGNNLINLGLWEPVQQAVEESGLSLDELIDIEEEPGLGNGGLGRLAACFMDSLATLEIPAIGYGIRYEFGIFDQEIKDGWQVEITDKWLQLGNPWEIARPESAVLVKLGGHTEPYTDDQGNYRVRWIAGSLVKGIPYDTPILGYKVSTANNLRLWKSEAAESFDFQRFNVGDYYGAVQDKMSSENLTKVLYPNDEQIQGKELRLAQQYFFVSCSLQDMIRIHLSDNPTLENFHEHFAVQMNDTHPSIAVAELMRLLVDEHHYEWQRAWAITEATFGFTNHTLLPEALEKWSLPLFGEMLPRHLEIIYEINQRFLDQVRMKYPNDGDRLARLSIIDEAGEKSVRMAYLATVGSHAINGVAALHSQLVKETILKDFYELWPEKFSNKTNGVTPRRWMVLSNPRLSNLISSRIGDGWIKNLDELKQLEPFADLAGFRQDWCKVKREVKQDLARYIHTRTDLVVNPDSLFDVQVKRIHEYKRQHLNILHVIHLYLQIKNNPNLDVTPRTFIYGGKAAPGYFTAKLIIKLINSVADVVNNDPTIGDRLKVIFLPDYNVKFGQRVYPAADLSEQISTAGKEASGTGNMKFSMNGALTIGTLDGANIEIREEVGAENFFLFGLTTPEVEKTLAEGYQPWEYYNNNANLKAVVDLINSGFFSHGDTALFRPLMDSLLGQDPYLVFADFQAYVDCQNQVGEAYKDQENWARMAILNVARMGKFSSDRTIREYAEDIWAIKPVVIELEDLCPDGQCLLISPNK

SEQ ID NO: 6894 - protein, 242 aa, Mesorhizobium loti MAFF303099
MDMTDKTALVTGANKSIGYETARRLGEAGYRIWLGSRDRERGEAAAAELRQKGLDVRMLEIDVASDASVEAAALRVFEEDGRLDALVNNAGILGSMLAPSEEPIAIIKDVYEVNVFGPIRTTQAFLPLLKAAPCANVVMVSSGLGSLGGLTDPASEFYAINILGYNSSKTALNAATVAFSKEFAAAGIKVNSADPGYTATDFNGHSGYRTVGQAAEIIVRLATLDKNGPTGGYFYDEGPLPW

SEQ ID NO: 6895 - protein, 140 aa, Leifsonia xyli subsp. xyli str. CTCB07
MTTAVEETLVLVKPDGVARNLTGEILRRIEAKGYSLVDIRMVQADRVLLAKHYAEHEGKPFYEPLVEFMESGPLVAIRLAGNRVIEGFRSLAGATDPTTALPGTIRGDLARDWGLKVQQNLVHGSDSPTSAARELALWFG

SEQ ID NO: 6896 - protein, 270 aa, Oceanobacillus iheyensis HTE831
MNQTIAFMGAGSLAEAIISGITKAQIVPNENILVTNKSDINRLKRIEEGYDIQGNTNKQEVIKQADIIILAMKPKDAATSLSFMKEYIRPDQMVISVIAGLTTERMEAILEKEIPVIRTMPNTSALIGYSATAIAKGSYVTDEQLAVAEQLFQTVGMTTIIKEKDMHTVTAIAGSGPAFFYYMVEAMEQAAVEAGLDAEMASQLIAQTVIGAGKMLELSGDPITLRKNITSPGGTTEAGVQQLMSEDFASIVQSCVQRARERSMELAAKS

SEQ ID NO: 6897 - protein, 333 aa, Nitrosospira sp. KAN8
MTIKVGINGFGRIGRMVFRAAVQNFPDIEVVAINDLLEPDYLAYVLQHDSVHGRFKGDVSIEDSTLIVNGKRIRLTAIKDPAELKWGEVGAEVVVESTGLFLTKESCQKHIAAGARKVIMSAPSKDDTPMFVYGVNNDTYDGEAIISNASCTTNCLAPVAKVLNDTFGVKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 6898 - protein, 818 aa, Bifidobacterium adolescentis
MTEITAPKSAVTAEQFADEIREQLKYTQGVTVEQAKPADVYVAASAAVRRHLVDSWMKTQADMVNGNTKAVGYLSAEFLMGKQLENALLNAGLTDQFDKAVEALGFDAQEVIDAEYEPGLGNGGLGRLAACFIDSLASLGVPAFGYGIQYKYGIFKQEFDENGKQIETPDYWLANEEPWGHIDYNRDQKVSFGGEVVEENGKKVWKPAWSVRAVPVDYMVPGYASGRVNTLRLWTAKSYDEFDLLTFNKSEYLDAVKPQVEAENISKILYPEDSTPQGKALRLEQQYFFVSASIHDAIRVFYPGQDKPDLTTFPDKINFQLNDTHPVIGIPELMRVLMDEYGYDWDTAWTITNKTFNYTCHTLLPEALEVWPSKLIGELLPRHLEIIEKINDQFEAELKAKGVAEETIKDMAIYTGDSVRMAYLATYGGSHVNGVAELHSQLLKDVTLKNFSDVYPDKFTNVTNGVTPRRFIKLANPRLSDLITEGLGTDKWLSDLELLKGLIPLADDDEFVKKFAAVKQANKVDFSNFAKRKYGFDIDPNTMINTMVKRLHEYKRQALKILSVIADYADIKSGKVSADDIMPRTIVFGAKAAPGYYLAKQTIQLINNVVRVINNDPDVKGKLNVYFPWNYNIELAMNLIPATDLDEQISQAGKEASGTGNMKFALNGALTVGTLDGANVEIRERVGAENFFLFGMTEPEVSALYAKGYDTKGLSREYYEKDPQLKAAIDMVADGTFSDGDKDTYKDLVNDWLNKDYFMTLADFRAYMDIQAQIEETYRDPMKWSRMAVLNVANSGYFSSDRSIEDYLERIWHTGPLK

SEQ ID NO: 6899 - protein, 576 aa, Zea mays
SNRGNRWDMRNSVSERSFLIESDDDDDAAVEDGKRRGLGGGGGDDDDGSDSSSPCDSPRVVAARCSQPSSYTQQWPQSYRQSIDMYSSVHSPNLSFLGTPSLSRLSNSFLTNSFRGKPPEIISSLIKPLLPTSIASASDDQQQQQHEDVRKSSHYLPPSRKASSLQRIPEDQRPMVGGHEVGPYRQCSYTQGVMNGVNVLCGVGILSTPYAVKQGGWLGLVILAVLGALAWYTGILLRRCLDSKDGLETYPDIGHAAFGTAGRIIISIILYMELYACCIEYLILESDNLSKLFPNAHLTMGNLTLDSHMLFAILTALVVMPTTWLRDLSCLSFISAGGVIASIVIVSCLFWVGLVDHVGTVESEGTALNLPGIPIAIGLYGYCYSGHGVFPNIYSSLKKSNQFPAVLFTCIALSTVLFAAAAIMGYIMFGESTESQFTLNLPPNLVASKIAVWTTVTNPITKYALTMTPLALSLEELLPPNKQTYPNIMILRSALVVSSLIIALSVPFFGLVMSLVGSFLTMFVAYILPCACFLSILRSKVTWYQVVLCVFIIVVGLCCVGVGTYSSLSKIIQKYQ

SEQ ID NO: 6900 - protein, 335 aa, Nitrosomonas sp. CNS332
MAIRVGINGFGRIGRMVFRASIEEFDDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISNASYTTNCLAPIAKVLNDTWGIKRGLMTTVHAATATQKTVDGPSNKDWRGGRGILENTIPSSTGAAKAVGVVIPELNKKLTGMAFRVPTSDVSVVDLTVELEKDASYDEIRKAMKTASEGSMKGVLGYTDQKVVSTDFRGETHTSVFDAEAGIQLDKNFVKVVAWYDNEWGYSCKVLEMVRVIAGRNN

SEQ ID NO: 6901 - protein, 642 aa, Arabidopsis thaliana
MASTSIMLSSFFSFFFLTFFVTYAQQNVTVHTICYYDGGNFTSNTSYSLNLNRLISSLPDLTPTINGFYNISINGEVNAIALCRGDVKPNQDCISCITTAAKQLVESCPNIIEANIWLEKCMFRYTSRIILGQMEPVPFSYTSSNVSVTDKEGFSKGLGDLLDSLGAKIDAANETKEVKFAAGVKGTIYALAQCTPDLSESDCRICLAQIFAGVPTCCDGKTGGWWTNPSCYFRFEVYPFFDLSVTSEQKQPLSSHNNNTRRSDQGKSKDRSKTLIFAVVPIVAIILGLVFLFIYLKRRRKKKTLKENAENEFESTDSLHFDFETIRVATDDFSLTNKIGEGGFGVVYKGHLPDGLEIAVKRLSIHSGQGNAEFKTEVLLMTKLQHKNLVKLFGFSIKESERLLVYEFIPNTSLDRFLFDPIKQKQLDWEKRYNIIVGVSRGLLYLHEGSEFPIIHRDLKSSNVLLDEQMLPKISDFGMARQFDFDNTQAVTRRVVGTYGYMAPEYAMHGRFSVKTDVYSFGVLVLEIITGKRNSGLGLGEGTDLPTFAWQNWIEGTSMELIDPVLLQTHDKKESMQCLEIALSCVQENPTKRPTMDSVVSMLSSDSESRQLPKPSQPGFFRRSASFSISLNDVSLTDLSAR

SEQ ID NO: 6902 - protein, 275 aa, Enterococcus faecalis
MKNTAVTFKESKLRNEKLTMLTAYDYSTAKIIDEAGINGILVGDSLGMVCLGHEDTLSVTMEDMIHHTRAVTRGAKNTLVVADMPFMSYQTSVYDSVVNAGRLIKEGRAQVVKLEGGIEVCDKIEAIVKASIPVMAHIGLTPQSVNAFGGFKVQGKDKEAAKELIRAAKAVEKAGAFAVVLECVPTKLAELISKEISIPTIGIGAGAGCDGQILVYQDMLGMYSDFTPKFVKKYANLSEEMNKAFTKYIEEVKDGVFPGPEHGFKISDDVLEKLY

SEQ ID NO: 6903 - protein, 335 aa, Nitrosomonas sp. OZK11
MTIRVGINGFGRIGRMVFRASIEEFDDIEVVAINDLLEPDYLAYMLVHDSVHGRFRGDVSVSGNNLVVNGKPIRLTAVKDPAELKWDEVNVDVVVESTGLFLTKQDCEKHIKAGARKVVMSAPSKDDTPMYVYGVNDKTYQGEAIISNASCTTNCLAPIAKVLNDTWGIKRGLMTTVHAATATQKTVVAPSNKDWRGGRGILENIIPSSTGAAKAVGVVIPELNKKLTGMAFRVPTSDVSVVDLTVELEKDASYEDICNAMKAASGGSMKGVLGYTNQKVVSTDFRGETCTSVFDAEAGIQLDKNFVKVVAWYDNEWGYSCKVLEMVRVIAGHGR

SEQ ID NO: 6904 - protein, 459 aa, Bacillus anthracis str. 'Ames Ancestor'
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFEKYMKNSMEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLTLK

SEQ ID NO: 6905 - protein, 471 aa, Symbiobacterium thermophilum IAM 14863
MAKVDRVLEMIAEKDIRLLDLKFVDVLGMLHHLTVPVEVVDAEQLSQGFFFDGSSIRGFRGIAESDMILRPDPATVVCDPFVEGPALSLMADVLEPGLREYGRDPRGVARRAEEYLRQTGIADTSYWGVEIEFFVFDNVRFQTGPDASFYYVDSAEAHWNSGRVPNGGYKVKHQQGYLRALPIDEQTDLRTAMTRQMQALGLVVERHHHEVASAGQNEINFRFSTLTDTADKAMLYKYAVKNVARAHGKTATFMPKPLYRNSGNGMHCNQSLAKDGVNLFYDPNGYANLSQIALWYIGGLLTHADALLAITNPTTNSYKRLVPGYEAPTNLAFSRANRSAAIRIPVSLSPKTTRIEFRTPDPTANPYLALAAQLMAGLDGIRRRIDPTAAGFGPVDIDIYHHAGSAAVQLKHVPSSLRQAVEALKADHEFLLEGDVFSEDLIETFIALKEDEIRNLETHPHPVEFEMYFDN

SEQ ID NO: 6906 - protein, 186 aa, Triticum aestivum
  misc_feature (160)..(160): Xaa can be any naturally occurring amino acid
  unsure (1)..(186): unsure at all Xaa locations
MERKQADYSNLDERYTIQGERYQGQQYSHIYYTRLHHMRTLLHALVPSRKPHLPVTTVLGLEEGKDCVLVGTLYKHMKLKPSILDEYSKERSAIPLVKPHNFMHSDDNLILEDESGRVALAGAIPPAAYVTGGGVASSWGRKQVLATFLVEDSMEAGLPXLTWVAHINEDKFVVLGSDIVFGPDIH

SEQ ID NO: 6907 - protein, 319 aa, Avena fatua
MASAKAMGQGEQDRFVLKSGHAIPAVGLGTWRAGSDTAHSVQTAITEAGYRHVDTAAQYGIEKEVDKGLKAAMEAGIDRKDLFVTSKIWRTNLAPERARPALENTLKDLQLDYIDLYLIHWPFRLKDGAHQPPEAGEVLEFDMEGVWKEMEKLVKDGLVKDIDVCNFTVTKLNRLLRSANIPPAVCQMEMHPGWKNDKIFEACKKHGIHVTAYSPLGSSEKNLVHDPVVEKVANKLNKTPGQVLIKWALQRGTSVIPKSSKDERIKENIQAFGWEIPEDDFQVLCSIKDEKRVLTGEELFVNKTHGPYKSASEVWDHEN

SEQ ID NO: 6908 - protein, 337 aa, Arabidopsis thaliana
  misc_feature (112)..(112): Xaa can be any naturally occurring amino acid
  unsure (1)..(337): unsure at all Xaa locations
MGKIKIGINGFGRIGRLVARVALQSEDVELVAVNDPFITTDYMTYMFKYDTVHGHWKHSDITLKNSKTLLFGDKPVTVFGIRNPEEIPWGEAGAEYVVESTGVFTDKDKAAXHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 6909 - protein, 251 aa, Xanthomonas campestris pv. vesicatoria str. 85-10
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHHESSELVARKFAAAIHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 6910 - protein, 825 aa, Arabidopsis thaliana
MMKMMMMNRRRSNVVRFEAKKEDKVEEEDNNDDCFYESLDRVLSSCSCSTSNSDYDSDPNVSDSIHDPTPFPVPMFTSGFELWKSEPESVSERRIRLLRGLGLSNEPDLPPASQLRSRSRRNSSHFSRSVPSDVLTSNHHGKCVLRSDVSGTDNVDREYTGSRMRNDGVDFISKEPMERSLRDIVEKENGRDVVLEEQMCTIRNLDTGREFVVNEVREDGMLERLKEVGTDRQLTLEEFEICVGTSPIVLELMRRQNVEDVCKDSVDLDTNVSGSRVTKHRRRGSWLKSIKNVASSVTGYKERRSTDDRDSPSERGGQRFSSATDDSRDMSFHDPERVKVRQYGKSCKELTALFKSQEIQAHKGSIWSIKFSLDGRYLASAGEDCVIQIWKVVESERKGELLSMDKQEDGSINLFLLANGSPEPVSMSPKRRGRTSFSRKSVSLDNVLVPEAVFGLSEKPVCSFVGHLDDVLDLSWSKSQHLLSSSMDKTVRLWDLSSKTCLKVFSHSDYVTCIQFNPVDDNYFISGSLDAKVRIWSIPDHQVVDWNDLHEMVTAACYTPDGQGALVGSYKGTCCLYNTHDNKLQQRREINLKNRKKKTHHKKITGFQFVAGSSSEVLVTSADSRTRVVDGVDLVHKFKGFRNTNSQISASLTSNGKFLVSASEDSNVYVWNYDSDSRAGRSKRVTVTNSYENFYCRDVSVAAPWPGKISNNHTNNSPEQSSFTANNNPPTPVNDPTNNKTVTNGIISSATNRYFFDRVSATWPEEKLLLAAKNRARTSPRVSVDMSNIQVNTKPSASAWSMVIVTGSLRGEIRIFQNFGFPVRL

SEQ ID NO: 6911 - protein, 127 aa, Glycine max
MEQTFIMIKPDGVQRGLVGEIICKFEKKGFTLKGLKLITVDRPFAEKHYQDLSAKPFFNSLVDYIISGPVVAMIWEGKNVVLTGGKIIGATNPAASEPGTIRGDFAIDIGRNVIHGSDSVESATRKL

SEQ ID NO: 6912 - protein, 100 aa, Glycine max
  misc_feature (27)..(27): Xaa can be any naturally occurring amino acid
  misc_feature (72)..(72): Xaa can be any naturally occurring amino acid
  unsure (1)..(100): unsure at all Xaa locations
HGGNARVTLVSSDQFAYDVIQGACDRXMVGGLYGDVPAARHVNGGENVVVLGVPCCEKRDLLILRISVSEPXMRSSESAEKEARDQRVTMRKRREFLDLD

SEQ ID NO: 6913 - protein, 528 aa, Synechococcus sp. WH 8102
MSKVLVSDPIDQAGVDILSQVAQVDQRPGLSPEELVSVIGDYDGLMIRSGTQVTAEVIAAASKLKIIGRAGVGVDNVDVPAATQRGVLVVNSPEGNTIAAAEHALAMMLSLSRHVPQAHAGMRVGKWDRKKYVGNELYKKTLGVVGLGKIGSHVARVARAMGMEVIAYDPFIAADRAQQMQVRLTELDELFRTADYVTLHIPRTKDTENLVNAELLRTMKPTARIVNCARGGVVDEAAIAEAINGGVIAGAGLDVYASEPLAEDSPLRAVERGLVLTPHLGASTEEAQENVAIDVAEQIRDVLLGLPARSAVNIPGLSAEIMERLKPHLQLAETVGGLVSQLSGGQVQELELRLQGDFASHPSQPLVIASLKGLLGAVLGDSINFVNASLEAKARGIRVLEVKDEASRDYAGGSLQLISRGDQGSRSVTGAVFADGELRITSIDEFPVNVTPSSHMLFTRHRDMPGIIGQLGSMLGEHNVNIAAMQVGRKIVRGDAVMVLSIDDPIPAALLQTITAIEGIQEAHPVSL

SEQ ID NO: 6914 - protein, 496 aa, Bacteroides fragilis NCTC 9343
MKANNLLSQFGDHRQRVQSAITAVCEGRGILLVDDENRENEGDLIFSAQSMTEADMAIMIRHCSGIVCLCITEEKARQLNLPLMVEQNTSKYGTAFTISIEAAEGVTTGVSAADRIQTIRTAIAPNATPESLHHPGHIFPLIARSGGIKERSGHTEGSIDLMKLAGLAPCAVLCELTNDDGTMARLPEIIKFGLEHKYPVVTINDLKEYQTAPDFLPKLVGSFSCPAAENPTTAIMEAAFRHHYMHYRYINCEVGPENLAAAIQGAKAMGWRGFNCSLPNKVEIIRYLDELGESAKIIGAVNTVVIGDDQRATGENTDGKGFVKAISEIITIQDKKIALLGAGGAARAIAVEMALAGVKEITILNRNRDKGQALADLLNSQTVATARFVLWDHPYRFSTDIDIVINATSVGLYSNVDQRLNIDTDTLLPHMVVADCIPNPVYTQLLRDAVRRGCCHVLPGMKMLVYQAVIAIKYWSGVDVDPDIMLEKLKEVVKPA

SEQ ID NO: 6915 - protein, 333 aa, Nitrosospira sp. GS832
MTIKVGINGFGRIGRMVFRAAVQNFPDIEVVAINDLPEPDYLAYMLQHDSVHGRFKGDVSIDGDTLVVNGKRIRLTAIKDPSELRWGEVGAEVVIESTGLFLTEETCQKHIAAGAGKVIMSAPSKDDTPMFVYGVNDNTYDGQSIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYEEICDAMKKASEGSMKGVLAYTDQKVVSTDFRGESATSIFDAEAGMALDGNFVKVVSWYDNEWGYSSKILEMVRVVASK

SEQ ID NO: 6916 - protein, 399 aa, Clostridium tetani E88
MLGVSKRVEELRFSEIRKFIPYSDGAKAKGVQVHHLNIGQPDIKTPEEFISAIKNFDEEIVKYEDSQGNKDLIDAFVKYYESINIDIDKEDVYITNGGSEAILYALLTICDLGDSVIVPEPYYTNYNTMAKMAGVDIISFRTYREDGFRIKSKEDIINSIKDNTKAIMITNPSNPTGVVYTKEEIRMISDIAKEKDLFIISDEVYREFVYDDLKFTSFMDMKDILDRVIIIDSISKRYSACGARIGALICKNRNVTENFMKMCQARLSVSSLDQVGAANLINVPKSYIEEVRIEYEKRRNILYEGLCDIPGVHCEKPSGAFYIIAKLPIDNSDDFTKWMLKDFQYNNKTVMVTPAEGFYTTEGLGKDEVRLSYCINSQDLKESMLILKKALEEYNKLRK

SEQ ID NO: 6917 - protein, 349 aa, Debaryomyces hansenii CBS767
MDLDTDVPMEDVSNDQQLNQRFDESTSGPGQQQSQPSNSKDLNTSSINQLDQWIEKLSACEPLSEGDVKNLCDMAMDVLQFEENVQPVQVPVTICGDVHGQFHDLMELFKIGGPCPDTNYLFMGDYVDRGYYSVETVSYLVCMKVRYPNRITILRGNHESRQITQVYGFYDECLRKYGSAAVWKLFTDLFDYFPITALVDNKVFCLHGGLSPMIETIDQVRELNRIQEVPHEGPMCDLLWSDPDDRGGWGISPRGAGFTFGQDISEQFNHTNDLSLIARAHQLVMEGYSWSHQESVVTIFSAPNYCYRCGNQAAIMEVDEQHNRQFLQYDPSVRPGEPTVTRKTPDYFL

SEQ ID NO: 6918 - protein, 333 aa, Nitrosospira sp. NRS527
MTIKVGINGFGRIGRMVFRAAVQNFPDIEVVAINDLLEPVYLAYMLQHDSVHGRFKGDVAIDGDTLVVNGKRIRLTAIKDPAELKWGEVGAEVVIESTGLFLTKETWQKHIAAGAGKVIMSAPSKDDTPMFVYGVNDNTYDGQSIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELDKDATYEEICAAMKQASEGAMKGVLGYTDEKVVSTDFRGESCTSIFDAEAGMALDGSFIKVVSWYDNEWGYSSKILEMTRVVAGK

SEQ ID NO: 6919 - protein, 333 aa, Nitrosospira sp. TYM9
MTIKVGINGFGRIGRMVFRAAVQNFPDIEVVAINDLLEPDYLAYMLQHDSVHGRFKGDVSIDGDTLVVNGKRIRLTAIKDPAELRWGEVGAEVVIESTGLFLTKETCQKHITAGAGKVIMSAPSKDDTPMFVYGVNDNTYDGQSIISNASCTTNCLAPIAKVLNDTWGIKRGLMTTVHAATATQKIVDGPSNKDWRGGRGILENIIPSSTGAAKAVGKVIPELNTKLTGMAFRVPTSDVSVVDLTVELDKDATYEEICAAMKQASEGAMKGVLGYTDEKVVSTDFRGESCTSIFDAEAGMALDGSFIKVVSWYDSEWGYSSKILEMARVVAGK

SEQ ID NO: 6920 - protein, 435 aa, Schizosaccharomyces pombe
MVSEISDLSLAKEKSEAQFIARNPKSNDFHCKACDSLPGGNTRTVLHGAPFPIFIEAGYGSKLRDVDGHEYTDFLNELTAGIYGHSNPVIKKALMQGFDEIGISLGGTTTCELNYAEALKSRFLSIEKIRFCNSGTEANITAIIAARKFTGKRAVIAMHGGYHGGPLSFAHGISPYNMDSQDFILCEYNNSTQFKELVNSSQDIAAVIVEAMQGAGGAIPADKEFMQTIQLECEKNDIVFILDEVMTSRLSPGGLQQIYCLKPDLTTLGKYLGGGLPFGAFGGRADIMSCFDPRLPGSLSHSGTFNNDTLTLTAGYVGLTELYTPEAVKRLNALGDGLRKDIESYCHNTKMSITGLGSIMNIHFTESGRVNSYNDTAGEVIELKDLLWMDLLKEGFWIARRGMITLSLVLTESELEAFKLTIKAWIHRRMSLIRI

SEQ ID NO: 6921 - protein, 508 aa, Burkholderia sp. 383
MNAPAVAAETRHSSSTAPAAGTRVAVQPVILAGGSGTRLWPMSRERFPKQLIGLLGEHSLLQSTALRLDGLTADHPLNDDVLIVCGEDHRFTTAEQLRLTGKPASIMLEPIGRDTAPALTLAALRLVAGGNDAVMTVMPADHAVADLPRFHAAVAAGVHCAMQGKIATMGIVPTHAETGYGYIRVGAPLGDAATGKLDVRRLDRFVEKPHLELAQQYVASGEYWWNSGIFIVRASVWLKAIRQLEPAIYAACEQAVAQGKADGDFFRVDRDAFAASPSNSIDYAVMEPIASLPQLCESVVVPLDAGWSDVGSWDAIWQISPKDDADNVGRGHVLFEGAESTFAHSESRLVACLGTQNLVVVETPDAVLVADKSRVQDVKKIVGHIKAQRGAEATDHRKVHRPWGHYDSIDMGERFQVKRIVVKPGARLSLQMHHHRAEHWIVVRGTARITRGDETFLLSENESTYIPLGVSHRLENPGMMPLELIEVQSGAYLGEDDIVRFDDTYGRQ

SEQ ID NO: 6922 - protein, 333 aa, Nitrosovibrio sp. FJI82
MAIRVGINGFGRIGRMVFRASIEEFDDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISNASCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVPTDFRGESATSIFDAEAGMALDGNFVKVVSWYDNEWGYSSKILEMVRVVAGK

SEQ ID NO: 6923 - protein, 1052 aa, Cytophaga hutchinsonii
MKLETVIQKGHSASVKAVAVSPDGKILATGSRDKSVKLWDQQSGMEIRSLIGHDHTVNGLAFSPDGKLLATSSADGTARVWDILTGKEIFTSPKNSKYITDVAFNPDGKSFAYAGYPDSASIYAIPSGKLIKRLEVNADQGSGYGISLKYSNDGKWLAIGEDNKTANVYRTSDWHLAYTFKPAEGWCGGCGTYVEFSRDNKSLFKIAHNDKLSQYDLQTGSLIKTFGEPVDYLRGITLTKDGQHVIAASDSMLYNYTITSKTVVAYKLYLSETVNDIALSLDEKEILVASDNMTAWALEAASGKVIRTYQGALQEQDKGGLNYNADNYWEYNIARYLRLKNELLLTKDDNNFITGKTGVNAIQWNISTGAPNKLYEGHTKAVISMDQSADGSILATADGAGEVFLWNTKTGALINRIKPHTEPIFDVSLSRDGKYVATGSWDASIEVYDVQTGEVSSDMYLKENSCYSISFTPNGLYLLCGRLDKSLELREPDSKKVVLSFIGHTDVVSSIAFGADPNKALTASWDGTARIWDVTTGMMLQKFKGARGMLHSAIYSTDSKKIITGGDDRIIRIWDIQSGQVLKTLNGHQSEITSLSLSKDGKMLVSYSTDGVVKFWNLESGLEFYEHVHISSREWMARTPQGYFSATEQARADIHFVKGMDVYAPDQFFEYYRPDLIQQIFLNRGSSPTGMQNVENSLQLSPPPLIKLACIPNADGLQATLNIKVMDEGGGLSEIRLAHNGKNMAVALDPKKVVEGKGNSYIYSVPVSLVRGTNQFSGIAVSKGKIESAASLVSVVSDKAPSAAVCHVFAIGIDTYKNPAYTLNYAREDAEAFAESVKRNGANLYQKVIVHGLYDAAATRQNVLDTLKSLEAHIALNDVFIFYYAGHGSMVDQNFYFIPTECTSMYQATANNALSAETIQAGFKNIKALKQIIIMDACQSGGSVEVLAMRGANEEKAFAQLSRGAGIHVMASAGSEQNAKEILELKHGLFTYVLLEALNGKADGAPKDGKITIYELKSYLDDQVPELNSKYSGKIQFPYTFSRGSDFPIVLE

SEQ ID NO: 6924 - protein, 333 aa, Nitrosovibrio sp. RY3C
MAIRVGINGFGRIGRMVFRASIEEFNDIEVVAINDLLEPDYLAYMLLHDSVHGRFKGDVSVDGNNLIVNGKKIRLTATKDPEELNWGEVKVDVVVESTGLFLTKELCEKHIKAGAPKVVMTAPSKDDTPMYVYGVNDKTYQGEAIISIVSCTTNCLAPIAKVLNDTWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 6925 - protein, 473 aa, Prochlorococcus marinus subsp. marinus str. CCMP1375
MGKSPQDVLRQIKDEGIELIDLKFTDIHGKWQHLTVTSDMVDENSFKEGLAFDGSSIRGWKAINESDMSMVPDSSTAWVDPFYRHKTLSLICSIQEPRSGEAYSRCPRSLAQKALAYLSNTGLADSAYFGPEPEFFIFDDVRYDSKEGTSFYSVDTIEAPWNTGRAEEGGNLAYKIQYKEGYFPVSPNDTAQDLRSEMLLLIGELGIPIEKHHHEVAGPGQHELGMKFASLISAADNVMTYKYVVRNIAKKYGKTATFMPKPVWNDNGTGMHVHQSLWKDGQPMFYGEGTYANLSQTAKWYIGGILKHAPSFLAFTNPTTNSYKRLVPGFEAPVNLVYSQGNRSAAVRIPLTGPSPKAKRLEFRSGDALANPYLAFSAMMMAGIDGIKNQIDPGDGVDVDLFELPEDELSKIATVPSSLNNALEALKADNDYLTAGGVFDHDFINNFIEMKYEEVQQLRQRPHPHEFFMYYDA

SEQ ID NO: 6926 - protein, 405 aa, Ureaplasma parvum serovar 3 str. ATCC 700970
MVKNFFIKDPIHGLITFDEQYEWAYELIKTKEFWRLNNIKQLGSSWSIFPSATHTRFTHCIGVFQVTRKLLDSLKFIKSDTHDLINNKKIVCAAALLHDIGHGPFSHTFEYATNYNHEKIGQMIITNPKSEINKILIKHNINPVDVANIIDHKSKKMWMQQVISSQIDADRLDYLPRDSHFTGTKYGNIDYDNIFKKAIVFNDQLCFSKHSWNALENILISRWSMFENVYLNKTPTTYDILMKKTLARVHFLYQKQKKYIFKNSQLLTILKPWLDNESWDITTVQNLDDYSFTALMRSFANEHDFILKTLATNWLQNKDFVTFEYEYGKDKSKDQKIIHKKYFYETITSNKQIYDFNEPVFLYTENKNNDIKLLKLEDKSLIIAALKSIKQPRIKKWIFYYKPLK

SEQ ID NO: 6927 - protein, 152 aa, Prochlorococcus marinus str. MIT 9313
MAMERTFVAIKPDGVQRGLVGEILGRFERKGFKLVGLKQVTPSRDLAGEHYGVHRERPFFAGLVDFITSGPVIAMVWEGDGVIASARKLIGATKPLDAEPGTIRGDLAVNIGRNVIHGSDGPDTAQFEINLWFSAEELNAWTPSDQSWRIES

SEQ ID NO: 6928 - protein, 379 aa, Gibberella zeae PH-1
MPGLTLPTFTRAEVEEHNSEGSCYVTIGSKVYDITDFIEDHPGGPEYVLEYAGRDIEKILKDSDSHTHSDSAYEILDESLVGFLVPEKSVNGHANGTANGNGNAKLSNGDANGTVHPRTGMSCEEDLSRETDYNMDYKKNKFLDLNRPLFPQLWFGGFTKEFYLDQVHRPRHYKGGQSAPLFGNFLEPLSKTAWYIVPIIWLPCIAFGTHVASQGFDNQLYTLGYWVFGVFFWTIIEYVLHRFLFHLDYYLPDNRVGITLHFVLHGIHHYLPMDRYRLVMPPALFALLATPFWWIAHSILCHNWYAAVAAYCGGVFGYVCYDLTHYFLHHQDLPLWYKDLKKYHLAHHFLDYELGFGVTSRFWDTIFGTELIYDTKKTK

SEQ ID NO: 6929 - protein, 318 aa, Saccharomyces cerevisiae
MGKAAKKKYSGATSSKQVSAEKHLSSVFKFNTDLGQHILKNPLVAQGIVDKAQIRPSDVVLEVGPGTGNLTVRILEQAKNVVAVEMDPRMAAELTKRVRGTPVEKKLEIMLGDFMKTELPYFDICISNTPYQISSPLVFKLINQPRPPRVSILMFQREFALRLLARPGDSLYCRLSANVQMWANVTHIMKVGKNNFRPPPQVESSVVRLEIKNPRPQVDYNEWDGLLRIVFVRKNRTISAGFKSTTVMDILEKNYKTFLAMNNEMVDDTKGSMHDVVKEKIDTVLKETDLGDKRAGKCDQNDFLRLLYAFHQVGIHFS

SEQ ID NO: 6930 - protein, 432 aa, Prochlorococcus marinus str. MIT 9211
MTNAFNTNLSQAVFNAAQDLMPGGVSSPVRAFKSVNGDPIVFDRVKGPYAWDLDGNRFIDYVGSWGPAICGHSHPEVIAALQEALEKGTSFGAPCELENKLAGMVIEAVPSVEMVRFVNSGTEACMAVLRLMRAFTGRDKLIKFEGCYHGHADMFLVKAGSGVATLGLPDSPGVPRSTTSNTLTAPYNDLEAVKALFAENPDAISGVILEPIVGNAGFIPPEPGFLEGLRELTKENGSLLVFDEVMTGFRISYGGAQERFGVTPDLTTMGKVIGGGLPVGAYGGRKEIMSMVAPAGPMYQAGTLSGNPLAMTAGIKTLELLKQEGTYERLESLSQRLINGICESAKKAGIPITGSFISGMFGFYLCEGPVRNFQEAKQTNAELFGKLHRAMLEKGIYLAPSAFEAGFTSLAHSNDDIETTIKAFEASFSEIV

SEQ ID NO: 6931 - protein, 311 aa, Triticum aestivum
  misc_feature (300)..(300): Xaa can be any naturally occurring amino acid
  unsure (1)..(311): unsure at all Xaa locations
MFSPSDGRNLLPRISEVPWRRTALARSGLPPVGECEWREELRQQQSQVEALRDRLVEVKVGMRRSEDDSGRELEHLCRRVKTIATLLAYLKSKARIMAIPHLAHTSCGIRNQDGVGFVDRHGVPLADWSKAAEPASCGAGSDDRAAAEGSGVHKHGDAVEGDGDVDDILKSIRVVTDVMESLVKRVIVAESETANEKEKVRIGLEEIRRKTIQVESMSVKVEEMEKFAVGTNGMLNEMRQRVEDMVLETTRQRQRAAENEQELSRVKNDFESLRTYVSTLVSVRETLLSSEKQFETMEKXFDRLVARTNQL

SEQ ID NO: 6932 - protein, 219 aa, Haemophilus influenzae R2866
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEMEKELNNVAGVVTNGIFALRGADVVIVGTPEGAKVID

SEQ ID NO: 6933 - protein, 273 aa, Porphyromonas gingivalis W83
MSTYQPEDTRKVTTHRLIEMKSRGEKISMLTAYDYSMAKLVDEAGMDVILVGDSASNVMAGNVTTLPITLDQMIYHGKSVVKAVKRALVVVDLPFGSYQGNSKEALCSAIRVMKETHADCIKLEGGEEVRESIVRILSAGIPIMGHLGLMPQSINKFGTYNVRAKEEAEAEKLLQDAHLLEELGCFALVLEKIPAELATRVASELSIPVIGIGAGGGVDGQVLVMHDMLGITEGFSPRFLRRYANLANEIDRALKHYIADVKSMDFPNKDEQY

SEQ ID NO: 6934 - protein, 401 aa, Arthrospira platensis
MYSPTGTGVAMRTGAAGRIFVFEVEGMRQGQNTDNFNYPIRRSGTVYLTVPYERMNQEMRRLSKMGAKIVNIYPAGETPPVRTQAAPENGQQSQSSGTQTPTMTQAKAKTDIPVNIYKPKNPYIGKCLSNEELVREGGTGTVRHLIFDISGGDLRYLEGQSIGIIPPGTDNNGKPHKLRLYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLAWLFFGIPYSPNILYQQELEELQQQFPENFRLTLAISREQQNPEGGKMYIQDRIKENADQLWELIQKPNTHTYICGLKGMEGGIDEGMSAAAGKFDVDWSDYQKQLKKKHRWHVETY

SEQ ID NO: 6935 - protein, 591 aa, Synechocystis sp. PCC 6803
MQTSPLPRRTKIVATIGPATQSKEVLRQLIQAGATTFRLNFSHGDHAYHQQSIRLIRQIAFELNQPVGILQDLQGPKIRVGKFLNDAGSVQLKNGDPYTLTSRPVECTETISSISYEYLADEVPSGARILLDDGKLEMLVEEVDTVARDLHCRVIVGGTLSSNKGVNFPGVCLSVKAMTDKDKEDLMFGLDQGVDWVALSFVRNPQDIDEIKGLIAAAGKSVPVIAKIEKHEAIKDMQAVLEKCDGVMVARGDLGVELPAEDVPILQKKLIATANRLGIPVITATQMLDSMVNSPRPTRAEVSDVANAILDGTDAVMLSNETAIGKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQAIAQFTQGEILVVPSTNADCVDMMRRAAGIITEEESLTSHAAIIGLRLGVPVIVGFKGATQKIRDGAIVTIDAQKGLIYSGALPPVSKG

SEQ ID NO: 6936 - protein, 339 aa, Debaryomyces hansenii CBS767
MSLVKRQKIDDGDRRALVQSRLLGARNGGGILYNEAVILEGHEGSVLSTRFSHNGDYIASGGLDKNILLWKLPYNEEEESPNYGEIKGHKSAVTSVRWLYDDITLASASADTTVGFWDGETGKRTKKCIGHELAVNDISVSKDSLALSASDDGSACLWDQRQKEATNKVTTEYPLLSCTFNNRGNTFYIGGIDPKIQAYDMRVMDKPIWTCEGQVDSITSIAINKDDSILLSRSVNGILRTYSAREFVPEGIPRMNPYIYDGAPSGNEYQLIRACFSTDNVSIASGSEDKTVTIWDYKSRKILNKISGHRGATLDIAYHPTERILASTSTDGSIIVREI

SEQ ID NO: 6937 - protein, 333 aa, Nitrosovibrio sp. RY6A
MAIRVGINGFGRIGRMVFRASIEEFDDIEVVAINDLLEPDYLAYMLLHDSVHGRFKGDVSVDGNNLIVNGKKIHLTATKDPEVLNWGEVKVDVVVESTGLFLTKELCEKHIKAGAPKVVMTAPSKDDTPMYVYGVNDKTYQGEAIISNASCTTNCLAPIAKVLNDIWGIKRGLMTTVHAATATQKTVDGPSNKDWRGGRGILENIIPSSTGAAKAVGKVIPELNTKLTGMAFRVPTSDVSVVDLTVELEKEASYDEICDAMKKASEGSMKGVLAYTDQKVVSTDFRGESATSIFDAEAGMALDGNFVKVVSWYDNEWGYSSKILEMVRVVAGK

SEQ ID NO: 6938 - protein, 269 aa, Clostridium acetobutylicum ATCC 824
MAGVKIRVLEILKKNSNDFVSGQRISDELGITRTAIWKNIKSLKDNGYTILSLTNKGYKLVDCPDTLTYEEINEDLKTKFIGRKIVHFDSIESTNIEAKKLAEQGEKEGTIVVAEEQTLGKARMGEKWYSPRGEGIWMSIILKPKISPEFAAEVTNATVEAVGKALIKIEPSVEIKKPNDIFVNDKKMCGILTEIDGELNLLNYVIVGIGINVNQEQFPESMKLKYTSLRICKNKVFLRKKLLCDILNNIEPMYEDLLMKIRKPSHRGS

SEQ ID NO: 6939 - protein, 375 aa, Zea mays
MGAEAAHGHPQQQPPSSLRPGREAAAPPAVVGLQLSALIDHVARVDWSLLDRVPGDRGGSQQVSIDELNHILDEVNAHILPSRNDLTPVTTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCVAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 6940 - protein, 527 aa, Trichodesmium erythraeum IMS101
MPKVLVSDSIDQNGINILSQVAQVDIKIGLPVEELVKIIPEYDGLMIRSGTKVTKEIIEAADKLKIIGRAGVGVDNVDVQAATRKGIVVVNSPEGNTIAAAEHALAMMLSMSRHVPEANQSIINAQWDRKKFVGVEVYKKTLGVVGLGKIGSHVAKVAKAMGMKILAYDPFISEERAEQLGCSLVDLDLLVQESDYITLHIPKTDETYHSINAETFAKMKPTARIINCSRGGIIDEVALSKALKEGKIAGAALDVYENEPLEVESPLRDLGQKIVMTPHLGASTAEAQVNVAIDVAEQIRDVLLGLPARSAVNIPGMYPDTLKKLKPYLRLAETLGNLVSQLAGGRIDFLNVRLEGDLAGGDSKPVVVGALKGLLSQALRERVNYVNAFIEAKERGIRVVETRDDSVRDYTGSLHLEAKGSLGEHNVRGSLLGKDEIRITNIDGFPINVPPSPYMLLTLHRDMPGIIGKIGSLLGSFNVNIASMQVGRKIVRGDAVMVLSVDDPLPEEILTEILKEPGIRNAYTVAL

SEQ ID NO: 6941 - protein, 238 aa, Triticum aestivum
MKTVSLGAPRSSTVKFRMPTRDNLVPIRVDIEVDGQRYRDAFTWNPRDPDSEVITFAKRTAKELKLPATFVPQMLQSIQGQLAEFRSYEGQEMQVKEKIMPLKIDLRVNNTTIRDQFLWDIGNLESDPEEFARTLCDDLNITDPEVGPAIAVCIREQLYEIASQTVSAMREAKMSKKRRAPEFASNSKAMNNAVDMFKYFGSKGSVIRKKKEWFLYEPVVDVVPKEEAAVVDAKEQLK

SEQ ID NO: 6942 - protein, 472 aa, Rhodococcus sp. RHA1
MSETATPVPAQMHRGLQNRHIRMIGLGSAIGTGLFLVSGSTIQTAGPAVLLAYVLAGAVIFLIMRMLGEMAVHSPVAGSFSEYAREHCGPLVGFIAGWNWWMTCIVVSMLELTAVGTFMDFWFPGIPHWVTAAVALVLITGVNLIHVSAFGEFEFWFTLIKVAAVVAMIVFGVAIVFGAGHYDTAALSNLWNSGGFAPHGITGILLSLVAVTFTFGGIESLGTTAGEAKDPARSIPKAVNGVIVRILIFYVGAIGVMLMIWPWARVGVDGSPFVLMLDGLGVGGAATLLNIVVLVAALSVYNTMVYSNARVLHGMAAKKQAPALLAKTNHRGVPVTGIVINSAITAIVVLLNYLFPGQLLMILVAIILSAEIITWSTIAISHLRFRRTVGAGVFRSPLYPYTNYLVLAYLAGVVVLMTQLPDFRAGAIALPLWLAGLLAAALLYRRIRRNRDHASADTAAEAGRPLIDHTPT

SEQ ID NO: 6943 - protein, 175 aa, Zea mays
  misc_feature (88)..(88): Xaa can be any naturally occurring amino acid
  misc_feature (115)..(116): Xaa can be any naturally occurring amino acid
  misc_feature (133)..(133): Xaa can be any naturally occurring amino acid
  misc_feature (153)..(153): Xaa can be any naturally occurring amino acid
  unsure (1)..(175): unsure at all Xaa locations
MASLSFVSSSHLTLRAPSPNNLRSSSPRPTSVSFSVKAQSVALSQDDLKKLAAEKAVESIKPGMVLGLGTGSTAAFAVDQIGKLLSSXQLHDIVGIPTSKRTEDQARSLGIPLVXXSNAPRIDLAIDGAERSXDPTLDLVKARGGALPEEKMXEAVAERFIVVAMIRTREGLRSG

SEQ ID NO: 6944 - protein, 257 aa, Ureaplasma parvum serovar 3 str. ATCC 700970
MGQNFLLSNNIKNKIVDVANINKDDLILEIGPGWGAITEILVQKTNILIAIELDKRLYAHLKTYIKTSNFHIINNDVLCVDLDNLILDYNNTQKIQKIKVVANLPYAISSKIVLKIIQSKLINDAYIMVQKEMAERIGAKVNTRGYNAFTVLVQLFCKTKILFEVNAKEFHPQPKVQSAVIHLENLHNSVNFNIEELGKFLRICFLNKRKKLKNNLSNIYDIKIINQMFIDYNLDMNLRAENIEPKMFLKLFNYLNR

SEQ ID NO: 6945 - protein, 594 aa, Oryza sativa
MDRDEEMGHGDRSLLFTGDEDDDLEADRDGGSTPSSDPGSFSDRSDPPSVDDIDEDDDDVVGDGRRAPRDDDDDQRGTWPQSFRQSIDMMSAVPSPAMSSIITAASPNLGRLAAVGSSLLKRATSSAVGQEGSSLPLSRPLLPPSSLSQLSTASGPPVRDSADSLPPRARPPPPPLQGESVVPPPLPRPSSACLRSNYIDLPPPSTRCGQKQAILNGLNVLCGVGILTTSYGIKQGGWLSLILLPLLGCCSCYTGLLLKKCIDSSPSIDTYPDIGQAAFGIYGRIFVSVVLYLELYACGVEYITLLGDSLSSVFPSADLAFGGIYLNAHNLFAITMALAILPSVWLKNLRLLSYLSAGGVIATTTVIVCLFWVGIGEGVGFHPGGTALNLTHFPVALGLYGYCYSGHSVFPNIYSSMEERPKFTFVLLFCFIVVTFVYAGVAVAGFLMFGESTMSQFTLNMPQQFIPSKIAIGMTIINPYTKYALTLTPVALSIEEALPRRMQTYQVGMCVRTALVASTVVVALTFPYFALVMALLGSVFTMLVALILPCACYLSIKKGSTPLWEVVLCITIILLGILCACVGSYTSVSQMISR

SEQ ID NO: 6946 - protein, 226 aa, Streptococcus thermophilus LMG 18311
MDELKKLAGVYAAGFVEDGMVVGLGTGSTAYFFVEEIGRRIKEEGLSVVGVTTSTQTTKQAEGLGIPLKSVDDIDSIDVTVDGADEVDPQLNGIKGGGGALLMEKIVATPTKKYIWVVDESKMVDQLGAFKLPVEVVQYGADRLYLDFESKGYKPSFRVTEQGDRFVTDMKNFIIDLDLGKINNPVALGDELKAMTGVVEHGLFNGMVNKVIVAGKDGVKIVEVKD

SEQ ID NO: 6947 - protein, 358 aa, Cytophaga hutchinsonii ATCC 33406
MDINNYAVIMAGGIGSRFWPFSRTKYPKQFHDVLGTGATLIQQTVNRFKNICPPENIIIVTNKDYVGLVKEQLPFLQDHQILAEPIGRNTAPCLAYASYKILQRDKNANIVVAPSDHIILQEKEFENVIVEALQATEQADILITLGMKPTRPDTGYGYIQYIDEKKLRIKKVKTFTEKPALELAIKFIESGEFVWNAGIFIFNAQTIVDAIKKHLPEMDEVFTEGSGLYWTDKENDFINKAYSRCGNISIDYGIMEKSDNVYVMLADFGWSDLGTWKSLFENMPKNDDGNVIDGNVLTYDAKDTIIKTPKNKLVVVEGLEGYIVAEFDDVLMICRKENEQRVKDFVSDVKATQDKRFV

SEQ ID NO: 6948 - protein, 334 aa, Pseudoalteromonas tunicata D2
MLILKGNKLAVLNYLQQGEFVSGEWLGLQLGISRAAVAKHIQSLQELGLDIFKVTGKGYRLNTAFELLNQQRIEQYYKAQSEGVAQFELFPVIDSTNSELMRRIQSGQLPDSGTVVVSESQTAGRGRRGRQWQSPFGSNLYFSYYWLLDDGLQAAMGVSIAVGLAVYDALKALYQIDVQLKWPNDILVHEQKLAGVLVELDGQPDGPCHLVIGIGLNLNMPVTASANIDQAWTDLALLGCEVDKSKLVAVLTHCLEQRLKQYRQSGLDEMHQQWNQVHAFQGQRVNLITGLRSWQGICEGIDPQGGIKIRQNGEVKSYFGGEISLRKVVDDFTY

SEQ ID NO: 6949 - protein, 737 aa, Glycine max
  misc_feature (706)..(706): Xaa can be any naturally occurring amino acid
  unsure (1)..(737): unsure at all Xaa locations
MGLNVPQRQLTLLLLIALAAAEKTLHGCRSTCGSVSSIPYPFGIGNSSVTGENCFLEKALMLTCINSTLYHGNGNVQILDITLDSKMVVLAFISKVCKNESVGRVVTKGHEAGLRTPAFTVSSEDNKFVTVGCDTYGYLNSFNNDIRSQMGCFTRCDTIESVQSMQEDGKCTGIGCCQMDIPPRMKNISIQAFSYYNFNYSSDFNKCGYSFVAKNGNYTFSMKHLKSVPFDKAPMVVDWAVGKQCFNSKGKACKSNSVCENSPSGYGYRCKCKKGFEGNPYHGCKDIDECKTGSHTCISEKNCLNTNGSHICLCPKSGNGTKGSKGCHQQEVVTKVVIGVGAGTVILFVGTTSLYLIYQKKKLNKLREKYFQQNGGSILLQKLSTRENSSQIQIFTVEQLNKATDNFDESLIIGKGGFGTVFKGHLADNRIVAIKKSKIVDKSQSEQFANEVIVLSQINHRNVVKLLGCCLETEVPLLVYEFVNNGTLFDFIHTERKVNNETWKTRVRIAAEAAGALTYLHSEASIAIIHRDVKTANILLDNTYTAKVSDFGASRLVPIDQAEIATMVQGTFGYLDPEYMRTSQLTEKSDVYSFGVVLVELLTGEKPYSFGKPEEKRSLTNHFLSCLKEDRLSDVVQDGIMNEENKKEIMEVAILAAKCLRLNGEERPSMKEVAMELERIRLMEKHPWINTFQNVEETQPASRGIXSICELGDSSSHQYAGYDSIRDHVLIALDDGR

SEQ ID NO: 6950 - protein, 109 aa, Glycine max
  misc_feature (46)..(46): Xaa can be any naturally occurring amino acid
  unsure (1)..(109): unsure at all Xaa locations
VPKSIRLNDMSFSVFNEGLTESEMSSHMNSLASKNKCFKSYIGMGXYNTHVPPVILRNIMENPAWYTQYTPYQAEISQGRLESLMNFQTMISDLTALPMSNASLLDEGT

SEQ ID NO: 6951 - protein, 713 aa, Saccharomyces cerevisiae
MTASVSNTQNKLNELLDAIRQEFLQVSQEANTYRLQNQKDYDFKMNQQLAEMQQIRNTVYELELTHRKMKDAYEAEIKHLKLGLEQRDHQIASLTVQQQQQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSSLGPEYNVFATGSGDCKARIWKYKKIAPN

SEQ ID NO: 6952 - protein, 470 aa, Thermotoga maritima MSB8
MFKKVSRDPVHSEIYLYPLEILATDTKVVQRLRFLSQLAGATVVYPGATHTRFAHSLGTMHVAGLYARNLFKESDRIRIVRLAALLHDVGHGPFSHQFDDVVFKRYGYEDGHDEFRNRLITEKLPEEMMRVFNSYNERLKQAVIEDIRESVGEVSLEDAFQEIAKRVVEVYRGEETGSVDFNIIQGPLGADRLDFLLRDSYYSGVGHFAPMNVDRVLRNSLVKEVDGKEILCYHVKVVDNIYSILFSRFMMYKNVYFHKTSRAADLMIQEILLRACEILDLEERLKDLDEFLELTDYSILRELELKGDSETKKLVERFKNRDLWKMVVERPFSAEGFDPSELSLSAARNLIDKIVENIDRVLSSVNVEDSDKSILEEIRDNKEKFFRIDTPYKLTIFHPDEFLQNNVFLYDPKHDEILTVDEYVKKYPAYRLMVSNMIQIVRVYVTEDVREVLFKYGVIPEDGRRVITRW

SEQ ID NO: 6953 - protein, 361 aa, Prochlorococcus marinus str. MIT 9211
MSYSEANVIAGGLAHIPVLIGVFGFIQSFILKRTQAKGTSNQPSTQTKPASSVASSQPKVIKKPAHPNVPVNTYKPKTPFIGTVKENYSLLKSGAIGRVNHITFDLSSGDPLLKYVEGQSIGIIPAGEDANGKPHKIRLYSIASTRHGDDYKGNTVSLCVRQLQYEKDGKTIDGVCSTYLCDIKPGDKVKITGPVGKEMLLPEDENANIIMLATGTGIAPMRAYLRRMFDPTEQEKNSWNYKGNAWLFMGAPKTANLLYDSDFEGYKSKFPNNLRYTKAISREQKNARGGRMYIQDRVLEHADEIFALIENPKTHIYLCGLKGMEPGIDEAMTQAAASKGLVWSELRPQLKKAGRWHVETY

SEQ ID NO: 6954 - protein, 262 aa, Magnetospirillum magnetotacticum MS-1
MLIGAGKMGSALLRGWLADGLDPGAVTVVDPQPSPEIALLCAERGLRLNPTDAAPAGALVLGIKPQVLDEAAAALGAWIGPDTLVLSILAGKTLADLKRRLPGARALVRVMPNLPASIGRGATGAVGSPEVGPDARAGAEALLASSGLVAWLDDEGLIDAVTAVSGSGPAYVFLLAEALAEAGVAAGLPRDLSAQLARATVAGAGALLDADPREAGQLRRDVTSPGGTTAAALAVLMREGGLPALMTEAVAAARRRAGELSG

SEQ ID NO: 6955 - protein, 478 aa, Neurospora crassa
MATTLFRLAGRNAKRHCMRQSTTIAHNLNSTRAFSASALRRYAEPSYEGQGTRLVPTGDDFAPNNDLYGLEALKADGAPRVPPQDHILARKVRHYTVNFGPQHPAAHGVLRLILELKGEEIVRADPHVGLLHRGTEKLCEYRTYLQALPYFDRLDYVSMMTNEQCFALAVEKLLNVEIPERAKWIRTMFAEITRILNHLMSVLSHAMDVGALTPFLWGFEEREKLMEFYERVSGARLHAAYVRPGGVHQDIPLGLLDDIYMWATQFGDRIDETEEMLTDNRIWIDRLRGIGVVSAADALNLSFTGVMLRGSGVPWDIRKSQPYDAYDQVEFDVPVGINGDCYDRYLCRMEEFRQSLRIIHQCLNKMPAGPVRVEDYKISPPPRSAMKENMEALIHHFLLYTKGYAVPPGDTYSAIEGPKGEMGVYVVSDGSERPYRVHIRAPGFAHLGGFDHLSRGHMLADAVAVIGTMDLVFGEVDR

SEQ ID NO: 6956 - protein, 888 aa, Yarrowia lipolytica CLIB122
MSQDQRTSYRAGAGSDPFLRSRSPSHERMMGQESPIQPLNRHRRTFTGFTQRQIEHIDNTIPLESRQIWKKFSLGEFGDKQEFQQEFVRHVETSLARSLYNCDDLAAYQAASQAVRDRLVVAWNRTQQKHTLTDTKRVYYLSLEFLMGRALDNAMLNTRTKQYAREGVKDFGFRLEDLIEQEPDAALGNGGLGRLAACFVDSLASENYPGWGYGLRYEYGIFKQKIIDGYQVEQPDYWLTYGSSWEIPRNEISVDIMFYGYVRHYTDDEGVHRRCWEGGDVVRAVASDFPVPGYGTANVNNLRLWSSKPAQEFDFAKFNAGDYINSVSEQQRAETISAVLYPNDNFDSGKELRLKQQYLWVAASLNDIVRRFKKSKRPWREFPEQIAIQLNDTHPTLAIVELQRIFVDLEQLPWKEAWDLVVETFGYTNHTVLPEALEKWPVPMLENLLPRHLEIIYDINLYFLQEVEAKFPNDRELLSRVSIIEESQPQQARMAYLAIIGSHKVNGVAELHSDLIKKTIFKDFVAVYGGDKFINVTNGITPRRWLHQANPELSDLIASKIGSGFVKDLSELRHLEKFADDEDFQRQWMLVKHKRKEKLAALVKSQSGVVLNPDHLFDIQVKRIHEYKRQQLNILGVIHRYVELKQMSPEERRKMTPRVSLFGGKSAPGYYMAKTIIKLINDVGKVVNNDPDMFDSLKVVFVEDYNVSKAEIIIPASDISEHISTAGTEASGTSNMKFVLNGGLIIGTVDGANVEITREIGEDNIYLFGHLADEVEDIRHKHKYGGVQVGKKLQQVFDFIQSGALGDPEIYTSLLHSIKYGGDYYLVSDDFDAYLEAQHTINHDFKDTKEWARKSIVSVSRMGFFSSDRAIRDYAEGIWNVEPSPVEE

SEQ ID NO: 6957 - protein, 157 aa, Brassica napus
MKRPVTGKDLMIVNMGPHHPSMHGVLRLIVTLDGEDVVDCEPILGYLHRGMEKIAENRAIIQYLPYVTRWDYLATMFTEAITVNGPEQLGNIQVPKRASYIRVIMLELSRIASHLLWLGPFMADIGAQTPFFYIFREREFGYDLFEAATGMRKMHNF

SEQ ID NO: 6958 - protein, 463 aa, Lactobacillus acidophilus NCFM
MGKKNKVPQLSRSMTAGQMEMISLGGAIGVGLFMGSTSTIKWTGPSVLLAYMFVGLILYIVMRALGEMLYINPGTGSFADYATEYVHPLAGYLAEWANVFEYIVVGMSEVVAATEYLKYWWPNISALWSGVIIIAFLLLANLASAKAYASLEFWFAMIKVITIILMIILGFIVIFFGVGNGGKPIGFSNLWAHGGFFTGGVKGFFFSMSIIVGSYEGIELLGISAGEVANPQKAIVKSVKSVLLRILIFYVGAIFVIVTIYPWNKLSSLGSPFVTTFAKVGITAAASIINFVVLTAALSGANSGIYSSSRMLFKLSHDNEAPSVFKHISKRIVPDRAIMGISGGIFIGFILNIIASQFNHSASDLFVIVFSSSVLPGMIPWFVILLAELRFRRHNQDMMKDHPFKLPLYPFSNYFAFLMLLVIVIFMFINPDTRISVITGALVLIVATIVYLVRHKDEFSKNN

SEQ ID NO: 6959 - protein, 444 aa, Frankia sp. EAN1pec
MSFATIETAIAEIAAGRPVVVVDDADRENEGDLIFAAEAATPELLAFMVRHTAGVVCVPLDPAEVDRLDLDQMVPQNTDRMGTAFTISVDARSGVTTGISAADRARTIRLLADPATQPGDLTRPGHIFPLRAKEGGVLRRPGHTEAAVDLARLAGLRPAGAICEIVNEDGSMARLPELTAFAREHGLALISIADLIAYRRRTEKQVVRVAEARIPTRYGSFRAVGYRGTLDGVEHIALIRGEVGDGENVLVRVHSECLTGDVFGSQRCDCGNQLDAALRAVAAEGRGVVLYVRGHEGRGIGLMHKLQAYQLQDAGHDTVDANLALGLPADARDYGTGAQILVDLGVRGLRLLSNNPTKRAGLEGYGLRIVEQVGLPVTHTPENLRYLTTKRDRMGHDLPGLPGLPDLPKVVGGDETAGAHEAHRWPVTAAPVADRADRACEEAR

SEQ ID NO: 6960 - protein, 363 aa, Pseudomonas syringae pv. phaseolicola 1448A
MALNTIEELVEDIRQGKMVILMDDEDRENEGDLIMAAECVQPEHINFMARFARGLICMPMTRERCETLKLPLMAPRNGSGFGTKFTVSIEAAEGVTTGISAADRARTVQAAAAKEAKAEDIVSPGHIFPLMAQAGGTLARAGHTEAACDLARMAGFEPTGLICEVMNDDGTMSRRAELEEFARQHDIKIGTIADLIHYRMIHERTVQRIAEQPMDSELGSFNLVTYRDSVEGDVHLALTLGKICAEEPTLVRVHNMDPLRDLLMVKQPGRWSLRAAMRAVSEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 6961 - protein, 537 aa, Schizosaccharomyces pombe
MGTYKKEKSRIGREGANEKKPGNLRVKGENFYRNAKDVARVNMYRGGKAKYNAAGELVRAAEFQSSEVPKARIQPDRRWFNNTRVIAQPTLTQFREAMGQKLNDPYQVLLRRNKLPMSLLQENTEIPKVRVLESEPFENTFGPKSQRKRPKISFDSVAELAKESDEKQNAYEEKIEERILANPDESDDVMLAARDAIFSKGQSKRIWNELYKVIDSSDVLIQVLDARDPVGTRCGTVERYLRNEASHKHMILVLNKVDLVPTSVAAAWVKILAKEYPTIAFHASINNSFGKGSLIQILRQFASLHSDKKQISVGLIGFPNAGKSSIINTLRKKKVCNVAPIPGETKVWQYVALMKRIFLIDCPGIVPPSSNDSDAELLLKGVVRVENVSNPEAYIPTVLSRCKVKHLERTYEISGWNDSTEFLAKLAKKGGRLLKGGEPDEASVAKMVLNDFMRGKIPWFIGPKGLSSSNDEINSSQKVATQQTEGSDQDGEEAEEEWHGISDDGKADESESTKPVAEGSASESTDESAVDDNKNRS

SEQ ID NO: 6962 - protein, 855 aa, Synechocystis sp. PCC 6803
MMSPRLFHQEQSMIDQSTLNTSPQPTITIEDDRTGMSVATLKRAFLDNLFYLQGIDRSQATLYDYYVALAYTIRDRLLHRFIKTVATYKQEKVKVVCYLSAEFLMGRHLGNNLINLGLYDKIDQVMKEFDLDLNEIIEQEPDPGLGNGGLGRLAACFLDSLASLEVPAIGYGIRYEFGIFHQRIQDGWQVEVPDNWLRFGNPWEIPRADESVEVKLGGHTEIIHNEKNQPKVVWIPERTILAIPYDTPVPGYQTNTVNPLRLWKAEASEEFNFEAFNSGLYDRAVAEKMDAETISKVLYPNDNTPAGRELRLAQQYFFVSASLQDLIRIHLRTHPNLDTFYELTAIQLNDTHPAVAIAELMRLFVDRYDYDWDKAWDITQKTFAYTNHTLMPEALERWSVDLFAKLLPRHLEIIYEINHRFLTGLQTWFPNDEALVESLSLIEENHGKKIRMANLACVGSHAINGVAALHTELLKKDTLRDFAKLWPQKFFNKTNGVTPRRWILLSNPELSALVTEKIGDGWLKNLDEMRQIEKFVDDPEFCRRWREIKQNNKRNLAAYLLKYRNVQIDVNSLFDVQVKRIHEYKRQHLAALEIIHLYNRIKQNPHAEIVPRTFIFGGKAAPGYFMAKLIIKLINAVGEVVNNDPDVRGRLKVVFVSNFNVSLGQRIYPAADLSEQISTAGKEASGTGNMKFAMNGALTIGTLDGANIEIREEAGPENFFLFGLTAEQVYAMKENGYHPHTYYDNNFDLKAVIDRIAHGYFSPGNPNLFHPIVESLLHHDPYMLLADYQAYVGCQDEVSKAYADQDRWTKMSILNSARMGKFSSDRTIREYCKEIWDVPPVKISLDEYHPEYADL

SEQ ID NO: 6963 - protein, 469 aa, Synechococcus elongatus PCC 7942
MLVPVILSGGSGSRLWPLSRESYPKQFHALLSDYSLLQETLLRLEGLPGLASPLLICNEQHRFLVAEHLRAIGQTAAAIVLEPEGRNTAPAVAIAALQAQSQGEDPLLLVLPSDHSIADPAAFRATVQTAIALATAGHLVTFGIVPEAPETGYGYIKAGSDLDLGGFAIDRFIEKPNLATAENYVASGCYYWNSGMFLIRASVYLSELARYAPEMFTACEAAWQKRQADLDFVRLDPATFAQCPSDSIDYAVMEHTQQGAVLPLQAGWTDVGSWSSLWQALEQDGAGNVTVGDSLALDCRNVYLRSEGRLVVGVGLEDVVAVETDDALLIAHRDRTQTVKQVVEALQREARRESRAHRKIYRPWGRYDSLDLGDRFQVKRITVNPGASLSLQMHHHRAEHWIVVKGTALVTRDNEEVLLTENQSTYIPVGCKHRLSNPGRVPLEMIEVQSGSYLEEDDIVRFEDHYGRS

SEQ ID NO: 6964 - protein, 190 aa, Oryza sativa
MQARRHRGFRLGRKLLGLWRWALCHRRRRRGRGYLRLQPCPGAAGGRSPLLAAGSVKKQPPPQQQQIVVHQRGGEKAVLKWGRSLARRMRLLRRRGSERLLEESPGEATTPKGQVAVYVGGGEPGESMRYVVPVVYFNHPLFGELLREAEEEFGFAHPGGITIPCAAARFERAAAVAAAGGGGRKVPTWW

SEQ ID NO: 6965 - protein, 97 aa, Triticum aestivum
  misc_feature (67)..(67): Xaa can be any naturally occurring amino acid
  unsure (1)..(97): unsure at all Xaa locations
MPSLQKALPPELADNALRLFRECLRRAKFIGNQQHNTGLLVSMVRQQFKKNMHETDPEKIQKMKDEXSHCSVDNAARGLINHIIYESEKMTGRKFSG

SEQ ID NO: 6966 - protein, 149 aa, Glycine max
MDTGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERASKEPKSPSKATKSPKKS

SEQ ID NO: 6967 - protein, 349 aa, Ustilago maydis 521
MPPKKDKAGSSSKVAVDKTFGMKNKKGGKGQKTVAMIQQQQKVAGKSKEQLAKEKQKEQEKKAAAMAAKERAADPLFSIIQPKVPFGVDPKTVTCAFWKAGRCDKGTKCKYGHSNDAGRKTEKKDLYVDMRDEEEDKKLDTMDKWDDAKLNSVILSKHGNPRSTTDKVCKFFLQAVEDGKYGWFWECPNGGEKCMYRHRLPPGFVLKSQKKELEALEKANEISLEEFLETERHKLGRNLTPVTAESFAKWKKERMDKKQAEHEMLKKKKEAQAAANKMAGLSGREMFSLNPDMFVDDDDDADDDGEFDLNQYMSNNWEQGRQDEQQQAAIYDDQDSPDAAANRLGKLSV

SEQ ID NO: 6968 - protein, 410 aa, Triticum aestivum
  misc_feature (148)..(148): Xaa can be any naturally occurring amino acid
  misc_feature (191)..(191): Xaa can be any naturally occurring amino acid
  misc_feature (200)..(200): Xaa can be any naturally occurring amino acid
  unsure (1)..(410): unsure at all Xaa locations
MGVVSTVLGLFGFGFGFSSGIAIGYYFFIYFQPTNVKDVEVRPLVEYDSNSLDGILPEIPMWVKNPDYDRIDWLNRFLELMWPNLNKAICRMAQDIAKPIIAENCEKYKIDSVEFETLTLGTLPPTFHGMKVYITDEKELIMEPSLKXANPNTDGLWHVDLQVLHRYSKPSTFLINANHMSHLICHTLLLXVARYRRIVXEYSSYASNALGALLYGRPAGGRASDFDRPPGQVGAGDPNDIQNEKSRGQIILEATYKPFKEEDMEKESVDGVDEVQKAPDNSPAGGGLQILLLLLTVEAQDLEGKHHTNPYAKIIFKGEEKKTKVIKKNRDPRWEDEFEFVCEEPPTNDKLHVEVLSKAGKKGILHGKEALGYIDISLTDVISNKRINEKFHLSDSKNGQIQIELQWRTS

SEQ ID NO: 6969 - protein, 962 aa, Prochlorococcus marinus str. MIT 9313
MRHIGPSLEDQQQMLLELGHRDLQSFVAAVVPPDILETTAPSSSLPEGCGEVQAMEELRLIAAANRVRRSLIGLGYYGTATPALIQRQVLENPAWYTAYTPYQAEISQGRLEALFNFQTLISELTGLPIANASLLDEGTAAAEAMSLSFAICKRPAAHRFLVDAEVLPQTLAVLRTRAEPLGIDLEVAEPMTFQFDAEVFGVLLQLPGRSGRLWDPTTSIQAAHEVGALATVAIDPLAQVLLAPVAEFGADIAVGSVQRFGVPMGFGGPHAAFFATLEIFKRQVPGRLVGQSVDAEGQPALRLALQTREQHIRRDKATSNICTAQVLLAVMASFYAVHHGPDGLAAIARRVLRLRAQLERGLHQLGYPVQSIARFDTIEVICREAPAVHQAAALAGFNLRVLPLGVAPEAAHGFGISFDELSTDQELKSILQILAEAAGQPVPVLEDPGNPHLEELVGLPLRQRPWLQQQVFHRYRSETELLRYLQRLVGRDLSLVHGMIPLGSCTMKLNAAAELIPISWREFAALHPFAPQDQCQGYQRLVQDLEHWFADITGFAGVSLQPNAGSQGELAGLLVIRAWHHSRGEQQRDVCLIPTSAHGTNPATCVMAGLRVVPVACDADGNVDLNDLASKAEAHAPQLAALMVTYPSTHGVFEPQIREICELVHGHGGQVYLDGANLNAQIGFCRPGTYGADVCHINLHKTFCIPHGGGGPGVGPIAVSAHLMPFLPGHPLAACGGEQGIGAISAAPWGSAGILPISWMYLRMMGAEGLRQASAVALLSANYLAHRLHPHYPVLFRGQAGLVAHECILDLRPLKRSAGLEVDDIAKRLMDYGFHAPTVSWPVAGTVMVEPTESESLEELNRFCDAMIAIREETAAIESGQIDPQNNPLRRAPHTLAAVTAEVWDRPYSRAEAAFPLAEQRQSKFWPAVSRIDNAYGDRNLLCSCPSVEELADNAVLKPPLV

SEQ ID NO: 6970 - protein, 492 aa, Mycobacterium tuberculosis CDC1551
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 6971 - protein, 122 aa, Allium cepa
GYLKKGRYAQRVGTGAPVYLAAVLEYLAAEVLELAGNAAKDNKKNRIIPRHVLLAIRNDEELGKLLGGVTIAHGGVLPNINPVLLPKKIAAKGIRDSKSPKKTAAKSPKKVAAENTQKSVAA

SEQ ID NO: 6972 - protein, 480 aa, Desulfovibrio desulfuricans G20
MSESAPSSAMERCHAVILAGGSGTRLWPLSRALFPKQLLALNGELTLLQQTVKRALDIFPPQRIHIVTNEEHVFEVRAQAKALDAALEDNVLAEPMIRNTLPALMLGLNAAMKQDAAPLLAVFPSDHMIHNAASWQRAVQAGAELAAQNHFVTFGIPPAHPETGYGYIHRGARIADGCYAVEGFVEKPPREKAEEFLRGGMHFWNSGMFVFNGEDLIAALETYQPALAAWWNTRTATSLRQGYSAIPSLSIDYGIMEHVSRIAVVEADFGWDDLGSWEAIFRLGEKDEQGCVVQGDAMAIDCENSLLLSRGGKLAAIGLKDVIAVQTRDATLLCAKDQVQRVREVVSRLKAEGSPLTEVHLTVHRPWGSYTVLEENAGYKIKRIAVHPGARLSLQRHYHRSEHWVVIQGTALVQVGDKEMLLSQNQWAEIPETAVHRLTNPGRIPLEIIEIQTGPYLEEDDIERFEDVYGRPKGGKNKSN

SEQ ID NO: 6973 - protein, 834 aa, Actinobacillus pleuropneumoniae serovar 1 str. 4074
MGNKALSPENIQQVKDAILYKMVFALGVEPREASKRNWLNAALRVVRDLSTESWLQTRRSQVANGSRRVYYLSMEFLMGRTFSNAMIAEGVYELIDAALKELGQNLEDIINEEGDPGLGNGGLGRLAACYMDSLAAMKIPAIGYGIRYEYGMFRQEIRNGEQVEQPDQWLENEFAWPYLRSSKRFPIRFGGRVWNEGSKVVWQPDEEIVAQAHDQLIPGFETTATNSLRLWSAHASGKGFGLADFNRGDYFSAMSHQNLSENVSRVLYPDDSTYNGRELRLRQEYFLCSASVQDIIRRHETECGSCVNLVDKVAIHLNDTHPTLAVPELMRILIDEKGYSWEQAWSMTRKIFYYTNHTLMSEALETWPVEMLGRILPRHLGIIFEINEWFLNEVREKFPGDEDLVQRVSLIDEHGDRRVRMAWVAVVASTKVNGVAKIHSDLMVESIFADFARIYPDRFTNVTNGVTPRRWLRIANPGLANILDKRIGTNWLTNLSELEKFNVFIDDADVQAEVAAVKYENKRKLAEYVEKNLGITLNPEAIFDVQVKRIHKYKRQQLNVLHIITLYNRILKNPNADWTPRVFIFAGKAASAYYAAKKVIRLINDVANVINNDERIRDLIKVVFIPNYGVSLAQMIIPAADVSEQISLAGTEASGTSNMKFALNGALTIGTLDGANVEILDCVGKDNIFIFGNTVEQVEELRRNGYSPYHYYETDGELNEAVSQILNGKFSPDDPYRYQDLILNSGDYYQACADFRSYVEAQEKVAAAYRNKKAWTRSAIINIANMGYFSSDRSVLDYARDIWHIEPMDELQLKDNADLKSILESSNKLLGSRK

SEQ ID NO: 6974 - protein, 559 aa, Oryza sativa (japonica cultivar-group)
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACSETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 6975 - protein, 271 aa, Haemophilus somnus 2336
MQHKLISFIGGGNMAQAIVLGLLKQGYPAHYIRVCDPNQSRRDLFIAQGTQVSSNNVEAIQDADVVLLAVKPQIMAEVCVPLSAVDFSDKLVISIAAGISTVRLTALLPSAKNIIRVMPNTPALVSAGMAGLFATPQVSVNLKQFAQDLLSAMGEICWLEQEQDMHAVTAGSGSSPAYFFLFMEAMQQALIEMNLDPKTARLLVQQSALGAAKMVIENPQIALSELREDVTSKGGTTASALAVFNEQNVTQIIKQAMLACVKRSQEMESLF

SEQ ID NO: 6976 - protein, 88 aa, Zea mays
MSAGSERPYAFSPPSAVPGPFSRGSGSAPTTAATDSTGRSSSSVAPTKSRKPPFRPAVDDTKPVLRDPISRSDLAVTEQVVLRLPPFP

SEQ ID NO: 6977 - protein, 320 aa, Salmonella enterica subsp. enterica serovar Typhi
MKDTTVPLTLISLLADGEFHSGEQLGERLGMSRAAINKHIQTLRDWGVDVFTVPGKGYSLPEPIQLLDADRIHSQLDSGNVAVLPVIDSTNQYLLDRIGELRSGDACVAEYQQAGRGRRGRKWFSPFGANLYLSMYWRLEQGPAAAIGLSLVIGIVMAEVLRELGADKVRVKWPNDLYLLDRKLAGILVELTGKTGDAAQIVIGAGINMAMRRVEEDVINQGWITLQEAGITLDRNMLAAKLIYKLRAALELFEQEGLSPYLSRWKKLDNFIDRPVKLIIGDKEIFGISRGIDTQGALLLEQDGVIKPWMGGEISLRSAE

SEQ ID NO: 6978 - protein, 483 aa, Bacillus cereus ATCC 10987
MDKKATFVNVEKKAMYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKVVEAVIGSKFRNAGQTCICTNRVFVQEEVYEVFAEKFQKSVGQLKVGDGFGDGTTVGPLIDENAVSKVQEHIADAIQKGGTVLYGGQKVAELDGHFMQPTVIGLANDTMLCMNEETFGPVAPVAKFKTVEEVIERANNTPYGLAAYIFTKDISQAFQISEALEYGIIGLNDGLPSVAQAPFGGFKESGIGREGGHFGIEEYLEIKYISLGL

SEQ ID NO: 6979 - protein, 568 aa, Arabidopsis thaliana
MARFAVIGLTFLLLLGTSLSARSDEETRERFYGNVVNSTAPGNGEGSIAKMFDRVLEKEFSENDSPEGSDGASFNSSVADQQAEIETVAKVTHEKGKRNDTQENNGTRPFQLQDVFSLENEDSDDMTLIDKKNNVFVMSNKKSKYPILQVDLRLISDLVVIIVFAAIGGIVFSCLGQPVIVGYLLAGSIIGPGGLKFISEMVQVETVAQFGVVFLLFALGLEFSMTKLKVVGPVAVLGGLLQIVLLMFLCGVTALLCGARLSEGIFVGAFLSMSSTAVVVKFLVERNSTSSLHGQVTIGILIFQDCVVGLLFALLPVLGGNSGLLQGIISMGKLLLILSIYLTVASLLTWSFVPRFLKLMIQLSSQTNELYQLAAVAFCLLSAWCSDKLGLSLELGSFVAGVMLSTTEFAQHTLEQVEPIRNLFAALFLSSIGMLINVHFLWNHVDILLASVILVIVIKTAIAAVVVKAFRYNMRISFHVGVLLAQIGEFAFVLLSRASNLHVIEGKMYLLLLGTTALSLVTTPLLFKLIPSAMNLGVLLRWFPSENSSPNESLQEKASLIEVHNRTK

SEQ ID NO: 6980 - protein, 461 aa, Burkholderia vietnamiensis G4
MVSGNEKDGLKRGLKNRHIQLIALGGALGTGLFLGIAQTIKMAGPSVLLGYAVAGVVAFFIMRQLGEMVVDEPVAGSFSYFADKYVGHFTGFLSGWNYWVLYILVSMAELSAVGIYVQYWWPGVPTWVSALVFYVAINLLNLASVKSYGETEFWFSIIKVAAIVGMIGFGGWLLVSGHAGPEASIANLWQHGGFFPNGVSGLVMSMAAIMFSFGGLELIGITAAEADDPKHSIPRATNQVIYRILIFYIGALAVLLSLYPWEKVVTGGSPFVLIFHALSSNLVANVLNVVVLTAALSVYNSGVYSNSRMLFGLATQGNAPKVLCSVNRRGIPLAALGASALATGVCVLVNYFMPGKAFEVLMGLVVSALIINWAMITLIHLKFRQAKRIAGEQTSFRSLGYPFTNYLCLAFMAGILVVMYLTPDLRLSVYLIPVWLAVLAIGYRFRQKNARYALGDGASAR

SEQ ID NO: 6981 - protein, 347 aa, Wolbachia endosymbiont of Drosophila melanogaster
MTPEGFHIHHYKKVSSTNKEALDLIDKGISNETIIVADKQTEGRGRTGKNWISPEGNFYASLVINLFNDYLNESQLSVSFQRVTLESRNQEEWSSTQLYKRCGIPTKDDVIRVAWHWDPENLITNGHIRQLCNKNWIPVSRTGMTPHTTCKLQCSHSYVSSTGENTGMIERGLMNQVSKLTELTFVTALAVGNAILSFINGLNLQYKWPNDILIDGKKISGILLEKRSNSNWLIIGIGINVSHAPLPGTTCISNYGESVSNIDLLKKLIINFNKLRKQWLLDGFYAIREMWLKKAFKMNEQISVKLADKLYEGIFADIDKSGKLVLQQKDGSLIYFDAGELFIDNAL

SEQ ID NO: 6982 - protein, 309 aa, Apium graveolens
MAITLNSGFKMPVLGLGVWRMDRNEIKNLLLSAINLGYRHFDCAADYKNELEVGEAFKEAFDTDLVKREDLFITTKLWNSDHGHVIEACKNSLKKLQLEYLDLYLIHFPMASKHSGIGTTRSILDDEGVWEVDATISLEATWHEMEKLVEMGLVRSIGISNYDVYLTRDILSYSKIKPAVNQIETHPYFQRDSLIKFCQKYGIAITAHTPLGGALANTERFGSVSCLDDPVLKKLSDKHNKSPAQIVLRWGVQRNTIVIPKSSKTKRLEENINIFDFELSKEDMELIKTMERNQRSNTPAKAWGIDVYA

SEQ ID NO: 6983 - protein, 284 aa, Arabidopsis thaliana
  misc_feature (260)..(260): Xaa can be any naturally occurring amino acid
  unsure (1)..(284): unsure at all Xaa locations
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQRRLESLLNSPSVTTALTVLVSSYSPLPFRASAPAQAVAVRYYLLVRLKLTFVFACICPPLSVDVRXTRAVGVVLNVVAAQLLLVDYSSGD

SEQ ID NO: 6984 - protein, 425 aa, Campylobacter lari RM2100
MKNNKKAFEEACEYIAGGVDSPVRAFASVGSNPLFIKKGKGAYISDIEDNTYIDYVQSWGPLLFGHCDEDVEKACKKALEHGSSFGAPTLAETKLAKFILQDWPHLDKIRFVSSGTEATMSAIRLARGFSKKDKIIKFEGCYHGHSDSLLVSAGSGAATFNTPSSLGVLEDVAKNTLVAIYNDIDSVKNLVEKHSDIACIIIEPIAGNMGLVPAKKEFLQELQALCKKHQILLIFDEVMSGFRASYLGSYGIYNIQADIVTFGKVIGGGMPAAAFAARAEIMDLLSPLGGVYQAGTLSGNPLAMASGYASLKKARNYEGLYEKLEKLGKRLTQGLKEAANDCKIPLQVNCVGSMFGFFFCENPVNNYQDALKSDTKLFAKFHAQMLSKGIYLAPSQFETGFICESMDKKIIEKTIQAAQESFKTL

SEQ ID NO: 6985 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPNTRYPGVDFDGGFASFVVVPESVCWPVPCGIPPLQAAMMEPFGLAVHASLEGSGVSGLNVLVSGCGPIGLMNIAAAKALGASKVIATDIHPLRLTAAAKMGADECINATEESVYKTVRSLLGERGVDVAIDYSGQAAALKELIQSITHGGELRLMGVPSHDILLNLEEWLFKGLIVRGLHGRRLFETWERSTSLLVTGRVDLSSLVSHRLPLSAAEDAFEMALNGQSLKILFEPNGTCI

SEQ ID NO: 6986 - protein, 388 aa, Campylobacter lari RM2100
MLSQRSQNLGESLTLVMTDIAKTLKANGEKVISFSAGEPDFDTPEIIKKAAIEAIEKGCGAYTPVVGIKEVIEAIQYKFKNDNNLEYKASEIITNVGAKHSLFMAIECLVEEGDEVIIPSPYWVSYPEMVKFAGGTPVFIEGDAKNGFKITPEQLKQAITPKTKVLMFNSPSNPTGAIYSKDEIIALAKVLEGSKIVVLSDEIYEKLVYDGEFFAFAQASEDASNRTVTINGLSKCGAMPGWRFGYMASKMSEFNKAIKKLQGQSTSNICSIVQHAALPALLGKANDDIEMMRQAFLKRRNLACEILSKCEKIKLEQIPQGAFYLFISCKELDNDSMRFCKRLLEEQKVALVPGVGFGMEGYFRLSYATSENDIKEGCEKIINFVKNY

SEQ ID NO: 6987 - protein, 955 aa, Vibrio fischeri ES114
MSQLLQQLGTDNEFIRRHNGPASSEHQHMLNTIGAETLQQLIEETVPSSIRLPQPMQLPHGLSENAMLAELKQIAQQNTLNTSYIGQGYYNTHTPNVILRNVLENPGWYTAYTPYQPEISQGRLEALLNYQQMVMDLTGLEIANASLLDEATAAAEAMTLCKRGGKSKSNLFFVADDVHPQTLAVIKTRAKFIGFDVVVDHESNLDSHDVFGALLQYPGTTGEVKDLTDLIAQAHTKKTLVIVATDLLASVLLKPVGEMGADIAIGSAQRFGVPMGYGGPHAAFMATREKLKRSMPGRVIGVSIDSKGNQALRMAMQTREQHIRREKATSNICTAQALLANMASFYAVYHGPEGLKTIARRVHHFTAIVAKALQTAGFELEHQHFFDTLTVKTEQQTDILYTKALASSINLRKFDTKLGISFDETTTVSDLVTLLAVFGIDNAECETLSAEVGKDEFAAIPKHCQRTSSFLTHPVFNTYHSETQMLRYLKKLENKDFSLTHGMIPLGSCTMKLNAVAEMLPVTWPEFGGIHPFAPLNQAAGYTTLATSLKSMLCEITGYDEFSLQPNSGASGEYAGLIAIQRYHESRGDAHRNVCLIPSSAHGTNPATASMVSMKVVVVKCDENGNIDMIDLAEKIEKHQENLSSIMITYPSTHGVYEEQVREVCDMVHAAGGQVYLDGANMNAQVGLTSPGFIGSDVSHLNLHKTFCIPHGGGGPGMGPIGVKSHLAPFLPGHTENGVQGMDYAVSAADLGSASILPISWAYIAMMGEMGLTEATKVAILNANYVMERLRPHYPVLYRGTNGRIAHECIIDIRPLKETTGISEEDIAKRLMDFGFHAPTMSFPVAGTLMVEPTESEDLAELDRFCDAMIAIREEMNKVEQGEWPLDNNPLVNAPHTQVDLMSDSWEHPYTREVACFPSSQSKDSKYWPTVNRVDNVYGDRNLICSCPSIENYEE

SEQ ID NO: 6988 - protein, 484 aa, Agrobacterium tumefaciens
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLCSAIG

SEQ ID NO: 6989 - protein, 591 aa, Oryza sativa
MPDVIRIDTTIVILNSDAPPGDSPSPSVAVPSPATVLLTGVPPERLEVHLSSSAVSPLGQKRTRRMEEVRVRESKDHRGGGGGGDGDGERTGRWRAEEVIAGNRAVLEALRELVTYPVLYAREARVLGLNVLSPIPLLFVPIIIKCTCFFPEDCCSTAPLALERREQGSRIVGQLLTLMDGKSSKLLPHLVVVASATRVDAIESALRRPGRFDSEIEVTVPTAEERFEILKLYTKNLHLGECVDLQSVAASCNGYVGADLQALCREAARRAYGRLSSSSESENVLTLIMEDWESAKSVAKNSVTRGVTKEIPAVSWDDIGGLKAVKKKLQQAVEWPIKHAASFDRLGISPIRGVLLHGPPGCSKTTLAKAAAHAAQASFFSLSGAELYSKYVGEGEALLRRTFQMARLASPSIIFFDEADAIAPKRTGPSGNSSGNATVGERLLSTLLTEMDGLELATGIIVLAATNRPNAIDAALLRPGRFDMVLYVPPPDAEGRYEILRIHTRKMPLGDDVDLWKVAERTELFTGADLEGLSREAGMAALRESLRSERFVCDDIHFQAALRSLRPSLTQSVVDEYSNAAIHGPLTRRKH

SEQ ID NO: 6990 - protein, 589 aa, Medicago truncatula
MGKNQKTELGRALVKQHNQMIQQTKEKGKIYKKKFLESFTEVSDIDAIIEQADEDVDEQQLLDIPLPPPTALINLDHASGSDFNGLTVEEMKKEQKIEEALHASSLRVPRRPFWSAEMSADELHANETQHFLTWRRSLARLEENKKLVLTPFEKNLDIWRQLWRVVERSDLLVMVVDSRDPLFYRCPDLEAYAKEVDVHKNTLLLVNKADLLPASVREKWAEYFRAHDILFIFWSAKAATAVLEGKKLGSSQADNMASADNPDTKIYGRDELLARLQSEAEAIVDMRRSSGSSKSSDDNASVSSSSSHVVVGFVGYPNVGKSSTINALVGQKKTGVTSTPGKTKHFQTLIISEKLILCDCPGLVFPSFSSSRYEMITCGVLPIDRMTQHRECVQVVANRVPRHVIEEIYNISLPKPKSYESQSRPPLASELLRTYCASRGQTTSSGLPDETRASRQILKDYIDGKLPHYEMPPGLSTQELASEDSNEHDQVNPHVSDASDIEDSSVVETELAPKLEHVLDDLSSFDMANGLASNKVAPKKTKESQKHHRKPPRTKNRSWRAGNAGKDDTDGMPIARFHQKPVNSGPLKV

SEQ ID NO: 6991 - protein, 509 aa, Bifidobacterium adolescentis
MSDVTAAKKPRGTDDVPVPPTLRKSLKNRHIQLIALGGAIGTGLFYGSSESIQLAGPSILLAYLVGGLAIFMIVRALSEMAVEDPKAGAFSYYATRYWSRRAGFISGWNYWFNYVLVAMVELAVVGSFVNYWFPNIPKWVSAAVFLVAIAALNLMGVNKFGEFEFWFAIIKIVAVLAMILGGLYVVIANVPTASGIRASFANWFTVDGGFLPHGLMTRNADGTWTGLLMALVVVMFSFGGTELIGITAGETENPRTTIPKATNGIIWRILVFYICALGVIMAVIPWSKIDGDSSPFVQIFDSVGVHAAAGILNFVCLTAVMSVYNSGLYANSRMLYSLAKQGNAPAYLGKLSKKGVPVGGVITSAIIIAIAVVVVFVWPEFAFNYLMSIATIAAAINWIMIMITEIKFRRMVAAGDGPAELKGLKGKEALDKIAFKLPFANVTPYVVIAFMLLVVVLMCFSASYRIAVIAGVIWLAVLFAAAQLALGKSGSERGEDAAVIVDAAAATAE

SEQ ID NO: 6992 - protein, 263 aa, Triticum aestivum
  misc_feature (246)..(246): Xaa can be any naturally occurring amino acid
  unsure (1)..(263): unsure at all Xaa locations
RGKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMXALEIAERTRDAILSGKV

SEQ ID NO: 6993 - protein, 256 aa, Symbiobacterium thermophilum IAM 14863
MRTPIVAANWKMHKTQPEARQFLADFLPREAGMSGVEIVICPPFTALAAVAGGLTGTRVGLGAQNMSDKPSGAFTGEVSGAMLVDAGCRYVILGHSERRRLFGESDEVVGAKVRAALQHGLIPILCIGETLEEQQAGEADAVNRRQLLAGLEGLTPEQVANLVIAYEPVWAIGTGRNCDPGDAQARIAAVRAVVAEAFGPEAAARVRIQYGGSVKPENMAAYMAQPDIDGALVGGASLDPTSFAAICAAAAEARAR

SEQ ID NO: 6994 - protein, 557 aa, Enterococcus faecalis V583
MNRNWWQKEVAYQIYPRSFSDSNNDGIGDLQGIIQKLDYLENLGITLIWLSPMYPSPMADNGYDISDYYGISSDFGTMADFDELIEEAKKRNIKVILDLVVNHTSDEHAWFQDVLKNPQSRFRDFYIIKEGREAPTNWRSNFGGSVWEKLPGEDAYYFHAFHKKQPDLNWENPELRKEIYQMIRFWLNKGIAGFRVDAINFIKKDLTWTNLPADGADQLAKVTKASRNMPGMSDFLNELKEKAFAGFDIVTVAEAAGVNYLNLSEFIGETGYFDMIFDFKWADLDVKSGSEWFYRIDWSWNDLRTLIFKQQEAMQEAGWSANFIENHDQPRATTKYLKEQAQQPNAVKTFGAMYFFLRGTPFIYQGQELGMTNFERGSIDEFDDISSIDQYYRAIKEGFTPKEALSLVNLRSRDNARTPFPWNDSMYGGFSSVKPWLGMVDNYKEINAEAEIKNSQSIFHFYKRMIAFRQKSPYTDILLYGTFEGLSNLPDNVIAYKRKLNEKTIYAFFNFGEAVPIPHYLVNGTVIFDTQSEEREQLVQQGTLLKSYQGLLITINE

SEQ ID NO: 6995 - protein, 506 aa, Candida tropicalis
MIEQVLHYWYYVLPAFIIHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 6996 - protein, 380 aa, Thermococcus kodakarensis KOD1
MDVFLELALILVVAKLFGYLTVRLGFPAALGQLIGGILIGPSILGIVSYDEAVRLIGELGVVMLLFLAGLETDIEEFKHVGIPAFIVAAMGVLVPFLLGYFGALAWGYSHVQALFLGGILTATSVGLTTSILMEMKKLRTRVGTTILAAAVVDDVLGIIALTILVGINTRGSVYAKDLLIIIGEVALFFLIGLLVGTPAVKEALKASEKITLPETVTAMAIAIMLIFAYLAEQFQIAGITGAYLAGILVATTEEARKVADKTVTIGYSLFIPVFLVSIGIESDVRILTTAGTFALVYALLAVVSKVVGCGLGALFAKFKPIEAIQVGVGMVPRMEVALIMANVALREGVFDRGVFAIPVTMVVITTIVTPFLLKWAFSRE

SEQ ID NO: 6997 - protein, 517 aa, Symbiobacterium thermophilum IAM 14863
MSAYRRPVALIVLDGWGLNPDPRANAVAMARHPNFDRLMARYPHTTLTASGEAVGLLPGQMGDSNVGHLNLGAGRIVYQTLVRIWRSIQDGSFYTLPVWRPVLDRAKQPGKALHLMGLVSDGGVHSHIDHLLALIDLAKRENVERVYVHAFLDGRDVPPQSALPYLERVEAKLKETGIGAIATISGRYYAMDRDKRWDRTEKAFLAITQGIGHTAGSVAEAVERAYARGETDEFVQPTVIEGVDGRVREGDGVIFFNFRPDRARQLVRALHETAFDGFKRPEGYRPVELVTMTQYDQTFTDIPVAFGPQFVDVPMGQVVAEAGLRQLRIAETEKYAHVTYFFNGGEERVFPGEERVLVPSPKVATYDLKPEMSAYEVAREAVKWIEEDRTDFIVLNFANPDMVGHTGVLEAAIRAVEAVDECLGQVVDALLAKGGAAVIIADHGNCDQMVDYETGAPHTNHTLNPVPCILVDDQRLDAKLKPGVLANVAPTLLEIIGLPKPPQMDADSLLVSNAEGA

SEQ ID NO: 6998 - protein, 274 aa, Rhodospirillum rubrum ATCC 11170
MGCLTTDTPLAGVSLLLLGCGKMGGALLNGWLGRGLEPSAVHVVDPLADLPAGVTRLTAEQAVALPPPDVCLVAIKPQVVPEVLPAYAPLAQAGTVFLSVAAGKTIDGLSGLLGGDAAVVRAMPNTPAAVGRGASVLCANARVPAPTRALCETLMAAVGTVEWVDDESLIDAVTALSGGGPAYVFLLVECLAEAGRANGLPADLAMRLARSTVAGSGALLDGSAEDAATLRKNVTSHKGTTAAALAVLMAEDALQPMVTRAIAAAAERSRELAS

SEQ ID NO: 6999 - protein, 399 aa, Pseudomonas aeruginosa PAO1
MSGNRGVVYLGPGKVEVQNIPYPKMQDPQGRQIDHGVILRVVSTNICGSDQHMVRGRTTAPEGLVLGHEITGEVVEIGRGVETMKIGDLVSVPFNVACGHCRTCKEQHTGVCLTVNPARAGGAYGYVDMGGWVGGQAEYVLVPYADFNLLKLPNREAAMEKIRDLTCLSDILPTGYHGAVTAGVGPGSTVYIAGAGPVGLAAAASARLLGAAVVIVGDVNPTRLAHAKKQGFEIADLSKDTPLHEQIAALLGEPEVDCAVDAVGFEARGHGHSGSQQEAPATVLNSLMGITRVAGKIGIPGLYVTEDPGAVDAAAKHGALSIRFGLGWAKSHSFHTGQTPVMKYNRQLMQAIMWDRIKIADIVGVEVITLDDAPKGYGEFDAGVPKKFVIDPHNLFRAA

SEQ ID NO: 7000 - protein, 473 aa, Leuconostoc mesenteroides
MKKTKIVSTLGPSSSDVETIVKLIQAGANVFRFNFSHGDHEEHLGRMNAVHEAEKITGKTVGILLDTKGAEIRTTKQADGKIEFHTGDTLRIAMDENLEGTKEKIAVTYAGLFDDVKEGGQVLFDDGLLGTTVIEKDSATRELVVRVDNDGILGSRKGVNAPGVSINLPGITEKDADDIRFGLDHEINYIAASFVRKPEDVLEIRGLLKEKNMEHVQIIPKIESQEGIDNLDAILEVSDALTVARGDMGVEIPAENVPLVQKDMIRKMNKAGLPVITATQMLDSMEENPRPTRAEASDVANAVFDGTDATMLSGESANGDYPVESVATMAAIDEKAETSLRENGRHEDIFFDETDSTEAVAASVARIARNVNAKAVVVSTNSGYTARMVSKHRPDVNILAVTYSERVQRGLTLNYGVVPVVYDAPKTIDEMVDLAKKAVKDQGLANSGDTIVIAAGVPMSQSGTTNMLTVQTV

SEQ ID NO: 7001 - protein, 272 aa, Tropheryma whipplei str. Twist
MICMSRKPSPTRRTRIHRFHKGSCGRKLVGLTCYDFSTARVLSDCELDFLLVGDSASGVIYGYENTGSVCLDEIIYLAAGVVRGAPNSFIIVDLPFGTYEKSDELAVETAIEVIKRTGASAVKLEGGARMACRISAIVRAGVPVMGHIGFTPQTINALGGYKIQGRDNADLIYLDAQAVEQAGAFAVVMEMVTEDLAKTITSEIKITTIGVGAGRYTDGQLLVINDLIGLSEKKITFAPRYASIDNTVASCVKLWRKDVLEGNFPQKDHIPA

SEQ ID NO: 7002 - protein, 482 aa, Tropheryma whipplei str. Twist
MGRGQRCCVFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 7003 - protein, 611 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKAISDLSISEPKRESMSQCENIIGDGNDTCGLSCMNAFLCTYHCEANASLSVKKKPELALTRLEEDDTTYRQICAGAAAVRAMEEGRGGDPPSSSSSAAAAAGVAIGYPFLEPQQGARLRRRRTISPFKKYFSRGFAIGMEIAFIVFGTIVHFPVWARIFLIISLSILPFSAFSITFQEY

SEQ ID NO: 7004 - protein, 319 aa, Shewanella sp. MR-7
MSDNWVRKREILGLLSSEYFVSGEELATQLGISRAAVSKHVDALEDYGVAIYSVKGRGYKLANPISLIDSARLIQSIDNRCFYFDEIPSTNGFMLSHTGELKSGDLCVAEYQSAGRGRRGRTWGSPYGHHLYFSQFWSFPQGMAQAMGLSLVVACSLVEVLKSFGVDNIGVKWPNDIYLNYKKLAGILIEMSGQADSECQLIIGIGVNMAMSEDQGKGIDQPWSDLSALATMPNKTDLVIALQKQLKKDIQLFEREGLAAFKLRWQGADLFYGKEIRLLMGENHVEGICRGVDEQGAVLLETADGTQAYIGGEISLRPR

SEQ ID NO: 7005 - protein, 328 aa, Triticum aestivum
LAMNGAALDNVIRRLLEVRRGRPGKQQVQQVQLGEGEIRQLCAAAKDVFMRQPNLLQLDAPIKIAGDIHGQYTDLLRLFELGGFPPQHKYLFLGDYVDRGKQSIETICLLLAYKLRYPEHFFLLRGNHECASVNRVYGFYDECKRRYSVRLWRHFSDCFNCMPVAALVESRILCMHGGLSPDLRHVRDIAGLSRPVDVPDTGLLCDLLWSDPGGAAGWGPNERGVSYTFGADVVAAFMERHDLDLVCRAHQVVEDGYEFFAGRRMVTVFSAPNYCGEFDNAGALMCVDDDLTCSFQILKPVDNRQRRFAFGMGSSATTTSRGIRSPWC

SEQ ID NO: 7006 - protein, 796 aa, Zea mays
MVLTLLLLLLLPAASRARDTITPGQPLRGNDTLVSSGAGSFVLGFFSPPGSNSTYVGIWYAKVPVRTVVWVANRAAPVRGAASESAGATLSVSSECALAVADANATVVWRSLSSSSPRPCAARIQDDGNLVVSDQRGRVVWQGFDHPTDTLLPGMRLGVDFAAGANMTLTAWASPSDPSPSPVVAAMDTSGDPEVFIWNGPAKVWRSGPWDGVQFTGVPDTVTYKGMGFSFRFVNDGREATYSFQWYAPKDQCDALSPCGPNGVCDTNKVPACSCLPGFTPRSPASWAMRDGRDGCVRATPLDCANRTDGFLVLPHAKVPDATRAVVDFNSSLEQCRQRCLRNCSCTAYASANLTAAPGRRGCVMWTGGLEDLRVYPSFGQELYFRLAAADLASKGKSKKVSIVVAIAVSITAALAVLLAITGFYIWRANKTKARKSGSSIWAAGSHNKDGSEGKDNGDDLELPVYDFETIAAATEGFSAENKLGEGGFGPVYKGKLEDGQEVAVKTLSRTSRQGLEEFKNEVLLIAKLQHRNLVRLIGCSISGPEKILIYEYMENKSLDFFMFDTTRSKLLDWQTRYRIIEGIARGLLYLHQDSRYRIIHRDLKTSNILLDKDMTPKISDFGMARMFGSDDAEINTLRVVGTYGYMAPEYAMDGVFSVKSDVFSFGVIVLEIIAGKRNRGVYRYSGHLNLLAHAWSLLNEGNGLDLVDENLNGSFNSDEVLKCLKVGLLCVQENPDDRPLMSQVLMMLASTDTASLPTPKQPGFAARTAAAEDTSWSKPDCSIVDSMTITMVEGR

SEQ ID NO: 7007 - protein, 394 aa, Lactobacillus acidophilus NCFM
MPNLSNDLQSIINNRLNNLSASKIRAFDQKVSSIPGIIKLTIGEPDLATPDHVKDAAINDIQANDSHYAPQAGKPELLDAISNYLDRSIGVHYDPESEICVTVGATGALNDVFMTLLNPGDKILVPTPVWALYFQLIKMTGAIPIQIDTKKDGFVLTPEHLRHVLNGRGKGAKAIILTDPSNPTGRVYPEEILKELAKIIKEYKIYSITDEIYAELVYGDAKHHSLSEYIPEHNILISGLSKAYAMTGWRLGYIAGPKQIMKAIRKVNSFLITSVTDNVQMAAVEALNNGQNDPKEARKIYESRLRFMQTGLEKLGFEMATPQGAFYIFAKIPEKYGTDDENFAFELAQKAKVGVTPGRYFGKGGEGYVRLSYASSTEQLRESLQRITNFVDNL

SEQ ID NO: 7008 - protein, 379 aa, Triticum aestivum
  misc_feature (329)..(329): Xaa can be any naturally occurring amino acid
  misc_feature (360)..(360): Xaa can be any naturally occurring amino acid
  misc_feature (376)..(376): Xaa can be any naturally occurring amino acid
  unsure (1)..(379): unsure at all Xaa locations
SAVARGCPSLRSLALWDVPQVTDAGLAEIAAGCPSLEKLDITGCPLVTDKGLVAVAQGCPDLKTLTIEACSGVANEGLKAIGRCCSKLQAVNIKYCPRVRDQGVSGLICSATASLAKVCLQGLSITDASLAVIGYYGKAITNLTLTRLSAVGERGFWVMANALGLQKLRCMSITSCPGVTELALVSIAKFCPSLKQLYLRKCSQISDGLLKDFAEAAKVLENLQIEECNRITLMGILSFLLNCSPKFKTLSLVKCTGIKDICSAPAQLPVCKSLRSLTIKQCPGFTDASLAVVGMICPHLENLDLSGLGAVTDDGLLPLIRSSESGLVXVDLNGCENSQDAAISALVKAHGTFLAHLSLXEGCSKITDAILFAISXDCS

SEQ ID NO: 7009 - protein, 323 aa, Oryza sativa
MAVVVPEAVLRHGDARPMPAVGMGVAEYPSTPERTRDAVLAALEAGFRHFDTASLYRTEAPLGEAIAEATRRGLLASREEAFVTTKLWCTQCHPDLVLPSLRESLRNLQMEYVDLYLIHLPISVKPGPMVFPVKKEDVVPFDFGGVWRAMEECHRLGLAKAIGVSNFTTKHIDKLLAVATILPAVNQVEMNPTWQQRTVREYCDAKGIRVTAYSPLGGQNWGGSANYVMESSVLTEIARARGKSIAQVSLRWIYEQGVTPIGKSYRKERLKENLEIFDWELTDEDRLKISQIPQRKRVTAASLFSPDGEFTSVDLPDIEIVEE

SEQ ID NO: 7010 - protein, 529 aa, Zea mays
  misc_feature (292)..(292): Xaa can be any naturally occurring amino acid
  unsure (1)..(529): unsure at all Xaa locations
SNRGNRWDMRNSVSERSFLIESDDDDDAAVEDGKRRGLGGGGGGDDDDDGSDSSSPCDSPRVVAARCSQPSSYTQQWPQSYRQSIDMYSSVHSPNLSFLGTPSLSRLSNSFLTNSFRGKPPEIISSLIKPLLPTSIASASDDQQQQQHEDVRKSSHYLPPSRKASSLQRIPEDQRPMVGGHEVGPYRQCSYTQGVMNGVNVLCGVGILSTPYAVKQGGWLGLVILAVLGALAWYTGILLRRCLDSKDGLETYPDIGHAAFGTAGRIIISASIFCTSNAHQLSVLYYSYHAVXGVWFFFFANSSAFVCLCNLQIILYMELYACCIEYLILESDNLSKLFPNAHLTMGNLTLDSHMLFAILTALVVMPTTWLRDLSCLSFISAGGVIASIVIVSCLFWVGLVDHVGTVESEGTALNLPGIPIAIGLYGYCYSGHGVFPNIYSSLKKSNQFPAVLFTCIALSTVLFAAAAIMGYIMFGESTESQFTLNLPPNLVASKIAVWTTVTNPITKYPWTSTSAFCVHLFPYLTSNIT

SEQ ID NO: 7011 - protein, 337 aa, Zea mays
MVELTSLSPGPPRPSPFTPRRRPPPTPHVRTSSRRRGRILGAATATPGADDYHSTIRSLNSRGRHVPRKSLGQNYTLNSKVNEELVAAAGVEDGDVVLEIGPGTGSLTSALLQAGATVFAVEKDKHMATLVKDRFGSTEQLKVIEEDITKFHIRSHFLPFMKEKYGATKKLAKVASNLPFNVSTEVVKLLLPMGDVFSVVVLMLQDETAVRLADASIQSPEYRSINVFVDFYSEPEYKFRVDRENFFPRPKVDGAVISFKLKNAEEYPPVSSPKSFFSMVNSAFMGKRKMLRKSLQHICSSSDIEAALDNIGLPVTARPSDLILDDFVRLHNHLAKV

SEQ ID NO: 7012 - protein, 505 aa, Candida tropicalis
MYQLFCFLAGIIVVYKAAQYYKRRTLVTKFHCKPARISPNKSWLEYLGIASVVHADEMIRKGGLYSEIDGRFKSLDVSTFKSITLGKTTYVTKDIENIRHILSATEMNSWNLGARPIALRPFIGDGIFASEGQSWKHSRIMLRPVFAKEHVKQITSMEPYVQLLIKIIKNHEGEPLEFQTLAHLFTIDYSTDFLLGESCDSLKDFLGEESNSTLDTSLRLAFASQFNKTQQQMTIRFMLGKLAFLMYPKSFQYSIQMQKDFVDVYIDRVVGMSEEELNNHPKSYVLLYQLARQTKNRDILQDELMSILLAGRDTTASLLTFLFFELSHHPEVFNKLKEEIERHFPDVESVTFGTIQRCDYLQWCINETMRLHPSVPFNFRTAANDTVIPRGGGKSCTDPILVHKGEQVLFSFYSVNREEKYFGTNTDKFAPERWSESLRRTEFIPFSAGPRACLGQQLPRVEASYVTIRLLQTFHGLHNASKQYPPNRVVAATMRLTDGCNVCFI

SEQ ID NO: 7013 - protein, 579 aa, Ralstonia eutropha JMP134
MEHNIPLITTLAAGFGIALVLGFLAERVKVPALVGYLVAGIIIGPGTPGFVADVHLASQLSEIGVMLLMFGVGLHFSLKDLLAVKRIAVPGAVVQMALATALGAGVAWMWDWHWGSGLIFGLSLSCASTVVLLKALETRGVLESMNGRIAVGWLVVEDLATVLVLVLLPPLAGILGGSDASAAAETRPLWTTIALTLLQVGAFIALMLVAGRRLLPWFLWLVARTGSRELFTLSVIAAAIGIAYGAAQLFSVSFALGAFFAGMVMRESEFSHRAAQESLPLRDAFSVLFFVSVGMLFKPAILIEQPLHVLGTVAIIIVGKSIAAFALVLAFRYPLNTALTVSASLAQIGEFSFILAGLGLSLGLLPAEGMSLVLAGALISIALNPVLFALNEPFRRWVLKRSALARRLEQRGDPYAELPMTTERKYLEGQVVLVGYGRVGRRIGSALQSRGIPFVVAEQNRELVESLRNRGIAAVSGNAADPAVLIQAHIARAAMLVVAIADPIDVRQMADTARTLNPSIEIVLRTHNEDESVMLRKEAIGTVFYGEEELARGMTAHVLERFAPGPQAYTDGHAAGHAA

SEQ ID NO: 7014 - protein, 729 aa, Zea mays
  misc_feature (378)..(378): Xaa can be any naturally occurring amino acid
  unsure (1)..(729): unsure at all Xaa locations
MGLIGDPSLAGFETGRSASEDAAGPPPASPVSRSRSGGAALGSAGKPPLGGVRLRSSLSDGPDPADEDPRCLIRNLDDGREYVVKEEFGLREVGTGRHLTVEELARSPIVQELMRRQAFSTPNSNCNSNSQSGASTPIERSSSGSSNGGSRSKRRSSWLRSIRCAAGSLVTHSRDRSSSDEKDTSSEKGGHHSSSATDDSQDSVPRHGPARVKVRQYGKSYKELSGLFMTQEIHAHNGSIWSIKFSPDGRYLASAGEDCIIHVWEVLEFKRAGKEREVKENGVCNPLVAMVYSESSETMVASGAPSGSHWEKKLRSKVLQGGGSVSSDRLMVPEYVFALSEKPVITFAGHSEDVLDLSWSKSQCKCKVQAIIGCRIPXSRYLLSSSMDKTVRLWHMSSTYCLKTFSHTDYVTCIQFNPVDDRYFISGSLDEKVRIWSIPKREIVDWVDLHEMVTAACYTPDGKGALIGSHKGSCHLYDTSDDMLCYKTQIDLQNKRRKSSQKKITGFQFVPGDSSMVIITSADSRIRVLDGFELVHRFKGFRNTSSQISACLAGNGRYIISASEDSRVYIWRNDDGSKPSKKKGIVSVTNTHEHFHCESVTVAVTWPFTSTTMTSLMNPRKQELERGSENGYSPQDLQTKLAKAREMTDVEYRRTNITSYNSKHNSDRTSPAWPEELVTPPNQSLSATTCHANEGDQALNRSAWGLVIVTAGRGGQIRTFQNFGFPVRV

SEQ ID NO: 7015 - protein, 132 aa, Triticum aestivum
  misc_feature (58)..(58): Xaa can be any naturally occurring amino acid
  misc_feature (72)..(72): Xaa can be any naturally occurring amino acid
  misc_feature (100)..(100): Xaa can be any naturally occurring amino acid
  misc_feature (116)..(116): Xaa can be any naturally occurring amino acid
  misc_feature (123)..(123): Xaa can be any naturally occurring amino acid
  misc_feature (129)..(129): Xaa can be any naturally occurring amino acid
  misc_feature (131)..(131): Xaa can be any naturally occurring amino acid
  unsure (1)..(132): unsure at all Xaa locations
MAPTVMASSATSVAPFQGLKSTAGLPVSRRSNGASLGSVSNGGRIRCMQVWPIEGIKXFETLSYLPPLSTEXLLKQVDYLIRSKWVPFLRVNKVGSSSRXAQRIPWGTNNGRYWTXLELAMSXCTDAPXIXR

SEQ ID NO: 7016 - protein, 349 aa, Pasteurella multocida subsp. multocida str. Pm70
MEKKIYFGTNLKMYKGNCETVDYLTQLLALREKLQSDYDIELFVIPSYIALKDAVHAAASETTHKILIGAQNMNAKDKGQFTGEISPLMLKELGVQLVMIGHSERRHVLKETDQEENEKVLSALKHGFKTLLCVGETLEQKNYQISDEVLRTQLKIGLHGVSVKQLPHLFIAYEPVWAIGEGGIPATAQYADEKQKIIKQCLFEMFGEESKKIPVLYGGSVNLENANELIMQPHIDGLFVGRSAWDAQCFYTLIDGALKALAGTTHQFSPIATQLIKHLGGKENISALTHCASRIRVMTRNENHINKVAIEKINGVSGLFSIANQYQIIVGPKWVEKIYSEMKALLETE

SEQ ID NO: 7017 - protein, 425 aa, Ralstonia eutropha JMP134
MPRRSRGCRRAPCSLRVLFLRGKLNVTTAILLENIHASATARLGEAGLTVERRTGALAGDELRQVLASHDLVGIRSATHLRGDDIRSAPALLSIGCFCIGTSQVDLDAATAAGIPVFNAPFSNTRSVAELVVSEAVMLLRKIPEKNALAHAGKWAKGASGAFEARGKTIAIVGYGNIGSQVGVLAESMGMRVVYYDVLARLSLGSARAAGTLEEAVSQADVVTLHVPATARTRNMIDAHVLACFKPGAILINASRGTVVDIDALAAALRDKRLGGAAIDVFPEEPKTNNDPFVSPLQQLPNVLLTPHIGGSTEEAQENIGTEVAAKLLNYLNTGGTIGAVNFPEVDPGPLHAPARLLNIHSNAPGALAALNTLLAQDGVNINGQHLQTRGHTGYVVTDLDRVPSDVLMESLRTHAGFVRSRLLVR

SEQ ID NO: 7018 - protein, 350 aa, Glycine max
MATVVRIPTISCIHIHTFRSQSPRTFARIRVGPRSWAPIRASAASSERGEIVLEQKPKKDDKKKLQKGIAEFYDESSGLWENIWGDHMHHGFYDSDSTVSLSDHRAAQIRMIQESLRFASVSEERSKWPKSIVDVGCGIGGSSRYLAKKFGATSVGITLSPVQAQRANALAAAQGLADKVSFQVADALQQPFSDGQFDLVWSMESGEHMPDKAKFVGELARVAAPGATIIIVTWCHRDLGPDEQSLHPWEQDLLKKICDAYYLPAWCSTSDYVKLLQSLSLQDIKSEDWSRFVAPFWPAVIRSAFTWKGLTSLLSSGQKTIKGALAMPLMIEGYKKDLIKFAIITCRKPE

SEQ ID NO: 7019 - protein, 352 aa, Candida albicans SC5314
MATSQELTADIQALATSFPKRLANDSDNSLLINVAPTGRQAKRHIQQINYSEEFGDDLDFDEFPSSTPGTRSLNENKAQIEAQRYSLAKNTPTPKRILEKPVLSELVEKPVVLIPIKIMIENLNTNQKLIDSFMWNLNESLITPTEFAEVVCSDLDLPFSMAAQIADSINQQIEEYSYASNLQLPNKGPYNVTIDLSVNLNKQLYQDRFEWDMNQNEVTPEIFAEIVVADLGLSLEFKNAISHALHEIIIRVKKEVIDGTFNNEMHNLHLVKGIMFEQGIRIFTENSVQNGNDRWEPLVEVLTSSEIERRENERVRNLRRLKRENMRRDYDDHSRRRQAGKRRYDELEGAWV

SEQ ID NO: 7020 - protein, 443 aa, Dehalococcoides sp. BAV1
MTRAESVEYVLKTAKDHNVRFIRLWFTDILGSLKSFSIAYNELERALEDGMGFDGSSIEGYARIDESDMVALPDPDTFKIIPWSNGDYQVGRMFCDIKKPSGEQFEGDPRYVLKRNLKKAAEMGFTFYIGPELEYFYFKNDHSTEFLDEGGYFDLTPRDLATDLRRETIVALQDMGIIVEYAHHEVAPSQHEIDIRYTDALTMADNVMTYRLLVKEVAMRHGLHASFMPKPVGSVNGSGMHTHQSLFKGDRNAFFDAKDSYYLSTMAKQYIAGILKYAPEFTSVTNQWINSYKRLVPGFEAPVYLSWARRNRADLVRVPEYKPGHEKSTRIELRSADPGCNPYLAFSVMLAAGLKGIEEKLTPPAPIEENVYEMNEAERAKRGIGTLPGSLLEALKLTEGSSLVREALGDHVFDAFVANKKIEWSQYSIAVTDWELKRYLPVL

SEQ ID NO: 7021 - protein, 305 aa, Triticum aestivum
  misc_feature (99)..(99): Xaa can be any naturally occurring amino acid
  misc_feature (113)..(113): Xaa can be any naturally occurring amino acid
  misc_feature (128)..(128): Xaa can be any naturally occurring amino acid
  misc_feature (143)..(143): Xaa can be any naturally occurring amino acid
  unsure (1)..(305): unsure at all Xaa locations
MDGGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFXSKELRLDTKVFYFXDIGENKRGRYLKVSXEASVNRNRCTIIVPXAGSSGEEGWEAFRNALLEINDEASRPYVLPNHPSQQHLEPPERLPGLSDDVGAGFIAGHGSQSASVPEVDVDGPPIEEFSGMGLSKVIRADQKRFFFDLGSNNRGHYLRISEVAGADRSSIILPLSGLKQFHEMVGHFVDIMKDRLEGMTGANVRTVEPSQR

SEQ ID NO: 7022 - protein, 251 aa, Zea mays
RPGLVTSREDLFVTSKVWCADAHRDRVLPALRRTLSNLQMEYVDLYMVHWPLTMKVGRVTAPFTSNDFYPFDMPAVWEAMEECHLLGLANVIVFCNFSCMKLDTLLSFSTIPPVVNQVEINPVWQQRKLREFCRAKGIQLCAYSPLGAKGTHWGSDSVMDSGVLHEIAKSKGKTVAQVCLRWVYEQGDCLIVKSFDEGRMKENLDIVDWELSEEERQRISKIPQRKINQGRRYVSEHGPYKSFEELWDGEI

SEQ ID NO: 7023 - protein, 392 aa, Saprolegnia ferax
MSLKKIKNFSINFGPQHPAAHGVLRLILELNGEIVQKADPHIGLLHRGTEKLIEYKNYLQALPYFDRLDYVSMMSQEHAYVLAVEKLLNCNIPLRAKYIRVLFSEITRILNHLLAITCHALDVGAMTPFFWGFEEREKLMEFYERVSGARMHSSYFRPGGVHQDLPLGLLNDIFIFCNQFPTRLDEFEEMLTGNRIWKQRLVDIGIVKAKDALDLGFSGVMLRGSGISWDLRKTQPYEIYDKLDFSIPIGTNGDCYDRYLIRIEEMRQSINIILQTLNQMPEGPIKIDDKKISSPNRVQIKQSMESLIHHFKYYSENITVNSGETFTVIEAPKGEFGVFLVSDGTNKPYRCKIKAPGFAHLQALDFMCKDHMIADVVTIIGTQDIVFGEVDR

SEQ ID NO: 7024 - protein, 282 aa, Streptococcus pyogenes MGAS8232
MAMIQWFPGHMSKARRQVQENLKHVDFVTILVDARLPLSSQNPMLTKIVGDKPKLMILNKADLADATRTKEWKAYYESQGIKTLAINSKEQSTVKKVTEAAKELMADKIKRLRDRGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTHYPSRLTKRFKNIPLEEEAPEIIMTLTRQLGFKDDYDRFYSLFVKEVRDGKLGQYTLDQVGDMDAD

SEQ ID NO: 7025 - protein, 385 aa, Thermus aquaticus
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 7026 - protein, 385 aa, Thermus aquaticus
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 7027 - protein, 470 aa, Selenomonas ruminantium
MLKKTKIVCTQGPSTEKPGVIDALIANGMNCARFNFSHGDHEEHLGRINMVREAAKKAGKVISLILDTKGPEMRLGEFKDGKVMLEKGNKFTLTYDDEPGDETHVSVNHKGLYTEVKPGDTLLLSDGLVALKVDEIKGKDIVTTIQNSGKMSTRKRVAAPGVPLGLPPISEQDAKDIIFGCEQDMDFVAASFIQRPDDVIAIRKLIEEHNGHMEILPKIENLEGVKNFDAILEVSDGIMVARGDLGVEVPAEDVPLIQKEIIRKCNAAGKPVIVATQMLDSMERNPRPTRAEVSDVGNAILDGTDAIMLSGETASGDYPVEAVATMNRIAQRMESSLEYKELYVERGLQHMESRTRAIAHATVQMAYELDAPAIITPTESGYTTKVVSKYRPKAAIVAYTPSEKVLRQLNLRWGVYPVLGTQWSDVDEMISNATAAAVKEDLVQRGDLTIITSGVKMESRTRAIAHATDI

SEQ ID NO: 7028 - protein, 476 aa, Campylobacter lari RM2100
MGKFVNNIDEFFSYCQEHEVLFVDFRFTDMIGTWHHITYNIKAIDDKTFENGIPFDASSLHGWQPIEKSDMILKPDVKSAFLDPFTADPTIIVICDVYDIYKDQMYEKCPRSIAKKAMQHLSTSNIADTAYFGPENEFFIFDNVKIVDSSHCAKYEVDTEEGEWNDNKDFADSYNSGHRPRNKGGYFPVSPVDSSVDIRSEMVQVLERVGLKVFVHHHEVAQGQAEIGVEFGNLVEAADNVQIYKYVVKMVAHLNGKTATFMPKPLYGDNGSGMHVHMSLWKDGVNLFYDKEGYGKLSECAINYIGGILANARSVAAFTNPSSNSYKRIVPGFEAPCILTYSCQNRSASCRVPYGINEKSARVEIRFPDSTSNPYLAFTSLLMAGLDGIKNKTIPVGPMDENLFALTLDEIREKGIEQLPHTLRGSLEALIRKNAFLKPVMSDVFIDDYQHMKFETQVWPVEARPTAYEFKTCYSC

SEQ ID NO: 7029 - protein, 191 aa, Triticum aestivum
  misc_feature (151)..(151): Xaa can be any naturally occurring amino acid
  misc_feature (174)..(174): Xaa can be any naturally occurring amino acid
  unsure (1)..(191): unsure at all Xaa locations
KNRQDYFHFGDVITFDTTYKTNLYNMPFALFVGVNNHFQSVIFGGALMREETEAAFNWLFKTFVALMNDKHPVTILTDQALAMKGAIESALPNTKHRWCKWHVLRDVKGNIVHVYNKSSGFKKEFNKLVNDVMCVDEFESKWLSLVNRFNXQYMVRLYDKRVMWAKPYFKGNFXAGMTSTQHSESANHMLK

SEQ ID NO: 7030 - protein, 377 aa, Malva pusilla
MADGEDIQPLVCDNGTGMVKAGFAGDDAPRAVFPSIVGRPRHTGVMVGMGQKDAYVGDEAQSKRGILTLKYPIEHGIVRNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDMKEKLAYVALDYEQELETAKSSSSVEKNYELPDGQVITIGAERFRCPEVLFQPSLIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 7031 - protein, 195 aa, Gibberella zeae PH-1
MPERNTGGEGAAGARRRRSSSILQVYHEPPETLEQISDQASLPNLNANWTNAKGAWTIHLVLILSAKIIFDAIPGVSQETSWTLTNMSYMFGSYIMFHHVRGVPFDFNSGAFDNLNMWEQIDNGAQYTPTKKFLLSVPIALFLVSTHYTHYDLTYFTINLLAVLGVVIPKLPFLITDFPQSHRMRFGLFSGIPEE

SEQ ID NO: 7032 - protein, 461 aa, Burkholderia sp. 383
MVSGNESDGLKRGLKNRHIQLIALGGALGTGLFLGIAQTIKMAGPSVLLGYGVAGIIAFFIMRQLGEMVVDEPVAGSFSYFADKYVGHFTGFLSGWNYWVLYILVSMAELSAVGIYVQYWWPGVPTWVSALVFFVAINLLNLASVKSYGETEFWFSIIKVAAIVGMIGFGGWLLASGHAGPEASVRNLWQHGGFFPNGVSGLVMSMAAIMFSFGGLELIGITAAEADDPKRSIPRATNQVIYRILIFYIGALAVLLSLYPWEKVVTGGSPFVLIFHALSSNLVANVLNVVVLTAALSVYNSGVYSNSRMLFGLAKQGNAPKVLCSVNKRGIPLAALGASALATGVCVLVNYFMPGKAFEVLMGLVVSALIINWAMITLIHLKFRQAKRAAGEETSFRSLGYPFTNYLCLAFMAGILVVMYLTPDLRLSVYLIPVWLAVLAVGYRFRQKNAGYAVHDSASAR

SEQ ID NO: 7033 - protein, 463 aa, Pseudomonas syringae pv. phaseolicola 1448A
MSSTANSSELEQGLKPRHITMLSIAGVIGAGLFVGSGHAIAEAGPAVLLAYAAAGTLVVLVMRMLAEMAVASPDTGSFSTYADRAIGHWAGFTIGWLYWWFWVLVIPLEANAAATILHAWFPNIAIWMFTLVITLLLTATNLFSVKNYGEFEFWFALIKVVAIIAFVVLGVAAIFGLLPTSNVSGVSHLFDTGGFLPNGMGAVLAAMLTTMFSFMGTEIVTIAAAESKNPGKQITKATNSVIWRIFLFYLVSIFIVVSLVPWNDPRLAEVGSYQTVLDAMGIPNAKLIVDLVVLVAVTSCLNSALYTASRMLFSLGKRGDAPALSKRTSKGGTPYWAVIMSTAAAFLTVFANYIAPAAVFDFLLASSGAIALLVYLVIAVSQLRMRQKRIAAGEAIDFKMWLFPWLTWAVIAFIVAVLTIMLIQEEHRVEIIATGLLSLLVISAGLLVSRRRKAGRVGAAALG

SEQ ID NO: 7034 - protein, 412 aa, Candidatus Protochlamydia amoebophila UWE25
MKTYRLEDALLALKEGKFVIVVDDENRENEGDLILAAEKAHPSSLGFMIRHTTGIICLAMKGQRLDELKLPPMVTDNTDRKQTAFTVSVDYLHQGVTTGVSAEDRTKTILSLIHPHTKPEDLGRPGHIFPLRYKEGGVLKRAGHTEAAVDLTNLAKLYPAGILAELINEDGSMMRLPELEKFSDLHQIPIITIAELIRFRRRHEKLVSCFSQSPIPTPFGDFNAYVYESQLDGIQHIALVKGEIKNQKNILVRMHSECLTGDVFGSKRCDCGSQLKLAMEKIEQEGRGVIIYLRGHEGRGIGIGHKLKAYNLQDQGKDTLEANLELGFPIDSREYGIGAQILVDLGLSTIRLMTNNLAKYNGLAGYDLEITERVPLPVCVTKENKHYLQTKKDKLGHLIDLSEDKLEIHHST

SEQ ID NO: 7035 - protein, 131 aa, Debaryomyces hansenii CBS767
MSGGKGKAGSSEKASTSRSAKAGLTFPVGRVHRLLRKGNYAQRVGSGAPVYLTSVLEYLAAEILELAGNAARDNKKSRIIPRHLQLAIRNDEELNKLLGHVTIAQGGVLPNIHQSLLPAKKAKAGNASQEL

SEQ ID NO: 7036 - protein, 514 aa, Arabidopsis thaliana
MEEIRKEIDVGDWHSNLAHDEWTPLPVSGSRASARYKHAAVVVDEKLYIVGGSRNGRYLSDVQVFDLRSLTWSSLKLKTESSSADNIQEDDGSSLREAFPAISDHRMIKWGNKLLLIGGHSKKSSDNMLVRFIDLETHSCGVIDVFGNVPASRDGHSITLVGSRVLVFGGEDKNRRLLNDLHVLHLETMTWDVVETKQTRPVPRFDHTAATHSDRYLLIFGGCSHSIFYSDLHILDLQTMEWSQPHVQGDVVTPRAGHAGITIDENWYIVGGGDNSTGCLETLVLNMSKLVWSTSTHVEARHPLASEGLSVCSASVFGENILVAFGGYNGKYNNDIFVMRLKPGESSHPKIFKSPAAAAAAASVTAAYAIAKSDKSDYPPPANPTLNGNGNSLPERDIRNRIDTIKEEKRALESSIAETQVENAKLREKIDEVNSSHTELSQELQSVEGQLISERSRCFKLEAQIAELQKALESGQSIEAEVEMLRRQRSASDEEEDGTVQRQGSAGVWGLFGR

SEQ ID NO: 7037 - protein, 347 aa, Schizosaccharomyces pombe
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 7038 - protein, 311 aa, Solibacter usitatus Ellin6076
MLTNSSQIVLITGGTGGIGQAIAVRMAKLGATTIVVGRDQARGEAAKAEIRTQSGNRSVELMLADLSSQGDIRRLAGEFMARYGRLDVLVNNVGGLYGKRWETVDGIECTLALNHLCPFLLTHLLLPVLRAGAPSRIVNINSEGHRAAKSVNFGDFDAARWKRGFLIYSQSKLANLLFTFEMARRLSPSEITVNAVHPGIVDTQLFRRFIEERFTLIGGVLSKAAAFVARKVAYRISHFDTVETAAECPVYLASSSEVAGITGKYFGLNKKIVETSAASLDADLSREVWRMSAEMVGLSGNEASQVQRRFA

SEQ ID NO: 7039 - protein, 312 aa, Streptococcus thermophilus LMG 18311
MKTYERIYEMLAKSPDFVTGESLAKELGISRTAIWKAIQSLQDQGVVITSVRKKGYHLEKGDILLSQEISKQLNFPVYFNPDSTSTQLDAKHGIERQDPAPSLYLASNQGSAKGRFERHFHTSPHGGIYMSIHLRPNCHFSELPPYTMMVAASIVKAIQRLTGIDTDIKWVNDIYLNNKKIAGILTEAISSIESGCITDVIIGVGLNFSISDFPEEIATKATSLFQNERPTITRNQLISEIWKLFLTIPTTDLVKVYKEKSLVLDKQVTFEQSGKAYSGIAKEIGDKGQLLVLTDDGQEKWLSAGEVSLTSW

SEQ ID NO: 7040 - protein, 476 aa, Thermobifida fusca YX
MLHVTRRAKIVATLGPATSSPEVLRKLVDAGLDVARLNLSHGTHDDHQTMYRNVRAAAEASGRNVGILADLQGPKIRLGTFVDGSVTLSPGDEFTITIDDVPGDRHRVSTTYKGLPGDVRPGDRVLIDDGRVVLECVKSTSTDVHTRVIVGGPVSNHKGLNLPGVSVAVPALTEKDERDLRWALEQGVDMVALSFVRSPADAEDVHRVMDEMGVHVPLIAKIEKPQAVERLQDIIEAFDGVMVARGDLGVELPLENVPMVQKRAIERCRDKAKPVIVATQMLESMIHNPRPTRAEASDVANAVLDGADAVMLSGETSVGKYPVETVQTMARIIAAAEQESLRASHILHRVPETVGGSIARAAAEVGATVGAKALVAFTSSGETARRLARYRSPIPLLAFTTEPATRAQLSLTWGVETHLVPWVDNTDDMVRQVENELLDMDYQKGDKVVIVAGSPPGTRGSTNMLRVHRMGDAISN

SEQ ID NO: 7041 - protein, 91 aa, Arabidopsis thaliana
  misc_feature (37)..(37): Xaa can be any naturally occurring amino acid
  misc_feature (51)..(51): Xaa can be any naturally occurring amino acid
  misc_feature (54)..(54): Xaa can be any naturally occurring amino acid
  misc_feature (59)..(59): Xaa can be any naturally occurring amino acid
  unsure (1)..(91): unsure at all Xaa locations
MASSMLSSAAVVTSPAQATMVAPFTGLKSSASFPVTXKANNDITSITSNGXSVXSCMKXWPPNRKESFRLYLNLPPLEFLREVGLTFFNKG

SEQ ID NO: 7042 - protein, 425 aa, Oryza sativa
MSSMESSYLPATTESIAKAQEAKDASESISILYRVLQDPSSSAEALRTKELAITNLTNYLTKENRAEELRNLLTQLRPFFSLIPKAKTAKIVRGIIDAVAKIPGTSELQISLCKEMVEWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPVDHVEKKLSQMILDKKFAGTLDQGAGCLIIFEDPKTEAIFPATLETISNVGKVVDSLYMRSAKIMA

SEQ ID NO: 7043 - protein, 196 aa, Arabidopsis thaliana
  misc_feature (74)..(74): Xaa can be any naturally occurring amino acid
  misc_feature (119)..(119): Xaa can be any naturally occurring amino acid
  misc_feature (132)..(132): Xaa can be any naturally occurring amino acid
  misc_feature (167)..(167): Xaa can be any naturally occurring amino acid
  unsure (1)..(196): unsure at all Xaa locations
EREREREFSIPPPPPEIEEEEEILVSYMISSDAELTSPAQDTMLAPFTVLKTSASFQVSRKANNDITSITTNVXTVSCMNERPPLGKKKFETISYLPDLTDSELLKEVDYLLRNQRIPXVQFDLYQGFEYRXEHRNTLVYYYGLYWNMWKIPLLRCSDSAQVLKEIXLCKKEYPVAFIMIIVFENNRQVQCISLIV

SEQ ID NO: 7044 - protein, 187 aa, Capsicum annuum
MASSVMSTATVATGANAAQASMIASFNGLKSAASFPVTRKQDLDITSIASNGGRVECMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEATKFSMFNV

SEQ ID NO: 7045 - protein, 245 aa, Enterococcus faecium
MNKNIKYSQNFLTSEKVLNQIIKQLNLKETDTVYEIGTGKGHLTTKLAKISKQVTSIELDSHLFNLSSEKLKLNIRVTLIHQDILQFQFPNKQRYKIVGSIPYHLSTQIIKKVVFESHASDIYLIVEEGFYKRTLDIHRTLGLLLHTQVSIQQLLKLPAECFHPKPKVNSVLIKLTRHTTDVPDKYWKLYTYFVSKWVNREYRQLFTKNQFHQAMKHAKVNNLSTVTYEQVLSIFNSYLLFNGRK

SEQ ID NO: 7046 - protein, 236 aa, Bacillus cereus ATCC 14579
MKKYAFITGANKGIGYELVRQLAEKDYHVFLGARNEQLGQQAVESLNVSNVSYIQVDISNSQSIQEAIKKIYEMTDHLHLLINNAGIALDFNTLPSELNIETLRQGFEVNFFGTFQMMQAFLPLLKNSSNSKIINVTTDMASLTMFANGETHPINTLGYNSSKTAINALTLAFSKEFATNGPEVFGVTPGFTTTDLNGNSPGGHTTTESAKIIIKYALSETNYNGKILNKDGIIPW

SEQ ID NO: 7047 - protein, 468 aa, Propionibacterium acnes KPA171202
MSAVYRSHDQPCYQLETHNGHTGKVSRQTEFVLRSMEERNIRFVRLWFTDVLGSLKSVAIAPAEVEGAFVEGVGFDGSAIEGYARVYEADMVAHPDPATFQVLPWRSGTSTARMFCDITNPDGTSSAADPRHVLKRTMGRAAEMGFTFYVHPEIEFYLLNDEHHPGESPVALDNGGYFDHTTLGAGTDFRRDAINVLEQMGISVEFSHHEAAPGQHEIDLRYADALTMADNIMTFRVVIREIASLKGIKATFMPKPFTDHAGSGMHSHVSLFEGDTNAFYDAADEARMSPVAKYFVAGLLHHAPEIIAVTNQWVNSYRRLSGGGEAPNYICWGRNNRSALVRIPMYKPDKASSARVELRSIDSAANPYLAYSLVLAAGLDGIEKELPLPEEASDDVWQLSARERHALGIKQLPQSLGAAIRCMEESELVAETLGEHVYDYFLRNKRAEFEEYNRQVSQFELDRYLPHL

SEQ ID NO: 7048 - protein, 482 aa, Staphylococcus epidermidis ATCC 12228
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDKIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 7049 - protein, 476 aa, Pseudomonas syringae pv. phaseolicola 1448A
MYPDVQLYIDGQWRASRDGRSIPVIDPATGQSLGSVAHAGITDLDEALAAAERGFATWRATSAYDRYKLMQKAANLIRERADNIARILTQEQGKPLAEARMETLSAADVIDWLAEEGRRSYGRIVPSRGVAIEQKVVKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTERFVGLTREIKVGNGLEAGTTMGPVANERRIPALVDLIEDAVRGGATLSAGGKAVEGAGYFFEPTVLSGLTPQMRIMNEEPFGPVALLVPFDTVEEAIAESNRVPFGLASYAFTTSMKTAQALSTYIEAGMLSINHQGIGLPEVPFGGIKDSGYGSEGGTEAIEAYLNTKLVTQYN

SEQ ID NO: 7050 - protein, 479 aa, Brassica rapa
MANIAGQLKRGISRQLSSVSLRRTFSRQFTRQASHDPRRINMRFSFGRQSSLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGSMDVYNILKARGAKVPKTKRTPMVVANPREVPEYELNPQELQVRKADGISKSCQGIYQVAKWNGTKVSVKILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 7051 - protein, 476 aa, Brassica napus
MANIARQFSSVSLRRTFSRQFTGQSSHDPRRNNMRFSFGRQSSLDPIRRSSTPEEGSNRPPHQLAVPDNLDATMQLLFVECGGDVEGVRDLLDDGIDVNSIDLDGRTALHIAACEGHVEVVKLLLTRKANIDARDRWGSTAAADAKYYGNMDVYNILKARGARVPKTKRTPMVVANPREVPEYELNPQELQVRKADGISKSCQGIYQVAKWNGTKVSVMILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 7052 - protein, 589 aa, Lactobacillus acidophilus NCFM
MKKTKIVSTLGPASNDIETITALANAGANVFRFNFSHGDHEEHRSRMNMVREVEKNTGKLLGIALDTKGAEIRTTEQEGGKFTINTGDTIRISMDDTKKGNKDMIHVTYDGLYDDTHVGGHVLIDDGLVDLLIKEKDDAKRELVCEAQNTGLIGSKKGVNAPGVEIRLPGITQKDTDDINFGLKEGINFIFASFARKAQDILDIRKLCEAAGADYVKIFPKIESQEGIDNADEILQVSDGLMVARGDMGVEIPFMEVPFVQKNLIRKANALGKPVITATQMLDSMQENPRPTRAEVSDVANAVLDGTDATMLSGESANGLYPVNAVKAMAEIDERTEKQMLKRNTLALQRFEAYKGSNVTEAIGESVVRTAQELGVKTIIAATNSGYTARMISKYRPNADIVAMTFDEKIQHSLAVVWGVQPVLTDKPKSTDDMFEKAAEVAKEKGYVKDGDLVIIVAGVPVGDSGTTNLMKLQIIGNKLVQGLGVGNGSVIGKAVVANSAEEANSKVKEGDILVAKTTDPDYNPAIKKASGLVVEASGLTSHAAVIGLSLGIPVVVGATDATEKISDGSTITVDARRGAIYQGEISNL

SEQ ID NO: 7053 - protein, 363 aa, Magnaporthe grisea 70-15
MTSHPEWDQQTTGTEVVKAFADAIKGKNGMAAKNATNNPEVTCAAKRGIGSATALAVASQAPNHLILASRTASKLEEVIADINQKYPGVKAVPVRLDLGSIDSIRDAASKIESLLVGEEINVLINNAGVTDKTRAPITTPDGTRLDKQFFVNHIGTFLLTNLLTPLLQKAAAGSPSGATRVVNVSSHGHRISPIRFSDYALDKYGSDEAIPEAERTHPETPAFLLKGMDDEGFPGFVAYGQSKTANILHATELSRRLKKSGVVAFSIHPGFIETDLDRSLDKEFSDALKAMAANGFKTLDGGAATTLVAAFDPALGQVDVGVEVTGYLSDCQLSEQLVRDHAKDPAIARRLWEETERMLQISK

SEQ ID NO: 7054 - protein, 518 aa, Debaryomyces hansenii CBS767
MRVKKPTSKRSTTRMREGIKKKAAAQNRKNKKLSKKDVTWKSRNKKDPGIPASFPYKDRIITELEEGRKLDKARKDELKLQRQKEREEALAKGEVIDDVMEEDEEDDQEGGLAALLESAQQAAQDYDGVEEESDGMTDSDADVEYELSDPEDDEEDKSELDKSRKAYDKIFKTVVEASDVVLYVLDARDPEATRSRKVEQAVLQNPGKRLILVLNKVDLIPTNALDQWLNFLKSSFPTVPVKAASGANSNSFNKNLTSTMTANSLLQALKSYATKANLKRSIIVGVIGYPNVGKSSIINALTNRHSNNTKACPVGNQAGVTTSMREVKIDNKLKVLDSPGIVFPDELTNSKKSKSNQEAKLALLSAIPPKQISDPMGAVNMLLKKFSKDSEMADGLKKYYLLPPLPSSDLNEFSKQFLIHIARTKGRLGKGGVPNLEAAAMSVLNDWRDGRIIGWTLPKASKSTSDGIDVADVNIDGPKSSMRGEKEPPKIEQTTVVSTWAKEFDLDGLLGDNFGLST

SEQ ID NO: 7055 - protein, 377 aa, Xylella fastidiosa Temecula1
MNSFAAVPVLIEEIRAGRMVVIVDDEDRENEGDLIMAAELVAPKDINFMVTHARGLVCLSLTRERCAQIGLSPMVQRNTTRFQTNFTVSIEAAEGLTTGISAYDRAHTIRTAVRPNAKPSDLHQPGHIFPLIAQPGGVLTRAGHTEAASDLPMLAGLEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGVAASDALRMIAAAERGVMVMLAAPRDSDVLLARLRSEPEVVSNVKDVGQWRRNGAGGQILADLGLAKLRVLGTPRRQIALAGFGLEVLEYVECRGGVPVPSQGVD

SEQ ID NO: 7056 - protein, 319 aa, Erwinia carotovora subsp. atroseptica SCRI1043
MKDITVPLKLIKILSDGDFYSGEVLGEMMGMSRAAINKHIQTIRDWGIDVFTVTGKGYSLPVTMQLLDEEIILKHLPEGGVTVLPVVDSTNQYILERLDTLSSGDACLAEYQQSGRGRRGRQWFSPFGANLYLSLYWRLEQGPAAAVGVSLVIGIVMAEVLHKLGADGVRVKWPNDLYLKDRKLAGILVELTGKTGDAANLVIGAGINLQMREPAPDTINQGWINLQEAGIDINRNTLASTLISELRGALAVFELEGLEPFISRWERLDNYFNRPVRLIIGNREIYGVDRGIDSQGALLLENDGLITSYIGGEISLRGV

SEQ ID NO: 7057 - protein, 474 aa, Aspergillus nidulans FGSC A4
MWSPFLEVAKALREGHVVEFITQKYNEYGWTFEQNVLGRSGISTIEPENLKALLATQFNDFCLGTREREFGPLLGQGIFTLDGAGWSHSRALLRPQFTRDQVADLDLMESHISRLIELVPKDGSAFDIQRLFFLMTLDSSTHFLFGESVHCMDEGNVLARSTVNNAQGFANAFNTALDYLNWRSVAGNFYWMITSKEFRDANKRVHEVVDYYVHQAIEAKRHPEKKEPGRYIFAEALAADNDNPKVLRDNMLNILLAGRDTTASLLSSAFFYLSRHPAVWEKLRRVIIEEFGDVQNPKGEITHAKLKDLPYLRYVLNEVLRLQPPVPLNLRVAVKDTSLPVGGGPDGKSPVFVEKDQPVLYSVYAMHRRKDLWGPDADSFRPERWEENAKHGWEYLPFNGGPRICLGQQYALTEASYTMVRLMQRFSKVENGEPGLDEPLIRATLTMSHENGVKVRFKLQHVRRKPSPLQTCTR

SEQ ID NO: 7058 - protein, 260 aa, Triticum aestivum
  misc_feature (138)..(138): Xaa can be any naturally occurring amino acid
  unsure (1)..(260): unsure at all Xaa locations
MPQGDYIELHQKRHGRRMDYEERKRKKEARAVKKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRPVAEEEMFKVLRXGKRKTKQWKRMVTKATFVGPGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 7059 - protein, 157 aa, Triticum aestivum
  misc_feature (40)..(40): Xaa can be any naturally occurring amino acid
  misc_feature (123)..(123): Xaa can be any naturally occurring amino acid
  misc_feature (130)..(130): Xaa can be any naturally occurring amino acid
  misc_feature (135)..(135): Xaa can be any naturally occurring amino acid
  misc_feature (139)..(139): Xaa can be any naturally occurring amino acid
  misc_feature (142)..(142): Xaa can be any naturally occurring amino acid
  misc_feature (144)..(144): Xaa can be any naturally occurring amino acid
  misc_feature (151)..(151): Xaa can be any naturally occurring amino acid
  unsure (1)..(157): unsure at all Xaa locations
MAPTVMASSATSVAPFQGLKSTAGLPVSRRSNGASSAASXNGGRIRCMQVWPIEGIKKFETLSYLPPLSTEALLKQVDYLIRSKWVPCLEFSKVGFIFREHNASPGYYDGRYLTMWKLPMFRXTDAKKVXNEVEXVKKXYPXAXVRIIRFXKWARMR

SEQ ID NO: 7060 - protein, 615 aa, Botryotinia fuckeliana
MSDFPTKEVVNHEDVSSSHYDTQAKMSEEDVSDVGNEKGAAQARPSHIGRKVSEWEALQIAAAGDMETIDNEVQDLEAEVTSRGKSRSDIFQLSFKDPRHYTWLLVAFASMGGLLSGIDQSLISGANLYMPSSLGLNTKQVSLVSSGVPLGAVGGALMLGPLNEAVGRKQAIVWSLFLYTVGAALEAGAVNFGMMMAGRVILGLGVGLEGGTVPVYVAESVAPKYRGNLVSLYQFMIALGEVLGYVVAAIFVGVKSGGWRYMLGSSLVFSTIMLVGILFMPESPRFLMHKGRTADAWGVWKRIRGTDEAARKEFFVMKHSVDSEREMEGARKRFAWLDFITVPRARRAIVYANVMIFLGQFTGINAIQYYMATLMQQVGFNDKEAVFMSLVGGGALLIGTIPAILYMEKFGRRFWAIAMLPGFFIGLVIIGCSYLIPLTNKAGSQGTYITGLILYEGFFGSYACLTWVIPSEVYPTYLRSYGMETSDTMLFLCSFLVTYFFAEMQKAMSNIGLTLGFYGGIAVVGWFYQVLFMPETKNKTLEEIDVIFSQPTGQLVKENLRSSMVTASDFIHGRWGKVFSPVSESDIFRKENGHKSDEGGMGDAKHEELMQPESM

SEQ ID NO: 7061 - protein, 270 aa, Geobacter sulfurreducens PCA
MLKGSTLGFIGGGNMAEAIIKGLLAGGVAAADVMVAEPVAARREYLHGTYGIDVCADNGRVAAAADALVMAVKPQVFRGMVAALGPAGLDGKLLISIMAGITTADMEEVCGSAARVIRVMPNTPALVLEGASTLCRGRNATDDDLFFATGIFDLVGTTCVVEEKLMDAVTGVSGCGPAYVFLFMEALSDAGVKNGLPRDVATRLAAQTVLGAARLLLETGDHPGVLKEKVTSPGGSTIAGIASLERDAFRGAVMAAVDAATARSAELGKK

SEQ ID NO: 7062 - protein, 223 aa, Pyrobaculum aerophilum str. IM2
MLKRLLAREAIRLVKSGMVVGLGSGTTAREFIKALAEAGVDDVLLVATSSDSEILAYEVGLGDRLRPMWAVDRIDLAVDGADEVTKDKVLLKGKGGALLREKIVDYAAEKFVVLIEEHKLVERIPSNNPVPVEVVPWAWRFVAREVEKRFGGVAKLRQDGGKLGPVVTDNGNYIIDWNPPGFIDPYLEDELKAIPGVVENGVFSKRRDATILVASSDGTIKTL

SEQ ID NO: 7063 - protein, 255 aa, Salmonella enterica subsp. enterica serovar Typhi
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDTVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 7064 - protein, 555 aa, Yersinia pestis biovar Medievalis str. 91001
MNNPIPWWQHGVIYQIYPKSFQDSTGNGYGDLAGVAQRLDYLQKLGVDAIWLTPVYVSPQVDNGYDVADYCAIDPAYGTLDDFKRLVAGAHQRGIRIIMDMVFNHTSTEHAWFKASQDRNSPYRQFYIWRDGDGGDGSLPNNWRSKFGGHAWQWHAASGQYYLHLFAPEQADLNWEHQPVRDELKKVCEFWADLGVDGLRLDVINLVSKQQDFPNDLDGDGRRFYTDGPRIHEFLQELSRDVFQPRRLMTVGEMSSTRLEHCQRYAALGGDELSMTFNFHHLKVDYLNGEKWSLMPPNRVELKHIFNQWQQGMHNRAWNALFWCNHDQPRIVSRFGHEGALRLPAAKMLAMVLHGMQGTPYIYQGEEIGMTNPNFTDITQYRDVESLNMFAELSVAGREPDELLAILAAKSRDNSRTPMQWDSSDNAGFSQGTPWIAPCSNYHEINVNAALADADSVFYAYQYLIALRKQYDIFTFGDYQDLCPQHPDLWCYLRSWQGKQLLVVANLSEEPQRWQPEGLTLDGNWQLLMSSYDQSAFQPQDMILRGYEGIYWVCE

SEQ ID NO: 7065 - protein, 307 aa, Zea mays
MSSPHGGLDDQIERLMQCKPLAEPEVRALCEKAKEILMEESNVQPVKSPVTICGDIHGQFHDLAELFRIGGKCPDTNYLFMGDYVDRGYYSVETVTLLVALKVRYPQRITILRGNHESRQITQVYGFYDECLRKYGNANVWKTFTDLFDYFPLTALVESEIFCLHGGLSPSIETLDNIRNFDRVQEVPHEGPMCDLLWSDPDDRCGWGISPRGAGYTFGQDISEQFNHTNSLRLIARAHQLVMEGFNWAHEQKVVTIFSAPNYCYRCGNMASILEVDDCREHTFIQFEPAPRRGEPDVTRRTPDYFL

SEQ ID NO: 7066 - protein, 529 aa, Mycobacterium tuberculosis
MVSLPVVLIADKLAPSTVAALGDQVEVRWVDGPDRDKLLAAVPEADALLVRSATTVDAEVLAAAPKLKIVARAGVGLDNVDVDAATARGVLVVNAPTSNIHSAAEHALALLLAASRQIPAADASLREHTWKRSSFSGTEIFGKTVGVVGLGRIGQLVAQRIAAFGAYVVAYDPYVSPARAAQLGIELLSLDDLLARADFISVHLPKTPETAGLIDKEALAKTKPGVIIVNAARGGLVDEAALADAITGGHVRAAGLDVFATEPCTDSPLFELAQVVVTPHLGASTAEAQDRAGTDVAESVRLALAGEFVPDAVNVGGGVVNEEVAPWLDLVRKLGVLAGVLSDELPVSLSVQVRGELAAEEVEVLRLSALRGLFSAVIEDAVTFVNAPALAAERGVTAEICKASESPNHRSVVDVRAVGADGSVVTVSGTLYGPQLSQKIVQINGRHFDLRAQGINLIIHYVDRPGALGKIGTLLGTAGVNIQAAQLSEDAEGPGATILLRLDQDVPDDVRTAIAAAVDAYKLEVVDLS

SEQ ID NO: 7067 - protein, 413 aa, Podospora anserina
MLENLCTLPLSADLFTQVLHPSEPLLTVGLASGKVETFRLPNDDDEEDESGRRTSTSSGRGMIKSIWSTRRHKGSCRHLAYSHDGSAMYSAGTDSVVKHFSPETGNVISKIGLPPRNSATSTTDCPAILHVLSPQTLLLGTDSGGLYIFDLRENGSLNPKPVRKHVPHADYISSITPLPASAESTSGFPKQWVSTGGTTLAVTDLRHGIVATSEDQEDELLCSTIIPTGLGPKKMRSNAVVAVGTGNGILTLWDRGAWDDQQERINVAGGRTKKDGESLDAIVRVPDELGWGKKVIVGVGDGSLSIVDLKRREVQFVLKHDEVEGVSALTFDYQNRLISGGGRTVKVWAESGDDDLDEEEEEEAEATGFKRPARSDSDSDDDSEDERPQKSSNKKQKKGKGNQARSVAFPGLD

SEQ ID NO: 7068 - protein, 266 aa, Pseudomonas syringae pv. phaseolicola 1448A
MPNITVTSLLAMKQKGEKITMLTCYDATFAHTASQAGVEVLLIGDSLGMVLQGHDSTLPVTTAETAYHVACVKRGNQGAMILADLPFMANATLEQTFINSATLMQAGAHMIKVEGAAWLGESIRLLAERGIPVCAHMGLTPQAVNVLGGYKVQGRLEAQARQMRADAIALEQAGAAMILLECVPSELAEEITQAVKIPVIGIGAGSATDGQVLVLHDMLGLSISGRVPKFVKNFMTGQPDIQSAIRAYVAAVKDVSFPATEHGFSA

SEQ ID NO: 7069 - protein, 473 aa, Propionibacterium acnes KPA171202
MFEGPDDLLAYVKKEGIEMIDVRFCDLIGIMQHFTVPAREFDKDQYENGLAFDGSSIRGFQKINESDMALLPDPTTAWIDPFRERKTLIVNFNVHDPITKEAYSRDPRNIARKAEAYLASTGIGDTAFFAPEAEFYVFDDIRFDTRQNTSYYSIDSEAGAWNTGRTEDGGNRGYKVKYKGGYFPVAPTDHFGDLRDEIVTIMERLGMKVERAHHEVGTAGQAEINWRFDTLSRSADDVMKFKYIVKNVAWQHGKTATFMPKPIFGDNGSGMHVHSSIWKGGEPLFFDESGYAQLSDMARYYIGGILKHAPSLLAFTNPSANSYHRLVPGFEAPVNLVYSQRNRSACMRIPITGPNPKAKRVEFRCPDPSANPYMAFAALLLAGLDGIQNKIEPPAPVDKDIYELPPEEHAAMDHVPGNLGAVLDNLEADHEFLLAGDVFTPDLIETWVELKRGDLAALQQRPHPYEFDLYYDI

SEQ ID NO: 7070 - protein, 479 aa, Pseudomonas aeruginosa PAO1
MLIPVVLSGGAGTRLWPVSREGQPKPFMRLPDGQTLLGKTYRRAAGLLAGHGEIVTVTNREHYFQSKDQFHAARLGRHRGHFILEPTGRNTAPAIAVAALALQAEHGDAAVLVVMPADHLIRNEEAFREAVGHAARLAVAGHLVTFGVVPDAAETGFGYIELGDRLDEQGAAKVRRFVEKPDEETARRYVESGGFLWNSGMFCFTASTLVDELAQHAPALLEQARACLAASAAVKMADGIQHELAGEAFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 7071 - protein, 250 aa, Triticum aestivum
  misc_feature (63)..(63): Xaa can be any naturally occurring amino acid
  misc_feature (93)..(94): Xaa can be any naturally occurring amino acid
  misc_feature (96)..(97): Xaa can be any naturally occurring amino acid
  misc_feature (112)..(112): Xaa can be any naturally occurring amino acid
  misc_feature (242)..(242): Xaa can be any naturally occurring amino acid
  unsure (1)..(250): unsure at all Xaa locations
MAGAAAAAAAVASGISIRPVAAPKISRAPRSRSAVRAAVSIGEKAYTVQKSEEIFNAAKELMXPGGVNSPVRAFKSVGGQPIVFDSVKGSHMXXVXXSFSRDVVGCGEQAEXGDKRIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDASGSIXERFEDNKG

SEQ ID NO: 7072 - protein, 502 aa, Nocardia farcinica IFM 10152
MVEITRSVAKGFGMSLQLPTTVSAVSDNARHLRTRLSWQAQRAGLQVVKRYPTRIRPLAEPPPGSGLKPVLGDFGPPGIGYTLHTLADPMGFSRERFERLGPVSWLGVLGRPVVSVAGPEAFEEVLLDRDKVYSAQRGWEWLIGPFFHGGVMLRDFDDHMFHRRILQQAFTRPRLHGYQDLTSPLLRRGIESWRPAAEFHIHTAIKQLLLQQATEVFAGAELGRESVALAHAFEDAVHGGTAMVRANVPGGVWARGLRGRRRLEDYFRRELPAKRAGEGNDLFSVLSRATTEEGHTFTDEEVVQHMIFVMLAAHDTSTIASSMLVYELGRHPEWQDKLRAEAIGLGKESVGYDDLDELPLLDMAFKEALRMYAPVAQQARETIADTALCGHYLPRGTLVMCGPYMMMRTARYWRDPDEFDPERFAPERREDKSHRFAWAPFGGGAHKCIGLYFGGMTVKAVLYQMLTRFRWSVRPGYEPLLVAGTGPTPADGLPIRLERLAR

SEQ ID NO: 7073 - protein, 473 aa, Tropheryma whipplei str. Twist
MFMRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVGSVVRQVSLSWGVRCFLIERLHQTDQMMRKAEHVLLTNNLAEIGEKIVIISGSPVGVPGSTNHMRIHELGSTS

SEQ ID NO: 7074 - protein, 448 aa, Streptococcus agalactiae NEM316
MTITAEDIRREVKEKNVTFLRLMFTDILGVMKNVEIPATDEQLDKVLSNKAMFDGSSIEGFVRINESDMYLYPDLDTWIVFPWGDENGAVAGLICDIYTAEGEPFAGDPRGNLKRNMKRMQEMGYKSFNLGPEPEFFLFKMDENGNPTLDVNDKGGYFDLAPTDLADNTRREIVNVLTQMGFEVEASHHEVAVGQHEIDFKYDDVLKACDNIQLFKLVVKTIARKHGLYATFMAKPKFGINGSGMHCNMSLFDNEGNNAFFDPEDPRGMQLSEDAYYFLGGLMEHAYNYTAIINPTVNSYKRLVPGYEAPVYIAWAGRNRSPLIRVPASRGMGTRLELRSVDPTANPYLALSVLLGSGLEGIENKIEAPEPIETNIYAMTVEERRQAGIVDLPSTLHNALKALEEDEVVKAALGTHIYTNFLDAKRIEWASYATYVSQWEIDNYLDLY

SEQ ID NO: 7075 - protein, 368 aa, Malus x domestica
MGKGGQSCNGVVRDAKPVEQENMAAWLVDVNTIKILPFKLPAIGPNDVRIRIKAVGICGSDIHYLKTMKCGDFQVKDPMVIGHECAGIVDKVGSEVKHLVPGDRVAVEPGISCAHCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSTKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEAFATSARGGNAIKVMFTL

SEQ ID NO: 7076 - protein, 388 aa, Aspergillus nidulans FGSC A4
MVQFAFVSLWCLLLSYLSTKLPWLKTSIPALKNNIRPPSRDVIMTALPLAIFQLAGHILSSMATSQIPVSLVHTIKGLSPLFTVLAYRFLFRIRYAKATYLSLVPLTLGVMLACSTGFSTNFFGILCALVAALVFVSQNIFSKKLFNEAERAESDIQSAGRRKLDKLNLLYYCSGLAFILTLPIWLVTEGYPLFSDLMQDGAISLTNKAGSLDHGALFLEFVFNGVSHFAQNILAFVLLSMVSPVSYSVASLIKRVFVIVVAIVWFGNSTTPVQGFGIALTFLGLYLYDRNSHDDVADQKANADHFHFKNPILPLNTRGASKLRGSNGYAIPQGRPVDQHVLDRSFPISSNSKKDDGVGHARPRASSNTKAWLPPGTKQETTWQSSDS

SEQ ID NO: 7077 - protein, 370 aa, Scherffelia dubia
MFGKAVTARPACAPCAPAPSPCAPGKFDEELIKTAKHIASPGKGILAMDESNATCGKRLDSIGVGNTEENRRTYRELLLTAPGLGNYISGAILFEETLYQKASNGKSFVDVMRSTGIAPGIKVDKGLVPCGTATTSWCTGLDGLAGAAEYYKQGARFAKWRSTVAVGAGPSIIHARHAYGLARYAAICQDNGLVPIVKPEILLDGDHTIDETLDVAKATWAETFKYMADNKVMFEGILLKPSMVTPGAECKVRADPQTVASYTLGLSQPRAPPVPGIMFLSGGQSELEASLNLNAMNQSPNPWHVSFSYARALQNTVLKTWKGEPGNVKAAQEALIVRAAANSAAQMGKYDPAKEAESAKAGMFEKGYVY

SEQ ID NO: 7078 - protein, 335 aa, Triticum aestivum
  misc_feature (147)..(147): Xaa can be any naturally occurring amino acid
  misc_feature (220)..(220): Xaa can be any naturally occurring amino acid
  unsure (1)..(335): unsure at all Xaa locations
MASTTAAVPEVALRSGGARPMPAIGMGTATFPVVPETTVKAVLEAVEVGYRHFDTAAMYATERPLGEALAEAVRRGLLASREEVFVTSKLWCTQCHPHLVLPSLRESLQNLQMEYVDLYLIHWPISLKPGPTVFPVKREDAVPFDFXGVWRALDECHRLGAPLAIGVRKFTTRHLEKLLAAAPVILQSTRGELFPGLAFKGSLREYCARGRAFPVAAYSXPVGRAKTLRTAWPGDGNAVLDSEVLAEIAKARGKSVAQVALRWIYEQGVTPIVKSFSKERLKENLGIFDWGLTDDDLRKIGQIPQKKIVKAETVLFSAEGEFTSADLADMEIVED

SEQ ID NO: 7079 - protein, 272 aa, Bacillus cereus ATCC 14579
MNKQIGFIGCGNMGIAMIGGMIKKNIVSPDQIICSDLNVINLKNASNEYGITITTNNNEVANSADILILSIKPDLYSSVINQIKDQIKNDVIVVTIAAGKSIKSTENEFGRKLKVVRVMPNTPALVGEGMSALCFNEMVTEKDIKEVLNIFNIFGQTEVINEKLMDVVTSISGSSPAYVYMFIEAMADAAVLGGMPRKQAYKFAAQAVLGSAKMVLETGIHPGELKDMVCSPSGTTIEAVVTLEEKGLRTAIISAMKRCTQKSMEMSSLTSK

SEQ ID NO: 7080 - protein, 181 aa, Zea mays
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 7081 - protein, 1625 aa, Aspergillus nidulans FGSC A4
MAASLCLRGSRQLALRSQLRSIHPSITRSRLLPTYRAVHSSSQQSHSARRPIYTSSVADHGVPHPRDVFQPVDTFPRRHIGPSPEAAEEMLAVLDPPVKSLDEFVKQVLPADILSKKDLAVTAPSADNGLPRSSVHGGLGETDMLKLLDKYREQIDVSGKTYIGAGYYPTIVPPVILRNILENPAWYTSYTPYQPEISQGRLESLLNFQTLTADLTGLPFANASVLDEATAAAEAMTMSLATQPLAKQKKAGKTYVVSHLCHPQTVAVMRSRAEGFGINLVIGDILADDFKIVKDQGDNLIGVLAQYPDTEGGIYDFQGLSDAIHTAGGTFSVATDLLALTVLKAPGEFGADIAFGNAQRFGVPMGYGGPHAAFFACADKYKRKVPGRVVGVSKDRLGNRALRLALQTREQHIRREKATSNICTAQALLANMSAMYAVYHGPSGLKTIAQRIMSMTAALRERLAALGYNVPAKSNVSDGAAVFDTITIEFSNSEEADAIIAAARQNSIFLRRVSATKVGISLDETAGREELKAILQVFSAHAKAEAALDQELGLASIPASLERTSAYLTHPVFNTHHSETEMLRYIRHLESKDLSLAHSMIPLGSCTMKLNATTEMIPVSWPEFSQMHPFLPADVAKGYTQMIDDLEQQLADITGMAEVTVQPNSGAQGEFAGLRVIKKYQEATGSSKRNICLIPVSAHGTNPASAAMAGMKVVTIKCDTKTGNLDLDDLKAKCEKHKDELAAIMITYPSTFGVYEPGVKKACDLVHQYGGQVYMDGANMNAQIGLCSPGEIGADVCHLNLHKTFCIPHGGGGPGVGPIGVAEHLRPYLPSHPNSEYLQSKRTEKSSPPISAAPWGSASILPITFNYINMMGSKGLTHATKITLLNANYILSRLKDHYPILYTNDNGRCAHEFILDVRKFKDTCGIEAIDIAKRLQDYGFHAPTMSWPVANTLMIEPTESENKAELDRFCDALISIRKEIAAVESGEQPRDGNVLRMAPHTQRDLLATEWDRPYTREQAAYPLPYLLEKKFWPSVTRVDDDAIGGSRRLPGTSRSQCGVRHPRCSTLSDIKASTFSGSLESHRSAARSRLGPSPDLCQDMESKITLFYGTFVDLPRTRSGEKHELAIRHGAIWVSSATGRIQGFDWSIANEAELQSLLRKKGWTGVPIIRALEQENEFFFPGFIGLFGSSTLLDWLETYTFPLESSMSNLDKARTAYNAVISRTLANGTTCASYYATIHVPATNLLASLCHTRGQRALIGRVCMDNPAFCPDYYRDESAEASIELTKETIAHIHSLPDSDKESERLVKPIITPRFAPTCSTSALTSLGQLAASHTPPLHIQTHISENPNEVSLVQSLFPEHPSYAAVYDACSLLTHRTILAHAVHLTQPEKELIASRNAKISHCPASNSALGSGLAPVRDLIDNGITVGLGTDVSGGYSPSILEAVRQACLVSRLLRHSTASTSSSGNSTQNETEGREVLSVEEALYLATRGGAAVIDMPNELGGFEVGMFWDVQLIRLGATVQETPQTGSHSDSRSVVDIFGWESWAEKVHKWVWTGNDRNVRRVWVGGAVVHDLDDGSCVGEETMLGSWFGKSLQRDWTRWAVASVGVAILGFAIGRRSLGSR

SEQ ID NO: 7082 - protein, 336 aa, Legionella pneumophila str. Paris
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVTPFSDPEEVADYTISVFRNNVPASVPTINFLSGGQTPQQATANLNAINQIGHQPWLLSFSFGRALQEDCLKEWCGNKANITKAQEALIKRARLNSMACLGEYQNDME

SEQ ID NO: 7083 - protein, 284 aa, Rhodopirellula baltica SH 1
MTLPKPRTMTHTRESILSGFRKKRSAGKPIIGGGAGAGISAKCEEEAGIDLIVVYNSGRYRMAGRGSLSGLLPYGNANEIVKELAPEILTAVKHTPVLAGVCGTDPFLLRDHFLQELKALGYAGIQNFPTVGLIDGTFRANLEETGMSFQLEIECIAAAHNMDLLTTPYAFDAEQARELTAAGADVIVAHMGLTTSGTIGAQTAMTLDDSVRLVSEIASAARDVRSDVFVLCHGGPIAEPDDAQYVMDRCPIDGFYGASSMERLPTERAITSQVRSFVDLKLSR

SEQ ID NO: 7084 - protein, 415 aa, Rhodopirellula baltica SH 1
MQPTTSDLSPLVYAIATMDTKGEELNFVAEQLKTQGLSVATIDVGTLDPPSIEPSITRDTVARCNPNTNALRCEDRGQAIQAMSDALQTFLSNEHRSGRVAGVIGLGGTGGTALVCPAMAVLPIGLPKVMVSTVGGGDVSAFVGGSDIVMFPSIVDVAGLNQVSTKILSNAAHALAGMVSIPSPTSTARPAIGMTMFGVTTTCATAVRVALEAEGLDPLVFHATGTGGRAMDKLVESKLIRGVLDITTTEVADEVVGGIFPAGPSRFDAIIESGVPYVMSLGALDMVNFRARSTVPEKFDDRLLHVHNPQITLMRTTPDENREIARWIAAKVNRSTAELAILIPEKGVSALDAPGQPFFDAEADEALFSELERCVDTTPKRTVRRLPYHINDPEFANALTGTFRSMWNLSQDGSA

SEQ ID NO: 7085 - protein, 318 aa, Arabidopsis thaliana
MMTSMEGMMEMGVLDDIIRRLLEGKGGKQVQLSEVEIRQLCVNARQIFLSQPNLLELHAPIRICGDIHGQYQDLLRLFEYGGYPPSANYLFLGDYVDRGKQSLETICLLLAYKIRYPSKIFLLRGNHEDAKINRIYGFYDECKRRFNVRLWKIFTDCFNCLPVAALIDEKILCMHGGLSPELENLGQIREIQRPTEIPDNGLLCDLLWSDPDQKNEGWTDSDRGISCTFGADVVADFLDKNDLDLICRGHQVVEDGYEFFAKRRLVTIFSAPNYGGEFDNAGALLSVDQSLVCSFEILKPAPASSTNPLKKVPKMGKS

SEQ ID NO: 7086 - protein, 261 aa, Solibacter usitatus Ellin6076
MPSPPCKITVLGSGTSVGVPTIGCHCDVCTSQDARDKRLRPSVLVSFDDRNVLIDTTPDLRTQALRARIERLDAVLFTHSHADHLMGLDDVRPFNFRQKGQIPIFASPETMAAVQRCFQYIFDNGKKESNVPKLDARVLDGTPFDVFGMEFTPIPILHGSQTIYGFRFGGAAYLTDHSDIPESSMEMLKGLDVLFLDALRYKPHPTHSTVERSIRTVDQLAPHRAFFTHICHDLGHERAESMLPPHIRLAYDGLEIQVGGR

SEQ ID NO: 7087 - protein, 320 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 7088 - protein, 432 aa, Staphylococcus epidermidis ATCC 12228
MTLSSYATSKLTEEKVFKDPIHRFIHVQDQLIWDLIKTKEFQRLRRIKQLGTLYLSFHTAEHSRFGHSLGVYEIVRRMIDETFIGQDAWDNTDRPLALCAALLHDLGHGPFSHSFEKIFNTDHEAFTQAIITGDTEVNGVLSRVSDNFPKQVADVINKTHDNKLVISMISSQIDADRMDYLQRDAYFTGVTYGSFDMERILRLMRPSKEEVLIKDSGMHAVENFIMSRYQMYWQIYFHPVSRGGEVLLNNCLKRAKQLYNEGYEFKMYPKDFIPFFEGTMTIEQYVELDEAVVLYYLKKWIHENDTILSDLSRRFINRDLFKYIPFDGSIITISELQELFEAGGINPDYYFVSEAFSDLPYDYDRPGSNRKPIHLLKSNGGITEISNQSLVINSITGINREDHKLYYPKEMILKIKDYQIKGSIINLLNELN

SEQ ID NO: 7089 - protein, 219 aa, Pasteurella multocida subsp. multocida str. Pm70
MDQLEMKKMAAAAALQYVKPDSIIGVGSGSTVNCFIEALGSMRDQIKGAVAASKASEALLAKQGIEVFSANEVSSLDIYVDGADEINPQKMMIKGGGAALTREKIVAALAKKFICIVDTSKQVDVLGSTFALPVEVIPMARSQVARKLVALGGSPEYREGVVTDNGNVILDVYHFAIMNPVEMEKELNNVPGVVTNGIFALRAADIIIVGTPEGAKVIE

SEQ ID NO: 7090 - protein, 432 aa, Prochlorococcus marinus str. MIT 9313
MASSDDAKLRPLPNTAALSGVLEAFAFFRDPAFAQKRFERHGNVFETSLLGQPMVFIQGGQAIRDLLAQPNAVEGWWPESVRQLLGSHSLANRNGASHRARRRVIGQLFSASALQRYSAGIISMVQDLADELQAAKTALPLAERMRRFAFSVIATTVLGLEGTDRDELFVDFEIWTRALFSIPIALPGSSFAKALKARERLLRRLQKVLLKASNGNGGLDLLAGGLDEAGIPLTDEDMVEQLLLLLFAGYETTASSLSCLMRELLLNPQVETWLREEINGVDWPPAPEQATTAYDQVNAPKLDAVVSEVMRLTPAVGGFFRRTKCALVIDGVEVPKNRVVQVALAASNRHGAGDLEAFRPQRHLEDGCSATLLPFGGGERVCLGKPLAELEIRLMVVGLFHQLRLHLIPDQDLTLQMLPSPTPRDGLLTKVL

SEQ ID NO: 7091 - protein, 410 aa, Pasteurella multocida subsp. multocida str. Pm70
MTTKVSLDKSKIKFLLLEGVHQTALEVLQNAGYTNIEYHKKALDDDELKEAIKDAHFVGIRSRTFLTEEVLAHAQKLIAIGCFCIGTNQVNLQAAKLRGIPVFNAPFSNTRSVAELVLGEILLLMRNVPQANAEVHRGIWNKSANGSHEVRGKKLGIIGYGHIGSQLSIIAESLGMRVFFYDIENKLPLGNAQQLRTLEELLSSCDVVSLHVPENASTKNLISAERIAQLKEGAILINAARGTVVDIDALAQALEAGKIRGAALDVFPEEPASIQEEFVSPLRAFDNVILTPHIGGSTSEAQENIGAEVSGKFVKYSDNGSTLSAVNFPEVSLPEHVGTKRLLHIHHNKQGVLNKINQVFVDANVNIAAQYLQTDPAIGYVVIDVETEDTHSLLTQLKEIEGTIRARVLY

SEQ ID NO: 7092 - protein, 248 aa, Aquifex aeolicus VF5
MVRLKKSFGQHLLVSEGVLKKIAEELNIEEGNTVVEVGGGTGNLTKVLLQHPLKKLYVIELDREMVENLKSIGDERLEVINEDASKFPFCSLGKELKVVGNLPYNVASLIIENTVYNKDCVPLAVFMVQKEVAEKLQGKKDTGWLSVFVRTFYDVNYVMTVPPRFFVPPPKVQSAVIKLVKNEKFPVKDLKNYKKFLTKIFQNRRKVLRKKIPEELLKEAGINPDARVEQLSLEDFFKLYRLIEDSGE

SEQ ID NO: 7093 - protein, 357 aa, Ralstonia metallidurans CH34
MAGMQAAVFQGPGKIVLQEKPIPAVGPTDALIRITTTTICGTDIHILKGEYPVERGLTIGHEPVGIIEKLGSGVTGYHEGQRVIAGAICPSFYSYACQDGCASQDGQGHSHGYKPMGGWRFGNTIDGTQAEYVLVPDAQANLAPIPDGLTDEQVLMCPDIMSTGFSGAEHANIKIGDIVAVFAQGPIGLCATAGARLRGASLIIAVDGIDDRLNISRQMGADVTLNFRNTDVVQEILRITGGRGVDASIEALGTQATFESALRVLKPGGTLSSLGVYSSDLKIPLDAFAAGLGDHRIITSLCPGGKERMRRLMNVIETQRIDLGPLVTHRFKLADIEAAYDLFGHQRDGVLKVAITP

SEQ ID NO: 7094 - protein, 278 aa, Rhodospirillum rubrum ATCC 11170
MSVVQPAGRRLTVRDIASRKSPAAEPVVCLTAYTAPMARLLDPHVDLLLVGDSLGMVIYGLPTTHGVTVEMMIAHGQAVVRGSSHALVVVDMPFGSYQESPAQAFRNAARILSETGAAAVKLEGGREMAETVAFLVQRGVPVMGHVGLKPQMVHAMGGFRAQGRDEAEAEAVVAETRAIAEAGAFSIVVEGTFEQVAARATREVSVPTIGIGASADCDGQVLVIDDALGLFTDFTPKFVKRYADLASTVSAAAEAYAADVRARRFPAPEHCFGIRKVG

SEQ ID NO: 7095 - protein, 340 aa, Staphylococcus epidermidis ATCC 12228
MKAAVVTKDHRVSIEEKRLRELRPGEALVKTEYCGVCHTDLHVKNADFGDVTGVTLGHEGIGRVIKIADNVDSLKVGDRVSIAWMYAACGNCEYCTTGRETLCRDVLNAGYTVDGAMAEEVIVDANYAVKVPENLDPAAASSITCAGVTTYKAVKVSGIEPGQWLGVFGVGGLGNLALQYAKNVMGAKVVAFDINDDKLNFAKELGADAIINSTNVDPIEEVNRLTNNKGLDATVITAVAKTPFNQAVDVVKAGARVVAVGLPVDKMDLDIPRLVLDGIEVVGSLVGTRQDLREAFQFAAENKVIPKIQLRQLSEINDIFDEMEKGTITGRMVIDMKSTH

SEQ ID NO: 7096 - protein, 583 aa, Alnus glutinosa
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 7097 - protein, 399 aa, Bacillus anthracis str. A2012
  misc_feature (143)..(143): Xaa can be any naturally occurring amino acid
  misc_feature (187)..(187): Xaa can be any naturally occurring amino acid
  misc_feature (190)..(190): Xaa can be any naturally occurring amino acid
  unsure (1)..(399): unsure at all Xaa locations
MDTLIFEVGTALVLVAIAAVIAGKFKFSVIPFLIVLGMLVGPHAPTIGVIDFKFIESASVISFLGRIGVLFLLFYLGLEFSMKKLIKSGRSIAIGGTIYILINFSLGLLYGFIMGFPLLEILIIAGIITISSSAIVAKVLVDXRRTGNNETELILGIIMFEDIFLAVYLSVVSGLVLGDHASFLGAXTSXGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 7098 - protein, 827 aa, Aspergillus nidulans FGSC A4
MCCWGGSRSGTLNLCVNSRRVYVADASGAEKKEELDTSTAILKKKKKPNSLIVTDAVNDDNSTISLSNNTMDTLGLFRGDTVTVRGKKRKETVLIVLADDDLDDGSARINRVVRHNLRVKHGDIITVHPCPDIKYAKRIAVLPIADTVEGLTGSLFDVYLAPYFRDGYRPVKQGDLFTVRGGMRQVEFKVVEVDPPEFGIVAPDTIIHSEGEPIQREDEENNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILSIHTKNMKLGEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKFQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALVRPGRLDTLVYVPLPDQASREGILKAQLRKTPVASDVDIEFIASKTHGFSGADLGFVTQRAVKLAIKESISAEIERQKQREAAGEDVKMEDEEEGEDPVPELTRAHFEEAMKTARRSVSDVEIRRYEAFAQSLKNSGGSSFFRFPSANEAADSGNTFGEAGNDDSLYD

SEQ ID NO: 7099 - protein, 397 aa, Wolbachia endosymbiont of Drosophila melanogaster
MSDLAKRMSLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTVELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 7100 - protein, 500 aa, Medicago truncatula
MSTIVEEKKPKTKIVCTLGPASRSIPMVEKLLRAGMNVARFNFSHGSHDYHQETLDNLRAAMENTGILCAVMLDTKGPEIRTGFLKDGKPIQLKQGNEITISTDYSLKGDENTICMSYKKLAEDVKPGSVILCADGTISFTVLSCDKELGLVRVRCENSAVLGERKNVNLPGVVVDLPTLTEKDREDIMVWGVPNKIDMIALSFVRKGSDLVQVRKLLGHHAKNILLMSKVENQEGVANFDDILANSDAFMVARGDLGMEIPIEKIFLAQKVMIYKCNIQGKPVVTATQMLESMIKSPRPTRAEATDVANAVLDGTDCVMLSGETAAGAYPELAVRTMAKICVEAESTINYGDVFKRIMEHSPVPMSPLESLASSAVKMANSAKAALILVLTRGGSTAKLVAKYRAGMPILSVVVPEIKTDTFDWSCSDEAPARHSLIFRGLIPVLSAGSARASHTETTEEALDFAIQYAKTKGLCNNGDSVVALHRVGVASVIKILTVK

SEQ ID NO: 7101 - protein, 275 aa, Oryza sativa
  misc_feature (262)..(262): Xaa can be any naturally occurring amino acid
  unsure (1)..(275): unsure at all Xaa locations
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVXKKDGTVALLHKKK

SEQ ID NO: 7102 - protein, 293 aa, Tropheryma whipplei str. Twist
MLPKRAYPVQDSNVHSQEKKIIAGNWKMNINHSQAVSYLQELNWRLIDNGHDFDSCEIAVFPPFTDLRSVQTLVASDDIQISYGAQDVSAFSDGAHTGQISAQFLKDLDCKYVLIGHSEQRCLPCYPGNNSAINELNNKHDGLIANKLLRSFAAGICPILCIGDISPGDHFDATLSRFRSVLSHLKAISDKKHSIGYALGSKTHFLDSDQLHMLVAYEPSSAINSGNCANSGDIVRMAAAIKDIVNVRVLYGGGVNLFNASAVFNEDLLDGILVGRASLNASDFASLIKTCCL

SEQ ID NO: 7103 - protein, 1164 aa, Gibberella zeae PH-1
MAPTKRSRRDAEQDDEITDVQRARSNYGNGDARKRARVTLDDERTIEQPPRREETPSDESDDDDDDRRQRNSPPRTQYEMMRDDGFKHLKHADWDDQQATQKLAQRSTTLGNNMVSESGIIESITCFNFMCHERLHVDLGPLINFIVGENGSGKSAVLTALTLCLGGKASDTNRGGSLKSFVKEGTEHGSLVVKIKNAGSDAYQPDIYGETIIVERHFSKSGSSGFKIKSANGRIISTKKQEVDEISEWYALQIGNPLTVLSQDNARQFLNAATPAQKYKYFVSGVQLEQLDNDYKMSQDTLEKTSLLRDDLDSKIEQVKKEMEEAKRLSETAQKNKTMREKARHYRNQLVWYQVVEQEQSLAEYEKDLVRRAQTIIEKEQYCESTTEELRLTEEKLEQRRQTKEELEQDRGFYEESIAKATEAHREAAKDESELLMEERDAHQRLKTIKDDIKACKSKIQEEERRLSQSTGNARSEKDNELEQARDKESLLRQQMEEIHNNLPDLQTRLSDAEHELKKLSYSKDIKRKDIVSIEQQVRELKATTGGRFDGYDRDIRDVVSAIENEQGWEQKPVGPIGAHIRLSKPEWSGILERTLGEGLNAFVVRSKSDQTRLSNLMRRLRLKKQPPIYIAYGGKIDTSSQEPDPAFDTILRVLQFDDDIVRSQLIIGNQIEKIILIRDREEAQKVMVEGVPPRNVGACLCFHDGQNKRGWGLRLTNRNGSMATSPVQPYTMRPRMQTDAGQQVRIQEDNLKHLGLEMAEINRKERQAQQAVQRCRTELDNQRKDNRKLEGDLRRTQADIERVQMELDAFEGVDGRLNILRAELESRRSDEESLGNQYGEMALSKRDLKAKTEKARLKLEEARNNQEEFEGKVQKASQKIATAENMRRVAVAKKNDAFEQVDIEKNERRRVEEKREHKAIEVAQFIEQATEAVPERVHIPEDETYDSIEQKYTKLREQLKQREARIGATDDQIFDRSREAEDRYESVQRQTKDLDDTIACLKRAIHSRLYMWRQFQRQISARIRIQFNYLLSERGFRGKIDLDHKNRKVHVQIEPDETRKSSSGRNTKTLSGGEKSFSSICMLLSVWEAIGSPIRCLDEFDVFMDNVNRAISTNMLVDVARRSVSRQYILITPNAIEGRARLDKDVKIIRLTDPRQRTLDDFR

SEQ ID NO: 7104 - protein, 671 aa, Candidatus Protochlamydia amoebophila UWE25
MELFLFTDLLILFAISIIILLVGYRFNIPPVVCFLLTGMLAGPHGLAFVQESKDVEMLAQLGIVLLLFGIGMEFSIKKLFQIKRLFFLGGSLQVGLTILFTYILTQLMQLPWKESIFIGCLISMSSTAIVVRLLDQKGESLSPQGKLSISILIFQDLIAIPMILFIPMLSGNMEEKQFQIEWTVFKPFMVGMLILVAVFFSAQRIVPRLLLQVARTRNKDLFLLSVLTLCFGVAWLTSTLGLSLTIGAFLAGLIISESEYSHEAVGHIFPLQTLFISFFFVSIGMLLNIDFFIHHLFTILALATLVIILKIFVTGLTTLMIGLPMRTAILTGLMLSQVGEFSFVLANAGMPFRLLTDYEYQLFLSISLVSLAISPILISFSPKIVSFICSLPLPQKLLSGLREQRKSDDRSLSNHVIIVGFGISGKNLARSSKLANIPYTILEMNPDIVREQRTLNEPIYFGDATHLTVLEHSHIHKAKAIAVLVNDPIAARRIVKIARESNPTIYIVVRTRYMREMLLMHKLGADEVIPDELGTSVEIFSRVLKQYYIPDEEIHQLVTEVRADGYKMLRDQQAPLTNLSEVKLNLSNVEMGTFRLHENSPLVGMLLSESNLRKKHGMTVLLIRREKAVISNPSPDTQLLANDVLVVVGEKTPLKQALELFGKLEKQSTIN

SEQ ID NO: 7105 - protein, 1233 aa, Coccidioides immitis RS
MNTFTLPDISTLPALRPSDCNQILDTLFEPSKHLHSLTESLLLQQKCISYEALIDLVRARLISLASSKAPDDRTVLLDILGSHPRLGEKAPASRSAESEASKGQEERPLSEFSKAEQANLSMAGQHGTAQHLSLLNREYEEKFPGLRYVTFVNGRGRDMIMEEMRRRIERGDIELEILETIQSTCYDDPGLQQESGSGKAKKSGNSSTTLSRCSPWQQTIKNGISHSVDYGLFVTLTEVWIRNAFVRIIYGTQAAASAALSWNHYSCMMAAETYTRPANGVVAPLHPGPNRAASQSIANETNTPVSEKRRVKGGDANGSLAHGNQQPPVRQGSSDWPSNEHSLPATPVLTRNSTTKSASKGAIGSTALLQQRHHYSSSSTSIPTHATFQHTPIDPLSQQILKRTNTEKSISSKLRTQAAIDVEPGPSDAARALTQEESSSANRPDSNLIQKSSKEKKKGVSFLSRIIGNKKRTDISESNDDVSELGENRAAGMDAEVFAQPIGYIPRFPPPPKYIKVRAQHKKTKDFNRLFVAQELSGNAAQANGSSTNKHATINVFESDAAAQEGRAIWTTEFSKDGKYFAAAGQDRKVRVWAVIGTPEDRQAHEIEEEARNDQPLMRLSAPVFKTQPVQEYEGHTASIVDLSWSKNNFLLSTSLDKTVRLWHVTRRECLCCFNHSDVVTSIEFHPRDDRFFLAGSLDSKLRLWSIPDKNVAFTAVAPDLITAVAFTPDGKHSIAGCLNGQCVIFETDGLKVVSQIHVRSARGRNAKGSKITGIDTILQPPGNDSGIVKILITSNDSRIRLYNFRDRTLEAKFRGNENSASQIRASFSSDGRYIICGSEDRRVYIWPVVCNERFPEKRPVESFEAHSSMATTAVMAPLQTKQTLGSTGDLLYDLCNPPPVTLVGQTASAASRSVTENGGNEFRPGTPRVPPSSNPQKPEESPSHTTRSSHPGGNIIVAADYSGVIKVFRQDCGYHRRRHESWDSSSLFSKRLLGRNNSVSSARRSILSIGKDSLHKSPSERILSWRNSVIGARDNGSFDNVRTLGSRTRSVSPDRPLRKSNSAPKADTSQAIKNLTKRGVISKPAGLTKMTLNHPFTGAVSPEVISDKREIVASPEEYEDSDTKYAPADPLFMAGEQSYTFWNKSQFASLAANRRRSSISNDVEAQQDQANLTSEGSSDEKGFENGMDAEALGEEEEEELSCPQCRATNFRAVRTKTGEQRLKCVLCGAFAS

SEQ ID NO: 7106 - protein, 284 aa, Lactobacillus acidophilus NCFM
MATIQWYPGHMNKARNQLEDKLNLIDVLVEVLDARIPESSRNPMIEELVGNKPHIIILNKADLADPILTKKWAEKFSGPDKYVLALDSLHNTNMQKLISLVKKAASDKTKKLEARGASNPTIRIALAGIPNCGKSTIINRLVGRNVAEVGNKPGVTKGQRWLKTSANIQVLDTPGILWPKFSDQTVGYKLAAFGAIKDSIFHADDVALYVLERLREYYLKDLIKFSKLNSADIENLSDADILLAMTEKYGMRDDYDRFSLFMLQRLRKGAIGRITLDRPDEYDN

SEQ ID NO: 7107 - protein, 660 aa, Arabidopsis thaliana
MSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDMQHRVITKCFWVLFGAATLLGISVTSYGWVLNLIVFLIEEYNIKSIAAAQISNIVNGCLSMLPVVTAILADSFFGNIPVISASAFISLLGIFLLTLISSFENLRPRPCETGSILCQSPSKLHLGVLYAALALVTAGTSGTRVALASAGANQYDKPRDKGSFFNWYFLTVNTGAIISATAIVYTQENASWRLGFGLCAAANLISFIVFISGKRFYKHDKPMGSPFTSLIRVLVAAILKIKVVTSSKEEDYHREVEKESKTCIGMPSKSFRFLNRAALKSEKDLNQEDGLCHNPWRLCSVEEVEDFKSVLRVLPLWLAILFVGTSIGVQASMTVLQALVTDRGLDSKFKVPAGSLQVIVLISSCVFLVLNNWTIYPIYQKITHKQLTPLQQVGIGQVFNILSMAISAIVEAKRLKTVENEHPMSVLWLLPPLVIVGIGDAFHYMANVAVFYGEFPESMRNTATSVTSVAFGISFYLSTALINLIQRTTAWLPDDINHGRVDNVYWVLVIGGVLNLGYFFVCSWYFTYRKIQDDNRQDPKDVTN

SEQ ID NO: 7108 - protein, 323 aa, Pyrobaculum aerophilum str. IM2
MPCIFVSREGFPESMYKKLEEVGRVEVYRHGGSPWSTRGVPKEVLIDAARRCEALVIFIGDVIDKEVLDAGEKLKIVSTASVGVDHIDVEYAKRKGVVVAHTPYVLVDAVADLAVGLLIAVTRKIALGDRLIRSGAADAVWGSLMGVNLRGKRAGIVGLGNIGVAIARRLKAFDIEVAYWSRRRKPEVEFALGIEYMELDSLLSSSDFIFLTMALTPETRWFFNRERFAKVKRGAYFINVARGGLVDTDALIEALEAGVLAGAALDVFDVEPLPARHKLASMDNVVLTPHIGSATVETRRRMAELAAENVVSFFRTGRPIYAV

SEQ ID NO: 7109 - protein, 209 aa, Kluyveromyces lactis NRRL Y-1140
MIFTDIEVAIEKFRQNKFVIVMDDESRENEGDLICAANAITTEQMAFLIRYSSGYVCAPMTNEWADRLDLPLLKDLSCESYADDRHGTAYTITCDYAHGTTTGISAHDRALTCSKLADKTTTAIDYLKPGHVVPLRAKEGGVLARRGHTEAAVDLCKLASLPPVGVIGELVKDEDGDMMRLDDCVEFGKEFDISIITLEALVDYIQKHQ

SEQ ID NO: 7110 - protein, 283 aa, Enterococcus faecalis V583
MTIQWFPGHMAKARREVSEKIKYVDIVFELVDARLPLSSRNPMMDQIVQQKPRLVLLNKGDLADNDQNKKWQHYFQKKGYQTLVINAQQNKGINKIVPAAKEALKEKLAREQAKGLKPRAIRAMCIGIPNVGKSTLMNRLVGKKIAQTGNKPGVTKGQQWLRSGSQLELLDTPGILWPKFEDEEIGKKLALTGAIKDQLLHLDDLAIYGLEFFARFYPQRLTERYGLTEEELFLPAPEQLMLISQKRGFRDDYNRASEMIILEIRSGKLGTYTLDRWEELGDE

SEQ ID NO: 7111 - protein, 390 aa, Pseudomonas fluorescens PfO-1
MAQPYSARSRAIEPFHVMALLARANELQAAGHDVIHLEIGEPDFTTAEPIIRAGQQALTAGKTRYTAARGIPELREAISGFYQTRYGLNIDPRRILITPGGSGALLLASALLVDPGKHWLLADPGYPCNRHFLRLVEGAAQLVPVGPDVRYQLTPDLVARHWDHDSVGALVASPANPTGTILTRDELSGLSTAIKARHGHLVVDEIYHGLTYGTDAASVLEVDDSAFVLNSFSKYFGMTGWRLGWLVAPDAAVSELEKLAQNLYISAPSMAQHAALACFEPDTIAILEERRAEFGRRRDFLLPALRELGFNIAVEPEGAFYLYADISQFGGDAFAFCRHFLETEHVAFTPGLDFGRYQAGHHVRFAYTQNLPRLQEAVERIARGLKSWQG

SEQ ID NO: 7112 - protein, 298 aa, Crocosphaera watsonii WH 8501
MIFIWLYPQSLFDVQVKRIHEYKRQHLNVLHIITLYKCLKNDPNLDVPPRTFIFGGKAAPGYFMVKRMIKLITAVGDVVNNDGDIGDRLKVIFLPDYNVTFGQRVYPAADLSEQISTAGKEASGTGNIKFSMNSALTIGTLDRANVEICEEVGAENFFLFGLTNPEVLNLKAQGYVPRRYYASIPELRGVLDLISSGFFSHGDPELFQCVVDNLLYDDPYLLLADYQSYIECQDKVSQAYKDQENWSNMSILNVARMGKFSSDRSIKDYCGKIWNAPPVPIKLKDYVQKEAQLRVNKF

SEQ ID NO: 7113 - protein, 221 aa, Triticum aestivum
GAMVTAKLSSPAAARLAPSAGSARRASRVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEISSTVTM

SEQ ID NO: 7114 - protein, 555 aa, Zea mays
MMSPASERSLIIQSDDDDDARSGHDVEEPEQDSDSSSSSSSCATPRRGPSSPPYIQQWPQSYRQSIDILSSVQSPNLSFLGTPTLSRLSNSFLAITDSFRSKAPETISSFIKPLLGPAPSDDQQQQHEGTRKSSEYLVPSRRSSLQQIPEDQKPPVGGHGASHDQNCSYTQGVMNGINVLCGVGILSTPYAIKQGGWIGLAILCTFALLAWYTGVLLRHCLDSKEGLKTYPDIGHAAFGSTGRIVISIILYVELYACCIEYLILEGDNLSKLFPNAHLTIGSMTLNSHVFFAILTTIIVMPTTWLRDLSWLSYISAGGVIASILVVICLFLVGVVNDVGFENEGTALNAPGIPIAIGLYGYCYSGHGVFPNIYSSLKNRNQFPSILFTCIGLSTFLYAGAAVMGYKMFGEATESQFTLNLPDNSVISKIAVWTTVANPITKYALTIIPLAMSLEELLPPNQQKYSTIIMLRSSLVISTLLIALSVPFFGLVMALVGSLFAMLVTYILPCTCFLAILKTKVGWHQIAACSFIIVVRVCCAYVGTYSSLSKIIQNYA

SEQ ID NO: 7115 - protein, 352 aa, Thermoanaerobacter ethanolicus
MKGFAMLSIGKVGWIEKEKPTPGPFDAIVRPLAVAPCTSDVHTVFEGAIGERHNMILGHEAVGEVVEVGSEVKDFKPGDRVVVPAITPDWRTSEVQRGYHQHSGGMLAGWKFSNIKDGVFGEFFHVNDADMNLAHLPKEIPLEAAVMIPDMMTTGFHGAELAEIELGATVAVLGIGPVGLMAVAGAKLRGAGRIIAVGSRPVCVDAAKYYGATDIVNYKNGPIESQIMDLTEGKGVDAAIIAGGNADIMATAVKIVKPGGTIANVNYFGEGDVLPVPRLEWGCGMAHKAIKGGLCPGGRLRMERLIDLVFYKRVDPSKLVTHVFQGFDNIEKALMLMKDKPKDLIKPVVILA

SEQ ID NO: 7116 - protein, 286 aa, Thermotoga maritima MSB8
MQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 7117 - protein, 252 aa, Ehrlichia ruminantium str. Welgevonden
MKTMQQHIKLPSGYSLEHHEVLYSTNYEAIKLAQCGGNDGTIIISDKQIKGKGRNNRTWYSPQGNLYFSIIIRELSEVFHLPFISALSVGTTLEQILNKENNTNAKVQYKWPNDILVNSKKISGILLESNIEHNKSQEWVVIGIGVNIYHAPEYATTIQNNIPNISLSNLELLEKIIYNFDKLRKDYLNNGFSNIRNLWLKNTYHNFNDQITIQSCNNIYVGNFVTLDLNGSLVIEQDGQAVHITSGEIFNI

SEQ ID NO: 7118 - protein, 276 aa, Aspergillus oryzae
MGMLALGAMQLAAGAVFEFPSCPKDIPFSCQNSTAVADSCCFNSPGGALLQTQFWDTNPPSGPSDSWTIHGLWPDNCDGSYGQFCDKSREYSNITAILQEQGRTELLSYMKKYWPNYEGDDEEFWEHEWNKHGTCINTIEPSCYKDYSPQKEVGDYLQKTVDLFKGLDSYKALAKAGIVPDSSKTYKRSEIESALAAIHDGKKPYISCEDGALNEIWYFYNIKGNAITGEYQPIDTLTSPGCSTSGIKYLPKKSENSTASAWKFRSDKASQSVRFN

SEQ ID NO: 7119 - protein, 308 aa, Aspergillus nidulans FGSC A4
MPPYTAAQKQQITQFVSFTQANNTTAAKFLRQSRWNTEEAIDAFKNRIAPASMGLIFRPCATAGVREAVLRISIFQKLIPGLPAGNDALADWVLYLYGFTFLLKEFRDSPEENPDTIGIEGAMRYLGDIEVELDEVTCLAIAELLQSPSMGEFTREGFLNGWRSVQCDSIAKMAAHAANLRTRIPSEPDLFRRVYRYTFPLCLVQGQRNLQFEIAVEQWNLFFTTPKGGIAWNTTTTPWLDWWVEFLEERGKKPVNKDLWQQVEVFMRKTHEDEAFGWWSEDGAWPGTLDDFVAWVRKKRGDEGAMEE

SEQ ID NO: 7120 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNELNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 7121 - protein, 383 aa, Thermus aquaticus
MRGLSQRVKSMKPSATVVVNARALELRRKGVDLVALTAGEPDFDTPHHVKERARRGLAQGKTKYAPPAGIPELREAVAEKFRGENGLEVTPEETIVTVGGKQALFNLFQAILDPGDEVIVLAPYWVSYPEMVRFAGGVPVEVPTLPEEGFVPDPERVRRAITPRTKALVVNSPNNPTGVVYPEEVCEALAEMALQHDFYLVSDEIYEHLIYEGAHFSPRHLAPEHTITVERAANAFAMTGWRIGYACGPKAVIKAMADVSSQSTTSPDTIAQWATLEALTNREASMAFIAMAREAYRKRRDLLLEGLSRIGLEAVRPSGAFYVLMDTSPFAPNEVEAAERLLMAGVAVVPGTDFAAFGHVRLSYATGEENLKKALERFAQALQ

SEQ ID NO: 7122 - protein, 249 aa, Coccidioides immitis RS
MARKFFVGGNFKMNGTQKSITDIITNLNSANLDPNTEVVISPPSLYLILSRSLADPKIGVASQNVFDKPMGAYTGELSVEQLQDCGISWTLVGHSERRVILKEDDDFAARKTKSAIDGGLSVILCVGETLEEREADKTVDVVTRQLGAVASRLSAQDWSKLVVAYEPVWAIGTGKVATTEQAQEVHAAVRKYIAESVSPSVAENLRIIYGGSVNEKNCKELAKQADVDGFLVGGASLKPAFVDIVNARL

SEQ ID NO: 7123 - protein, 429 aa, Staphylococcus aureus subsp. aureus MSSA476
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIQQTLKAADYAFSQMK

SEQ ID NO: 7124 - protein, 962 aa, Magnaporthe grisea 70-15
MFTFSPLQGALSEATASQSLLELDGGVKVLIDIGWDETFDVEKLKEVEKQVPTLSLILLTHATVPHLSALVHCCKNFPLFARIPIYATQPAIDLGRTLIQDLYSSTPAAATSIPDSALAEASYSFSQTQTNGHGFLLQAPSPDEIAKYFSLIQPLKYSQPHQPLASPFSPPLNGLTITAYNAGHSLGGTIWHIQHGMESIVYAVDWNLARDNVYAGAAWMGGGHGGGGAEVIEQLRKPTALVCSTRTAEGGLTRAARDKQLLDTMRMAISRGGTVLIPVDSSARVLELAYLLEHAWRSEASTEGGGLSTAKLYLAGRSVHSTIKLAKSMFEWMDNSIVQEFEAGADQGFRRTNGAGGNADAKGKDGGPFDFKYLRLLDRKAQVLKLLEPSTDELRGKVILATDTSLEWGFSKDIISAIANDSRNMVILPEKPAESSRDNPSISRQLWRWWKERRDGVADEQSSGAGSAEQVFAGGRELQIRESKKVPLADSELSIYQQWLATQRQLNATVQGGGASALEASADVADDVSSESSSDSDDSENEQQGKALNASTTQASRKKVVLQDEDLGVMILLKKPGVYDFPVKGKKGRERMFPLAVRRKRNDEFGELIRPEDYLRAEEREENERPDTQQLQSDGQDGFGQKRKWDDAGSRNAANGLNRRGQRGQADDADAAQAASGPAPDELDLVEDVEEEVVTGPAKLVHTSTTVSVNLRLALIDFSGLHDRRSLAMLIPLIQPRKLILVAGSADETEAVADDCRRNAIEVFTPPVGAVVDASVDTNAWVVKLADPLVKRLKWQQVRGLGIVTVTAQLTATPAAQKNGIPLLIADDDGANKRQKIKATGVDDQEPTAEDEDVGVMPTLDVLPVAMVSASRSAAQVLHVGELRLADLRRTMQNLGHSADFRGEGTLLIDGTVVVRKTAAGRVEIESVGVPGTGGGPAARMGGTFYAVKKTIYDGLAVVAGA

SEQ ID NO: 7125 - protein, 463 aa, Yersinia pestis biovar Medievalis str. 91001
MADNAEKKGLHRGLEARHIELIALGGTIGVGLFMGSASTLKWAGPSVLLAYIIAGLFVFFIMRAMGEMLYLEPVAGSFAVYAHKYLSPYFGYLTAWGYWFMWIAVGISEITAIGVYVQFWFPEIPQWLPAIAGVAIVALANLAAVKLYGELEFWFAMIKVTTIIVMILVGLGVIFFGFGNHGQPIGFDNLTAHGGFFAGGWKGFLFALCIVVASYQGVELVGITAGEARNPQVTLRRAINNILWRILIFYVGAIFVIVTIFPWNGIGTEGSPFVLTFAKIGIVAAAGIINFVILTAALSGCNSGMYSGGRMLYALAKNRQLPAGLTKLSASGVPVYCIAITILCLLVGSSLNYIIPNPQQVFVYVYSASVLPGMVPWFVVLVCQLRFRQVHKAALQQHPFKSILFPYVNYLTIAFLICVLVGMGINPDTRLSLLVGAIFLALVTGCYFVLGMHKPKAMEAERL

SEQ ID NO: 7126 - protein, 266 aa, Pseudomonas fluorescens PfO-1
MPAITLTTLQSLKQKGEKITMLTCYDATFAHACNEAGVEVLLVGDSLGMVLQGHDSTLPVTTAEMAYHVASVKRGNSDALILADLPFMANATLEQTMTNSALLMQAGAHMVKVEGALWLADSIRLLAERGVPVCAHMGLTPQAVNILGGYKVQGRNENQARQMRADAISLEQAGAAMLLLECVPSELAAEITQAVKIPVIGIGAGSDTDGQVLVLHDMLGLSISGRVPKFVKNFMQGQDSIQSALKAYVSEVKATTFPGIEHGFSA

SEQ ID NO: 7127 - protein, 448 aa, Oryza sativa (japonica cultivar-group)
MAAAVRPTVKGSCSSGGHAGAGRGAGWAPRRRDRRRGGPRRGRSTRASSRRGRRRPRSGYQSRVSRAEQVGPEIRTGFLKDGKPIQLKQGKEITITIDYSIKGDENLISMSYHKLAIDLKPGSTILCADGTITLTVLSCDCEQGLVRCRCENSAMLGERKNVNLPGVIVDLPTLTEKDKVDILQWGVPNKIDMIALSFVRKGSDLMLVRSVLGEHAKSILLMSKVENQEGVANVDEIIANSDAFMVARGDLGMEIPIEKIFYAQKVMIHKCNIHGKPVVTATQMLESMIKSPCPTRAEATDVANAVLDGTDCVMFSGETAAGAYPELAVQTMANICSRAELYLDYPFIFKKLSSEAPVPLSPLESLASSAVQTANISKASLILVLTRGGTTARLIAKYRPAMPVLFVVVPELKADDSFNWTCSDEAPARQSHCQGFDPNAEHRYTKGI

SEQ ID NO: 7128 - protein, 408 aa, Aquifex aeolicus VF5
MAAAPVEGNGAGLDVHTLFLHLAILLFSAKLFGSIFRKLGIPPVLGEVTAGVILGQSVLGLIPLSEAIKVLAELGVILLLFEVGLEADINMLMRVGLWSTLVAIVGAALPFAGGFIVSYYFFGLDLVASLFMGGALTATSIGITVRVLTDLNKHKERFAQIVLGAAVLDDIMGVIILAALYEFSKTKAVHFDTTVNLIIHILMFFLIAPFVANVLAKLLSIAARKTQDMDLIPASIMALILLAAYSAHKFGSPSILGSFTAGLALSRRFVIPFAAMLRLDEKLLHKVEESITPLVWVMAPIFFVSVGLALNLKAIDFSSPEFWTFSSALIVVAIIGKVLAGFVAPGSLKEKASIGFSMLPRGEVGLIFAEFGRSFKAINEVEYAVIVFVVAVTTLIAPIVLKLLLKEE

SEQ ID NO: 7129 - protein, 377 aa, Aspergillus nidulans FGSC A4
MAPTALEKENHQRDAEFNAAMHGNSAQAKGGFAAMRQKSAAAQKAAVDEYFKHWDNKSAETETEEIREARRAEYATLTRHYYNLATDLYEYGWGTSFHFCRFAYGEPFYQAIARHEHYLAHQMGIKPGMKVLDVGCGVGGPAREIVKFTDAHVTGLNNNDYQIQRATRYAEREGLSHKLNFVKGDFMQMQFPDNSFDAVYAIEATVHAPELAGVYKEIMRVLKPGGVFGVYEWLMTDAYDNDNPEHRKIRLGIEQGDGISNMVKVSEGLAAIKEAGLELLHHEDLADRPDEIPWYYPLAGSFKHMTSPWDFFTIARMTWWGRGLVHRFVGAMETIKLIPQGTQKTADSLALAADCLVAGGEKKLFTPMYLMVARKPE

SEQ ID NO: 7130 - protein, 464 aa, Solibacter usitatus Ellin6076
MPSPKSQDSRPGLLRQIGFFSATALVISNMVGTGIFATTGFMAGDLGSARLILACWTVGALFALAGALSYSELGINFPSSGGEYVYLTHAFGPEWGFMTGWVSFFAGFSAPIAAAALAFSDYLGYFFPLLKQANASIVIGTGTLSLRLGRGQMVASALIAAFTILNCLGVGRTAKVQNVLTSTKLIVIAGFVILGFAAGTGDWRHFSEHAVRTSTVSLPTQFMISLLWVMVGYSGWNAATYVAEEVRRPERTLPAAIAVGSLIVAVLYLGLNLVFIYATPLEQMKGVIAVGTLSASNLFGPGVAGVFSALMAVSIVSTVNAMVTIGPRVYYAMAKNRAFFSAAARVDPRWHTPVYAILSQGLCAMLMTLTPFPQLVVYIGFSLTLFTVLSVASIFIFRRRRRDWQRLRALEFAWPLIPASYILVGTCMMAYGVIWQPRASLTALATVGAGALVYRFGVHVPKVR

SEQ ID NO: 7131 - protein, 307 aa, Schizosaccharomyces pombe
MGKIRVRNNNAASDAEVRNTVFKFNKDFGQHILKNPLVAQGIVDKADLKQSDTVLEVGPGTGNLTVRMLEKARKVIAVEMDPRMAAEITKRVQGTPKEKKLQVVLGDVIKTDLPYFDVCVSNTPYQISSPLVFKLLQQRPAPRAAILMFQREFALRLVARPGDPLYCRLSANVQMWAHVKHIMKVGKNNFRPPPLVESSVVRIEPKNPPPPLAFEEWDGLLRIVFLRKNKTIGACFKTSSIIEMVENNYRTWCSQNERMVEEDFDVKSLIDGVLQQCNLQDARASKCGQTEFLSLLHAFHQVGVHFA

SEQ ID NO: 7132 - protein, 330 aa, Yarrowia lipolytica CLIB122
MSLENPNTLPFNDPETSPKTALVTGASSGIGWYTTLHLYMHGWDVFLGVRNVLKGQKAIDDIKAEAQKRQLDGSIPATAKFGQLAIVEMDLLDIKSLDKVEAQLQNTEKLDLLIHNAGIMAVPRENSKDGWEVQMQTNYVAPFVLTDRLLDLLQKAPKPRIVYLSSIGHHFAMKPAPLDKRQDGFPGLYYGFVRYGYSKTAGMQLINQLAKDYPHILSMSVHPGFVMETELYRHWNSLPLVGPLFNLGFRSFGVVFGVSKEEGCYSTLVAALSPNLTAPTDSGEFLWTKGSEGNPSSLVKDEKYALKNWNWTVDQMEQKNVRIRHFQHKR

SEQ ID NO: 7133 - protein, 191 aa, Arabidopsis thaliana
  misc_feature (107)..(107): Xaa can be any naturally occurring amino acid
  unsure (1)..(191): unsure at all Xaa locations
MAPSNHFSTGEDTSPGEATMVAPCTGLKSSASFPVTRKANNDITFITSNGGRVSCMKVWPPIGKKKFETLSYLPDLSDVELAKEVDYLLRNKWIPCVEFELEHGFVXAREHGNTPGYYDGRYWTMWKLPLFGCTDSAQVLKEVEECKKEYPGAFIRIIGFDNTRQVQCISFIAYKPPSFTEAESPFWNIQR

SEQ ID NO: 7134 - protein, 626 aa, Cryptococcus neoformans var. neoformans JEC21
MPADIPPDAKIKMANDLRKAIRELRDRGLMVAAKWASELLMSLPKEYRSTSNLVFSPPPQISSLPPRSPPGHARPSIGDFLPSPGPGAFAQAGPSRGRTMHGIEIEEEENVIEEDEFQLARGYFDLKEYDRVAWVLRDAQGSRAKFLRYYSMYLSADRKAQESLPHFLDTKEERLAFYPALSALLSELKKESDPYLIYLRGLCYMRLDRRPTAIKCFMDSVRLKPYNWSAWSQMAQLVSSADMFISLKEELPSTPMLTFFAINCMLDLHTATDLVMNMIKELLEIFPSSVHLKAQRALVYYHMRDFETAEEEFDAVQHLDPFRMEEVDIYSNMLYVMNKQAKLGKLAHEYAEIDRNRAEVCCLIGNYYSSRSDHTKAITYFKRSLMLNREYLPAWTLMGHEFVELKNSHAAIEAYRKAIDVNAKDYRAWYGLGQAYELLDMPMYAIEYYNQATSLRPYDCRMWTALATVYENLHRLPDAILAHTRALLGADRVQTMTILLKLASLHTTLDEIDKAVGYHRKVVALGEKSGLEVAEMAGSYLAVAEWEMRGVIQLQQREAREGKRLDRTNGDGDETMDGAEALKEADLALAAQYMERLAQTNAPQRDRAEELLRSLRVYEMRTVAAI

SEQ ID NO: 7135 - protein, 513 aa, Yarrowia lipolytica CLIB122
MILLYVLAFLVSYLIFTRLRYRYQSYKLAQKWKCSPVRDVSSFPMAFPEFLFFFKSGKNNVLLDEFVNFFTKRQPNLTVGLVLAGNDVTVTLEPENLKALLATQFKDFCLGVRHNQLAPILGDGIFTLDGQGWQHSRAMLRPQFARDQVSDVDMIERHVQNLVRKIPQGDSFDIQGLFFNLTLDTATEFLFGQSVSCQTVDNPAEDDSTVTDMPIPMRKSFQSDFNLAQHHGGYRVRLQMFYWLWRPQELFTASKSVRKFVDHYVKKALVESEKEKQADDKYVFLTELAREVKSPQVLSDQALNILLAGRDTTASLLSWCIYLLARHPETWNKLRDEILSTFGSGSDLSLITFESLKRCEYLRFVINETLRLYPSVPVNVRYATRDTTLPRGGGPDESQPILIRKNSVLVYSVFATHRLKKFWGEDADEFRPERWGEGISRGWEYLPFNGGPRICLGQQYALTETSYVLTRIVQLFGTLENADASPEPPMKLHALTMCHLTGVHVKMSTNNLP

SEQ ID NO: 7136 - protein, 592 aa, Neisseria gonorrhoeae FA 1090
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 7137 - protein, 262 aa, Bacillus anthracis str. A2012
LVRLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 7138 - protein, 542 aa, Coccidioides immitis RS
MAEEDTSGQFLCPPKDKEEYPPVYRQHSAYNPLYTFRLPSGKTRHYQQQYADIYFLRLARLKPAVAEIAAAEWEEFTGELCWVVGTVYMDLPLKPNILDDISKEHWTAAPPSRKTYLDPSNQGGTQTMLEDGSGRLRLTGTLLQSALLVTGAVVAVLGTENANGDFEVVDVKVPDLAPQPARWESQYADSASGKRKRSPSETPVDGPRKKIALLSGLGITGTSGDTVALTLLTDYLLGYGEGYGNVGTGSSPIRSAQISRLIIAGNSLGSSVPPSLEEQDEDAAVKKRRQAKKYGYDASAYNASPITHLDNFLAEILPSIPVTIMPGENDPANFALPQQEIHRAMLPRSRNYCSAPRLGIDEPPSEPGWLDTVTNPWQGDVEGWRLWGCSGQNVDDVLRYMYLDDDQTGNGQDIEGDTRLRLMEAMLRWRCAVPTAPDTIWCYPFQDNDPFVLQACPHVFFTGNQPAFRTTVIEKSVSASSMDIEGDQPSKVRLLALPKFRETGELVLLDAETLEVEVVKFGTWQSVKEVESLDAPVNDSQA

SEQ ID NO: 7139 - protein, 420 aa, Stigmatella aurantiaca
MDTHSKRHPSLPRPIQGEMKLENSNRLLAEAKRLIPGVTLSMMKRPEHFAPDAFPVYLARGQGALVEDVDGQQYIDFIGGLGANMLGHNHPAVVESIRKHLDEGLIHSLPTPVELSASQTLIEMIPGAEMARFFKTGADATSAAMRLARIITGKERIITVGYNGWHDHFMVGTPGVPAVMSQYTIRMPLFTPQDETALLACIGENAKQLAAVLISIPFNRCLSREFMHQLRAACTAHEVLMVQDEVITGFRLARGGAQEFFDVKADFVCLSKALAAGMPLSAVAGPAKHLSKLGAMEVQVSTTFGGEMLSLAVCEATLKEYRKGGYIEQLAALGSRLRTGINAKAEKAGSPLRVLGYDSIPFLLFDKNPTEHAKRMQPFQAGMARRGILLRRDVNFISAVHTQEQIDYTIEMAGEVLQSL

SEQ ID NO: 7140 - protein, 394 aa, Xanthomonas campestris pv. campestris str. ATCC 33913
MDSLLSPVSGYSRRSQDIAPFHVMALLARANALEQAGHDVIHLEIGEPDFTTAAPVVAAGQAALAAGHTRYTAARGLPALREAIAGFYAQRYGCHIDPERVLVTPGGSGALLLASSLLVDPSKHWLLADPGYPCNRHFLRLVEAGAQLVPVGPDSDYQLTPALVDACWTADSVGALVASPANPTGSVLSRAQLAALSQALQARGGHLVVDEIYHGLTYGLDAHSVLEVDDSAFVLNSFSKYFGMTGWRLGWLIAPPSAVPELEKLAQNLYISASSIAQHAALACFTPESIAIFEARRAEFQQRRDYLLPALRALGFDIAVEPQGAFYLYADISAFSKDAQAFCTHFLETEHVAFTPGIDFGFHRANQHVRIAYTQSLPRLEQAVERIARGLRHI

SEQ ID NO: 7141 - protein, 448 aa, Blastopirellula marina DSM 3645
MNVVTKVSRVPRSLQLYQKALEIIPGGTQLISRRADRFAHGVSPIYASRAKGARFWDVDGHEYIDWVSGIGSILLGYADDVVDAAVCQQISTGTIYSVNHELEIELAEVLCEAIPCAEMVRYSKTGGEACAMAVRIARGATGRDKVLFCGYHGWHDWYLAANLAEEASLSQHLFPGIEPIGVPQGLRGTAIPFVYGDLVGLGELLDEHRGQIAAVVMEPLRSELPQEGYLAAVAKMTREHGAVFVMDEVSAGLRFSSGGAQKYLGVTPDVAVFAKSLANGYPMAAVVGKREVMEASARMFISSTYWSDTIGLRAALTTLQEVQSRDVPAQLWSFGAKLKSGLNQAGMEYGFDQCCRGVDVHPHLHLEINDADLKSKVNTLYIQEMAKRGCHGFTSFYLNAAQQTKELDQTVNAARETFAIIRNGLEDGNLDAKLECGVQQESFRRLVR

SEQ ID NO: 7142 - protein, 511 aa, Capsicum annuum
MANIDIAGIMKDLPNDGRVPKTKIVCTLGPSSRSVPMLEKLLRAGMNVARFNFSHGTHEYHQETLNNLKIAMQNTQILCAVMLDTKGPEIRTGFLKDGKPIQLKEGQEITVSTDYTIKGNVEMISMSYKKLVVDLKPGNTILCADGTITLTVLSCDPAAGTVRCRCENTATLGERKNVNLPGVVVDLPTLTEKDKEDILEWGVPNNIDMIALSFVRKGSDLVNVRKVLGPHAKRIQLMSKVENQEGVVNFDEILRETDSFMVARGDLGMEIPVEKIFLAQKMMIYKCNLAGKPVVTATQMLESMIKSPRPTRAEATDVANAVLDGTDCVMLSGESAAGAYPELAVKIMARICLEAESSLEYEAIFKEMIRCTPLPMSPLDESSIISCPHGLTKLKQNSIVVLTRGGSTAKLVAKYRPAVPILSVVVPVLTTDSFDWSISDETPARHSLVYRGLIPILGEGSAKATDSESTEVILEASLKSATEKGLCQPGDAVVALHRIGAASVIKICIVK

SEQ ID NO: 7143 - protein, 426 aa, Raphanus sativus
NNSYTLSFLLAFFVFILFRLAFSINTLSSTESLTISSNRTLVSPGDVFELGFFRTNSRWYLGIWYKKLSERTYVWVANRDNPLSNSIGTLKISGNKLVILGHSNKSVWWTNITRGNESSPVVAELLANGNFVMRDSNNNSASGFLWQSFDYPTDTLLPEMKLGYDLRKGLNRFLASWRSSDDPSSGDFLYKLETGRIPEFYLSSGIFRLHRSGLWNGIRFSGIPEDQKLSYVVYNFTENREEVAYTFRMTNNNIYSRLTLSYSGYIERQTWNPSLGIWNVVWSFPLDSQCDVYRMCGPYSYCDVNTSPICNCIQGFNPSNVEQWDLKSWSGGCIRRTPLSCSRDGFNRMKNVKLPETTMAIVDRSIGVKECEKRCLSDCNCTAFANADIRNGGTGCVIWTGALEDIRTYFAEGQDLYVRLAAADLV

SEQ ID NO: 7144 - protein, 427 aa, Raphanus sativus
DNSYTLSFLFVFYVLILLRPAFSINTLSSTESLTISSNRTLVSPGNVFELGFFRTTSSSRWYLGIWYKKLSERTYVWVANRDNPLSNSIGTLKISGNNLVLLGHSNKSVWSTNLTRGSERSTVVAELLANGNFVMRDSNNNDASEFLWQSFDFPTDTLLPEMKLGYDLKTGLNRFLTSWRSSDDPSSGDYSYKLDTQRGLPEFYLLQGDAREHRSGPWNGIGFNGIPEDQKWSYMYNFTENSEEVAYTFLMTNNSFYSRLTLSPSGYFQRLTLNPSTVDWNVFWSSPNHQCDMYRMCGPYSYCDVNTSPSCNCIQGFNPENVQQWALRISISGCIRRTRLSCSGDGFTRMKNMKLPETAMAVVDRSIGVKECKKRCLSNCNCTAFANADIRNGGTGCVIWTGRLDDMRNYVTDGQDLYVRLAAADLV

SEQ ID NO: 7145 - protein, 391 aa, Thermobifida fusca YX
MSEPLVARMAAFGETIFAEMTRLAEHTGAINLGQGFPDTDGPPFLLAEAARYLTEGVNQYPPGYGREELRTAIAADRQERYGLAYDPATEVYITVGATAGIAASILALVEPGDEVVLFEPMYDSYSAVIALAHGVRRPVTLRPSPDNGRYTFDPDELAAAITPRTRAIIVNTPHNPTGTVFTADELAWIARLCRENDLVAVTDEVYEHLTFDGTPHLPLAALPGMAERTLSVSSAGKTFSVTGWKIGWVTGPEPLVRAVATVNQYLTFTANGAQQLAVATALRHGMDWVSEQRDALHAKRDRLVAGLAAAGFQVHPPQGTYFVMADIRPLGYDDGLTFVRTLARRAGVVAIPAQVFYADERHGRHLVRFAFCKRDDVLDEAAARLRAWGDR

SEQ ID NO: 7146 - protein, 431 aa, Raphanus sativus
DNSYTSSFLLVFFVLVLVHPAISMYINTLSATESLTISSNRTLVSPGDVFELGFFRTTSSSRWYLGMWYKKFSERIYVWVANRDNPLSNSIGTLKISGNNLVLLDHSNKSVWSTNFTRGNERFPVVAELLANGNFVMRDSNNNDASGFLWQSFDYPTDTLLPEMKLGYDLKKGRNRLLTSWRNSDDPSSGDYSYKLEPRRLPEFYLLQGDVRAHRSGPWNGIEFSGIPEDQKLSYMVYNFTENSEEVAYTFRMTNSSFYSRLTISSEGYLERLTWAPSSAVWNVFWSSPNHQCDTYRICGPYSYCYVNTSPSCNCIQGFNPENVQQWALRISISGCKRRTRLSCSGDGDGFTRMKNMKLPETTMAIVDRSIGVKECKKRCLSNCNCTAFANADIRNGGTGCVIWTGQLDDMRNYVADGQDLYVRLAAADLV

SEQ ID NO: 7147 - protein, 428 aa, Raphanus sativus
NNSYTLSFLLAFFVLILFRLAFSINILSSTESLTISSNRTLVSPGNVFQLGFFRTNSSSRWYLGIWYKKLSERTYVWVANRDNSLPNSIGTLKISNMNLVLLDYSNKPVWSTNLTRGNERSPVVAELLANGNFVMRHSNNNDASEFLWQSFDYPTDTLLPEMKLGYDLKTGLNRFLTSWRSSDDPSSGNFSYKLETRGLPEFYLSSENFPRHRSGPWNGIRFSGIPEDQKLSYMVYNFTENSEEVAYTFRMTNTSIYSRLTVTYLGEFQRLTWNPLIGIWNRFWSSPVDPQCDTYIMCGPYSYCDVNTSPICNCIQGFNPSNVQQWDLRVWAGGCIRRTQLSCSGDGFTRMKNMKLPETTMATVDRSIGVKECEKRCLSNCNCTAFANADIRNGGTGCVIWTGALEDIRTYFAEGQDLYVRLAAADLV

SEQ ID NO: 7148 - protein, 405 aa, Yersinia pestis biovar Medievalis str. 91001
MPRHIYIATTTDTKGQELAYVSELIQATGLTTVTVDLSTKESQRDSGADICAETVAGYHPDGRQAVFCGDRGQAINAMAIAFERFMVSRVDVAALLGMGGSGGTALITPAMQRLPIGIPKLMVSTMASGDVSGYIGASDIAMMYSVTDIAGLNRISRRVLSNAAHQVAGAVYFAQEASPVDDKPALGLTMFGVTTPCIQAVSAELSDEYDCLVFHATGSGGKAMEKLAESGLLAGVLDLTTTEVCDLLFDGVLACGPERFDAIAHTHIPYVGSCGALDMVNFGSPATIPAKYADRLFYKHNAQVTLMRTTEQENIEMARWIGEKLNRCQGEVRFLIPEGGFSALDAPGQPFWDEKALTAFIRTLEETVIQTDKRRVVHYPFNINDPLFAQAAIENFKEIVNRPSH

SEQ ID NO: 7149 - protein, 200 aa, Glycine max
MSVEELDDNERQAFLIWRRRLARLEENENLVLTPFEKNLDIWRQLWRVVERSDLLVMVVDSRDPLFYRCPDLEAYAREVDDHKRTLLLVNKADLLPASVREKWVEYFCAHNILYIFWSAKAASAAVEGKMLRSPLEADDSGKNNNPDTKIYDRDELLARMQSEAEKIVEMRRNSSSDTGPSNIQSSGENVGGSSSSNNVI

SEQ ID NO: 7150 - protein, 280 aa, Yersinia pestis biovar Medievalis str. 91001
MEKHMPKFQRQAILAKFREMIARREPIIGGGAGTGLSAKCEEAGGIDLIVIYNSGRYRMAGRGSLAGLLAYGNANDIVVDMAKEVLPVVKNTPVLAGVNGTDPFCQFDHFLDHLKALGFSGVQNFPTVGLIDGNFRANLEETGMGYGLEVEMIRLAHQKDLLTTPYVFSAEDAIAMTQAGADIIVPHMGLTTGGNIGADTALKLADCVPLINDWAAAAKSVREEVIVLCHGGPISTPEDAQYIMDHCPQCDGFYGASSMERLPTEIALTDTTQKFKNITR

SEQ ID NO: 7151 - protein, 136 aa, Mycobacterium sp. KMS
MTERTLVLIKPDGVQRRLVGEILGRIERKGLTLAALELKTVDDELARRHYAEHEGKPFFGSLLEFITSGPVVAAIVEGPRAIAAFRQIAGGTDPVEKATPGTIRADLALVTQDNLVHGSDSPESAAREIDLWFPGR

SEQ ID NO: 7152 - protein, 1113 aa, Bordetella pertussis Tohama I
MPATHPAPDPLWYKDAVIYQLHVKSFFDANDDGVGDFAGLLAKLDYIVELGVNTIWLLPFYPSPRRDDGYDIADYRGVHPDYGSLADARLLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTLDAAILTGASADDYQQELAGYEVLAGTIGQRLAQMHSVLARAGELPGFAPRPASERDAALAGERAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 7153 - protein, 336 aa, Clostridium thermocellum ATCC 27405
MAVKIGINGFGRIGRLVFRASLNNPNVEVVGINDPFIDLEYMQYMLKYDTVHGQFKGEISQDNGKLVVNGRKISVYGFTDPAEIPWSECGAEYIVESTGVFTTTEKASAHFKGGAKKVVISAPSADAPMFVMGVNHDKYTKDMNVVSNASCTTNCLAPLAKVIHENFGIVEGLMTTVHATTATQKTVDGPSKKDWRGGRAAAGNIIPSSTGAAKAVGKVIPELNGKLTGMAFRVPTLDVSVVDLTCRLEKPATYDEIKAAVKKASENELKGILGYTEDAVVSSDFIGDPRTSIFDAEAGISLNSNFVKLVAWYDNEWGYSNKVVDLIVHMASVDAK

SEQ ID NO: 7154 - protein, 357 aa, Tropheryma whipplei str. Twist
MVRMKALVYHGPGKRSLDTVDDPTIKLGTDVILEMETTTICGSDLHILKGDVAAVKPGTVLGHEGIGKIVEVGKDVKSHSVGDRVIVSPMSSCGVCRFCRANNNGHCLGDSEGPGGWRLGGLINGVQAQFARIPLADNSLHKLPSGLDPKVGILVSDVLPTGHEVGAQAGQVTLGSVVAVIGCGPVGLGAIVTSLLYSPSKVIAVDADSNRLELARKLGATDTVRVNRERPLDAIEDVKKLTEGGFGVDVAIEAVGVPVTFSMALGIAAPGGRVANIGVHGAPVDFPLQDLWDKNIAVTLGIVSTHTIPLLLAALSEGKIDASQFVTHEFDLSDLERAYDVFSAAAQHNVVKVAIRA

SEQ ID NO: 7155 - protein, 245 aa, Aspergillus nidulans FGSC A4
MSSQTIVLISGANRGLGFEAAKCLVHLANYHIILGSRDLLKADKAADTLHALPNLKCSVSTVQLDVTDKSSITAAKSYIEATFSRLDILVNNAAIYLLNPTSSVDALRASLDTNVIGVVALTEELLPLLRKSASPRLILVSSSNGSLEYNSDPSSPHGGTWAMEYRVTKAALNMLLVQYHASLKEITVLGVDPGFSATEVIGDADALRKMGAAEPEVGGEIIASVVRGEKGQPGRIYGPQGIVPW

SEQ ID NO: 7156 - protein, 469 aa, Bacillus cereus G9241
MYINGEWITLQEQIEVNNPATKEIFATVPKGGVTEAKQAVDAAHEAFKSWSKLTAADRAVKLKKWFTLIDENKEEIAAIMTREQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADKWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFIQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 7157 - protein, 465 aa, Xanthomonas axonopodis pv. citri str. 306
MPEPSSATAPQFQRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSLAWPWCLLFCALIFGLNTVSARWFAEGEFWFSLIKVITILVFIVLGGAAVIGLLPLADGSPAPGLRHLRANGWFAHGTLPILMTMVAVNFAFSGTELIGVAAGETAQPARAIPLAIRTTLVRLVVLFVGTVLVLAALLPARRAAVETSPFVRAFELLGIPYAADILNAVILTAILSAANSGLYAAARMLWSLANEGTLPSGLARLTGRGIPLRAVSLSMLGGLLALLTGVYAPETVFVAISAVSGFAVVVVWLSICAAHYRFRRQWLRDGAALETLAYRAPWYPWTPILGFSLCLLACIGLAFDPQQRIALWCGIPFVALCYGAYALTQWLAARRLYA

SEQ ID NO: 7158 - protein, 257 aa, Bacteroides fragilis NCTC 9343
MKVAIIGAGNMGGSIACGLAKGKLIPASDIIVSNPSIGKLEALKKEFPSIAITRNNAEAATGADIVILAVKPWLIRGVLREMKLRSKQILVSVAAGISFEQLAHDVVEPEMPMFRIVPNTAISELQSMTLIASRNAGQELEALMVNLFSEMGMAMILPEDKLEAATALTSCGIAYVLKYIQAAMQAGIEMGIRPSDAMDMIAQSVKGAAELILNNDTHPSVEIDKVTTPGGITIKGINELEHNGFTSAIIKAMKASR

SEQ ID NO: 7159 - protein, 487 aa, Nocardioides sp. JS614
MRRAKIVCTLGPAVANPRRIRELVYAGMDVARLNMSHGSHEDHAEAYRLVREASDASGHGVGIFADLQGPKIRLERFANGPVVLTRGQAWTITTRDVPGDDRECGTTYKGLPGDVSVGDPILIDDGKVRLRVTKVDGPDVHTEVLVGGKVSDNKGINLPGVAVSVPALSEKDIEDLRFALHLTVDFIALSFVRDAKDVEDVRRIMDEEGVHLPVIAKIEKPQAIENLDEVIAAFDGFMVARGDLGVECPLEDVPFLQKRIVEKARLNAKPVIVATQMLESMIGNPAPTRAEASDVANAVLDGADAVMLSGETSVGEYPVHTVETMARIIAATEAHALAQPPGRAALAEIDWDPHTRGGVIAKAAEEVAERVGAKYVVAFTQSGDSARRMSRLRGPIPILAFTPVGVVRSQLALTWGIETFLTQPVEHTDEMVRQVDDQLLRIGRVREGDLVVIIAGAPPGIPGSTNALRIHRMGDAINQVAPAYRRS

SEQ ID NO: 7160 - protein, 428 aa, Raphanus sativus
DNSYTLSFSLVFFVFILFRPAFSINTLSSTESLTISSNRTLVSPGDVFELGFFTPGSSSRWYLGIWYKKLSDRTYVWVANRDNPLPNSIGTLKISNMNFVLLGDSNKSVWSTNLIRGNERSPVVAELLANGNFVMRDTNNNDASGFLWQSFDFPTDTLLPEMKLGYDLKTGLNRFLTSWRSSDDPSSGEFSYKLELLKIPEFYLSSGYFPVHRVGPWNGIRFSGIPEDQKLSYMVYNFTENSEEVAYTFLMTNNSIYSRLTISSSGYFERLTWTPSSGMWNVFWSSPVDLQCDVYKICGPYSYCDVNTSPVCNCIQGFDPWNVQQWDLRAWSGGCIRRTRLSCSRDGFTRIKNMKLPETTMATVNRSIGVKECEKRCLSDCNCTAFANADIRNGGTGCVIWTGRLNDMRNYAADGQDLYVRLAAADLV

SEQ ID NO: 7161 - protein, 440 aa, Glycine max
MMGEKSNSNSGDAINSTLLHGKYELGRLLGHGSFAKVYHARHLNTGKSVAMKVVGKEKVVKVGMMEQIKREISAMNMVKHPNIVQLHEVMASKSKIYIAMELVRGGELFNKIARGRLREETARLYFQQLISAVDFCHSRGVFHRDLKPENLLLDDDGNLKVTDFGLSTFSEHLRHDGLLHTTCGTPAYVAPEVIGKRGYDGAKADIWSCGVILYVLLAGFLPFQDENLVALYKKIYRGDFKCPPWFSSEARRLITKLLDPNPNTRITISKIMDSSWFKKPVPKNLVGKKREELNLEEKIKHQEQEVSTTMNAFHIISLSEGFDLSPLFEEKKREEKELRFATTRPASSVISRLEDLAKAVKFDVKKSETKVRLQGQENGRKGKLAIAADLYAVTPSFLVVEVKKDNGDTLEYNQFCSKELRPALKDIVWRTSPAENPTLA

SEQ ID NO: 7162 - protein, 240 aa, Burkholderia mallei ATCC 23344
MSFPLPSKSAPADAFSDFPLLDAEPVPPRIAAALAALREGRAVVLQDDHDRENEADLIVAAERLTDETMALLIRECSGIVCLCLTDEKVRALELPPMAQLNESKNGTAFTVSIEARAGVTTGVSAADRVTTIRAAIADNASPHDIVRPGHVFPLRAAPGGVLARRGHTEGTVDLAILAGLKPAGVLCELMNPDGTMARGADVERFAAQHGLPMLTIAELVAFRERLASLRARDACCADLA

SEQ ID NO: 7163 - protein, 429 aa, Raphanus sativus
DKSYTLSFLLVFFVLILFGPAHSINTLSSTESLTISSNRTLLSPGNVFELGFFKPGSSSRWYLGIWYKKLPDRTYVWVANRDDPLSNSIGTLKISNMNLVLLDHSNKSVWSTNLTRGNERSPVVAELLANGNFVTRYSNNNDASEFLWQSFDFPTDTLLPEMKLGYDLKKGLNRFLTSWKNSDDPSSGEISYQLDIQRGIPEFFLLKDGFRGYRNGPWNGVRFNGIPEDQNLSYMVYNFTDNSEEVAYTFLITDKNIYSRLIISNDEYLARLTLTPASWDWNLFWTSPEEPECDVYMTCGPYAYCDVNTSPVCNCIQGFKPLNVQQWDLRDGSGGCIRRTELSCSGDGFIRMKNMKLPDTTMATVDRSIGVKECEKRCLSDCNCTAFANADVRNGGTGCVIWTGKLDDIRNYFEDGQDLYVRLAAADLV

SEQ ID NO: 7164 - protein, 518 aa, Zea mays
MAARFLLVVAVALLLRPGDASVHEYRGLSFANKGNAFILHAGSEGLYAASHANTTAEDDEDTAAVAEAFIRFDKITFRRSEDTNNSVKETSSAKVQVLVFEVEDREMIGGSAYGGQKAICCSSDLAKLGACTEGSVIYRPSQVNPGWPKLFVASFEGSDLIATLPSRTIQITKTGMYNMYFIHCDPSLASLEIEGKTIWKNPTGYLPGRMAPLKNFFGLMSFAFVVLGIYWFYQYMKSWKEVLPLQNCITLVITLGMLEMALWYFEYAEFNETGVRPKGITFWAVTFGTVKRTAAEVIVLIVSMGYGVVAPTLGGLTSKVVMLGGTFFLATEILELVENLGAVNDLSGKARLFLVYPVAILDAAFVVWIFISLAKTIGKLQARRLMAKLDIYRKFATALIVSVLVSVGWIGYEIYSKSTDVFNERWQHAWIIPAFWHVLSFLLLCVICYLWAPSQNSMRFSYDASEFFDRKDNISLIRPAPSASKNGWNLSSTPEPKATKDVNTVADFEGDDEENKRE

SEQ ID NO: 7165 - protein, 436 aa, Raphanus sativus
MTCLRKTYVNSYTLSFLLVFFVLILFRPAFSINTLSSTESLTISSNRTLVSRGDVFELGFFRTNSSSSWYLGIWYKKLPDRTYVWVANRDNPLSSSIGTLKISNMNLVLLDHSNKSVWSTNVTRGNERSPVVAELLANGNFVMRNSNNNEACQFLWQSFDYPTDTLLPEMKLGYDLKTGLNRFLTSWRSSDDPASGDYSYELELRKFPEFYIFDTDTQVHRSGPWNGIKFSGIPEDQKLSYMVYNFTQNSEEVAYTFLMTNNSFYSRLRMSTSGYFQRLTWTPSSVVWNLFWSSPVNLQCDVYRVCGPNAYCDVNTSPVCNCIQGFMPFNVHQWDLGDGLGGCIRRTRLSCSGDGFTRMKNMKLPETTMATVDPSIGVKECEKRCLSDCNCTAFANADIRNGGTGCVIWTGRLDDMRNYVADGQDLYVRLAAADLV

SEQ ID NO: 7166 - protein, 472 aa, Bacillus anthracis str. Sterne
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLVGMWFNDDTRISLVVGIVFLAIVTISFYAFGIGKRPPLDVPNDQEISSK

SEQ ID NO: 7167 - protein, 270 aa, Geobacter metallireducens GS-15
MLKGCRVGFIGGGNMAEAIIRGLLAGGVTAAELVVAEPMAERREFLRETYGIDARADNGEVATMTDALIVAVKPQVFRGMAAALGAAGFAGKLVISIMAGISINGIEEVCGDSSRVIRVMPNTPALVLEGASALSRGKNATDDDLFFAQGIFELVGTTCVVDEKLMDAVTGLSGSGPAYVFMFIEALSDAGVKNGLPRDVATRLAAQTVLGSARLLLETGDHPGVLKEKVTSPGGTTIAGVAALERGSFRGTVMAAVDAATARSAELGKK

SEQ ID NO: 7168 - protein, 213 aa, Clostridium tetani E88
MEMGITLYITRHGQTEWNTERRMQGWNDSPLTKLGMEQAKRLGKRLDNNNIDIIYSSPLGRAIKTAKIVRGERDIPIVCDNRLKEIKLGKWEGMNHDLIDNYYKEEIDNFWNNPKLYKSIGGETFLQLRNRVKDFLEEILKKHKDETILIVTHAITLKGIMNYIEDLTIDNFWGEPHINPTSLTKVEIEDSNRRILLNADISHLDEVKEIKIV

SEQ ID NO: 7169 - protein, 251 aa, Clostridium thermocellum ATCC 27405
MSRKVIAAGNWKMNKTPKEAVEFVQALKGRVADADTEVVVGVPFVCLPGVVEAAKGSNIKVAAQNMHWEEKGAFTGEVSGPMLAELGVDYVIIGHSERRQYFGETDETVNKKVHAAFKYGLKPIICVGESLTQREQGVTAELVRYQVKIALLGLSAEQVKEAVIAYEPIWAIGTGKTATNEQAEEVCGIIRECIKELYGQDVAEAIRIQYGGSVNAANAAELFNMPNIDGGLVGGASLKLDDFEKIAKYNK

SEQ ID NO: 7170 - protein, 280 aa, Nostoc punctiforme PCC 73102
MSATLYQQIQQFYDASSGLWEQIWGEHMHHGYYGADGTQKKDRRQAQIDLIEELLNWAGVQAAEDILDVGCGIGGSSLYLAQKFNAKATGITLSPVQAARATERALEANLSLRTQFQVANAQAMPFADDSFDLVWSLESGEHMPDKTKFLQECYRVLKPGGKLIMVTWCHRPTDESPLTADEEKHLQDIYRVYCLPYVISLPEYEAIAHQLPLHNIRTADWSTAVAPFWNVVIDSAFTPQALWGLLNAGWTTIQGALSLGLMRRGYERGLIRFGLLCGNK

SEQ ID NO: 7171 - protein, 511 aa, Clostridium thermocellum ATCC 27405
MKDKLVMLIILDGYGINPRKEGNAIEAANKPNIDRFMREYPNTIVRTSGMDVGLPDGQMGNSEVGHTNIGAGRIVYQELTRITKSIQDGDFFEKKEFLDAAENCRKHNSKLHLFGLLSDGGVHSHNTHLYGLLEFAKRQNLKDVYVHCFFDGRDVPPDSAMGYVEELENKIREIGVGEIATVMGRYYAMDRDNRWERVKLAYDAMVLGRGNQAQSAKEAVAESYKRQEFDEFVKPTVIMKNGSPVATVGENDSIIFFNFRPDRAREITRAFTEVNFSGFEREKGYFPVFFVCMTQYDKTFENVVVAFKPESLENTFGEYISKKGLRQLRIAETEKYAHVTFFFNGGVEAVYEGEDRILINSPKVATYDLKPEMSAYEVTDKVLECINKKEYDVIILNYANPDMVGHTGVFEAAKAAIEAIDECLGKVVPAVLEQNGVVLITADHGNSEQMIDYETGGPFTAHTTNPVPLIVIGLGDVKLREGRLADLAPTMLDILGFEKPKEMTGESLIVK

SEQ ID NO: 7172 - protein, 262 aa, Oceanicola granulosus HTCC2516
MSADLSPIDKAKFAAARRATDYVEDGMRVGLGTGSTAAWLVKCLGEMVREDGLRLTGVPTSSRTAALAREVGIKVVSLDEARWLDLTIDGADEYDSNLNLIKGGGGALLQEKIVATASDQMVVIADISKQVDTLGAFPLPVEVIPFGWQTTKVLIEETLIGLDVLGRDTSLRLNGERPYVTDEGNYILDLHLNRIGNARQLSLVLNQIPGVVENGLFIDVCDAVVIGYGDGRVEVRDINEGTVEESRIDFLETENLFTDLAD

SEQ ID NO: 7173 - protein, 399 aa, Acidobacteria bacterium Ellin345
MSLLMTKTMTELPLARRMARLGTETAFEVLVRARALEAKGKDIVHLEIGEPDFDTPRNVVDAGIDALNKGFTHYGPSAGLPILRQTIAEEVSKTRGVKVTPEEVVVVPGGKPIIFFTMLALADEGDEIIYPNPGFPIYESMINFVGAKAVPIPLREERDFRLDVNELKDLITDRTKMIIINSPQNPTGGVLTKQDIADIADAIGDRDIMVMSDEIYSRLIFEGQHHSIMSLPGMQERTILLDGFSKTWAMTGWRMGFGVMRADLAAHIARLATNSVSCTASFSQMAGVEAIKGDQSSVAAMNKAFLERRDFFIKRVNQIKGFSCRSPHGAFYTFPNITKTGWPSKKLADALLDEAGVAGLSGTAFGSFGEGYLRFSIANSIENIAKALDRIDEWTKHRL

SEQ ID NO: 7174 - protein, 540 aa, Frankia sp. EAN1pec
MGVARGEAGWDFFISYTAVDTAWAEWIAWQLEDAGYRVLIQAWDSVPGSNWAVRIQQGTTESDRTIAVLSASYLRSVYGQNEWHAAHAADPGGFARTLLPIRVEDCPRPGLLGQIVSIDLFGHPADVARQHLLDAISTARAGRAKPTAAPAFPPRPALPPQQPSARTAPPFPGPDPTASLDQPALRTHARSDRLLHGPQRRVSLAVVLLVITGTVFLASSARDRNPSATSAHSAAPPTSAPTPSLSGSPLRDHTDSVRSVAFSRDGRTLASASQDGTARLWDIAERTSQPLTGRIAVWSVAFSPDKHTLASANGDSTVQLWDVAEGTLPHPVASLPGHSDAVGSVAFSPDGRTLASASDDHTVRLWDVATGTTTHTLTDHTGPVNSVAFSRDGRTLASASDDHTVRLWDVAEGTLLRTLPGHTEPVMSVAFSPDRRTLASASQDNTVRLWDVAARTAPRLVGSLSDHTHWVMSVAFSPDGRILASASQDRTVRLWDVAARTTTHTLTGHTGPVFSVAFSLDGRTLASASDDNTVRLWDMS

SEQ ID NO: 7175 - protein, 458 aa, Bacillus cereus G9241
MSTKMTPPVEKNEFIDVVFEDLTHDGAGVAKVKGYPIFVKNGLPGEEAQIKIIKVKKNFAFGRLMKLHTESPYRKDAECPVYNQCGGCQLQHLTYEGQLQAKEKQVRDVMQRIGGLGDVPVHPVLGMKTPWVYRNKAQVPIGEREGGLVAGFYRQGTHDIINMESCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDANRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVAWLKLV

SEQ ID NO: 7176 - protein, 191 aa, Momordica charantia
EFDSFWFVQQWPPAVCSFQKSGSCPGSGLRTFTIHGLWPQQSGTSLTNCPGSPFDITKISHLQSQLNTLWPTVLRANNQQFWSHEWTKHGTCSESTFNQAAYFKLAVDMRNNYDIIGALRPHAAGPNGRTKSRQAIKGFLKAKFGKFPGLRCRTDPQTKVSYLVEVVACFAQDGSTLIDCTRDTCGANFIF

SEQ ID NO: 7177 - protein, 190 aa, Momordica charantia
MDSFWFVQQWPPAVCSFQKSGSCPGSGLRTFTIHGLWPQQSGTSLTNCPGSPFDITKISHLQSQLNTLWPSVLRANNQQFWSHEWTKHGTCSESTFNQAAYFKLAVDMRNNYDIIGALRPHAAGPNGRTKSRQAIKGFLKAKFGKFPGLRCRTDPQTKVSYLVEVVACFAQDGSTLIDCTRDTCGANFIF

SEQ ID NO: 7178 - protein, 492 aa, Arabidopsis thaliana
MEMLLGGRATNGALRSKTKIVCTLGPVSRSVEMIEKLLKAETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 7179 - protein, 513 aa, Photobacterium sp. SKA34
MSAKKPLALVILDGWGYREDNADNAIANAQTPVMDELLAQNPNTLISASGIDVGLPDGQMGNSEVGHTNIGAGRVVYQDLTRITKAISDGEFFENEALVTAIDKAVNAGKAVHIMGLLSPGGVHSHEDHIASAIEMAAKRGAEKIYLHAFLDGRDTPPRSAKNSLVRFNELFAQLGKGRTASLIGRYYAMDRDNNWDRVEKAYDLISAAKAEFTVANAVDGLAAAYERNENDEFVKATEVRAEGQEAAIMEDGDSVIFMNYRADRAREITRAFEPGFTGFERTQRPQLSDFVMLTQYAADIALTTAFKPASLDNTLGEWLSKKGKKQLRISETEKYAHVTFFFNGGKEDEFDGESRQLVASPKVATYDLQPEMSAPELTDKLVAAIKGGEFDMIICNYPNGDMVGHTGVYDAAVKACEALDTCLGKVVAAIKEMDGQLLITADHGNAEMMVDPSTGGIHTAHTNLPVPLIYVGSKDLDLKSGGKLSDLAPTMLSLTDMEIPAEMSGQVLYNLK

SEQ ID NO: 7180 - protein, 483 aa, Colwellia psychrerythraea 34H
MPRRTKIVATLGPATDDREILKNVLAAGVNVVRLNFSHGIPQDHIDRADNVRAIAKELGVYVGILGDLQGPKIRVSTFKNGPIKLAIGDKFELDATLEKGEGCQEKVGIDYKKLVQDVNTGDILLLDDGRVQLKVLSTSDNSVFTEVTVGGPLSNNKGINRQGGGLTAPALTAKDKEDIKLAAKINVDFLAVSFPRDAADMREARLLAQEAGCDARLVSKIERAEAVNDDKILDGIILASDVVMVARGDLGVEIGDAALVGKQKHIITRSRQLNRVVITATQMMETMIEQPMPTRAEVMDVANAVLDGTDAVMLSAETAAGKYPVETVTAMANVCVGAEQHRSVNISNHRMELTFSEVSETIALSAMYAANHLEGVKAIISLTESGQTSKLMSRITSGLPIFSLSRHPKTLNKTAIYRGVYPIEFDSTHVNNDNLSDEMLKVVSGKIELAVGDKLILTHGDMMETVGASNTLKILTISKRHLK

SEQ ID NO: 7181 - protein, 320 aa, Blastopirellula marina DSM 3645
MTASHFLATSWPYYELLTAAGFEVRFADLSKSLWEPDHLVAALDGAAGVICSTEPYTAEVLSRTQVRVVSRVGVGYDSVNVPAATEQNIAVCRTPGTLHQSVVEHTIGMILAIYRNVISQNKQVRAGDWDRTAGPRAYGKTLGIIGYGVIGKEVAKAAVLLGMQVIAYDPIAPAGGPSEVERVALDEIWRRSDVVSLHAPCTPETERIINAQSLALMKDDALLINTSRGGLVNEPELAAAMKGGKLRGAALDVFEQEPIDKENPLLDVDNIYFTAHMAGLDEQSLLDMSTMAAQNILDLYEARWPAANVVNANELNGWKW

SEQ ID NO: 7182 - protein, 436 aa, Colwellia psychrerythraea 34H
MANKSEKLFNKALKVLPGGVSRNTIFRKPYPFYADKGEGCYVTDVEGVTRIDFANNMASLIHGHAYPAIVDAVTEQLAKGSCFTMATEAEVNYAQLLCDRVPSFDKIRFVNSGTEAVMAMLKASRAYTGKAKIAKVEGAYHGAYDYAEVSQTATPNNWGELDKPNSIPVAVGTPPKALEDVVVIPFNDPERAIKILDQHKDDIACILVDLLPHRVGLIPASNAFINALHQWTRDNKSLLVFDEVITFRTNYSGAQQNYDVAPDLTAMGKVIGGGFPAGALAGCDKVMKVLDPTEPKVLLPHSGTFSANPITMTAGLAAMKDFDQAAVTKLNQLASYAREAITQAMSDVGIKACVTGAGSMFRIHLKAQPPKNYRDGYVDKKESQLITKLLDHLFDNGIMMINTCTATLSTAMTKKEIDHLVCALKDGFELIKPEMA

SEQ ID NO: 7183 - protein, 487 aa, Saccharomyces cerevisiae
MDALLTKFNEDRSLQDENLSQPRTRVRIVDDNLYNKSNPFQLCYKKRDYGSQYYHIYQYRLKTFRERVLKECDKRWDAGFTLNGQLVLKKDKVLDIQGNQPCWCVGSIYCEMKYKPNVLDEVINDTYGAPDLTKSYTDKEGGSDEIMLEDESGRVHLVGDFIRSTPFITGVVVGILGMEAEAGTFQVLDICYPTPLPQNPFPAPIATCPTRGKIALVSGLNLNNTSPDRLLRLEILREFLMGRINNKIDDISLIGRLLICGNSVDFDIKSVNKDELMISLTEFSKFLHNILPSISVDIMPGTNDPSDKSLPQQPFHKSLFDKSLESYFNGSNKEILNLVTNPYEFSYNGVDVLAVSGKNINDICKYVIPSNDNGESENKVEEGESNDFKDDIEHRLDLMECTMKWQNIAPTAPDTLWCYPYTDKDPFVLDKWPHVYIVANQPYFGTRVVEIGGKNIKIISVPEFNSTGMIILLDLETLEAETVKIDI

SEQ ID NO: 7184 - protein, 219 aa, Haemophilus influenzae Rd KW20
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 7185 - protein, 957 aa, Hordeum vulgare subsp. vulgare
  misc_feature (467)..(467): Xaa can be any naturally occurring amino acid
  unsure (1)..(957): unsure at all Xaa locations
MKIPFVTKWSHRSSEPAGPSNSAAAQQQQPPPLSPSAPSRSPPVASTEAAGDEFILQEEEYQMQLALALSASASGAEGAGDPDGEQIRKAKLMSLGKGDPVTNSDLGGGYTAESLSRRYRDYNFLDYNEKVIDGFYDIFGPSAESSGHGKIPSLAELHMSIGDLGYEVIVVDYKFDNALQEMKEVAECCLLGCPDITVLVRRIAEVVADHMGGPVIDANEMITRWLSKSIEQRTSHQTSLLHIGSIEIGLSRHRALLFKILADMVGIPCKLVKGSHYTGVVDDAINIIKMDNKREFLVDVMAAPGTLIPADVFNSKGTPFNFSQTLGQNQVVESASNIEDDPVALQSEHEHYQGHMFANNDRVSDNLSSYENTMTAGSSASEPGTLGKASTLAGAPSKQKKNLQLIPDSHEIDESRNLFAEFDPFNATESGKSSLAFKGLNNRNSDFRRRRENVVPPSARSQQPLVXKNWSACNDISNNKQYNVADGSVPRRNATDNASSSQLALSTAKHYNPNVRELNDRMYAAPARNYDNRIIGTSAMAKASTGDCLDRSQVPPGLYYDKMLGTSSMNTASSSGIGKVAEKDLQNDLEKGPIYSRFDGELSKNAQGFTPERDEHKENCGSYDHRMLHPDPRKSPLDRFMDRPRQNIECVSPSQVGSSKVDLVLDEVSECEILWEDLVIDERIGIGSYGEVYHADWNGTEVAVKKFLDQEFYGDALEEFRCEVRIMRRLRHPNIVLFMGAVTRPPHLSIVSEYLPRGSLYKIIHRPNCQIDEKRRIKMALDVARGMNCLHTSVPTIVHRDLKSPNLLVDDNWTVKVCDFGLSRLKHSTFLSSKSTAGTPEWMAPEVLRNEQSNEKCDIYSFGVILWELATLRKPWHGMNQMQVVGAVGFQDRRLDIPKEVDPIVASIIRDCWQKDPNLRPSFIQLTSYLKTLQRLVIPSHQETASNHVPYEISLYR

SEQ ID NO: 7186 - protein, 410 aa, Haemophilus influenzae Rd KW20
MTNKVSLDKSKIKFVLFEGVHQSALDTLHAAGYTNIDYYKKALDGDELKEAIKDVHFIGLRSRTHLTAEMIEAAPKLIAVGCFCIGTNQVDLNAAKARGIPVFNAPFSNTRSVAELVLGEILLLMRNVPQANAEVHRGVWNKSATGSHEVRGKKLGIIGYGHIGSQLSIIAESLGMDVYFYDIENKLPLGNAKQVRSLEELLSSCDVVSLHVPELPSTKNLMNVARIAQLKQGAILINAARGTVVDIDALAQALKDGKLQGAAIDVFPVEPASINEEFISPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 7187 - protein, 317 aa, Clostridium thermocellum ATCC 27405
MNQKYSLRPYCQISVNPVGLTFLILESKTEEGMIMNDKFTTASFLESKKQGRKITMLTAYDYPTAKILDEAGVDSILVGDSLGMVVLGYEDTTRVTMDDMVHHTKAVVRGVKRAMVVADMPFLSYHTGKNDSVRNAGRLVSEGGCKAVKLEGGEDIIENVKAIISAGIPVVGHLGYTPQSINVFGGHKAQGKTIDTAKKIYRDALLLQKAGVFAVVLECVPYKLAAFISKRLDIPTIGIGSGPDCDGQVLVIHDLTGMFKDFTPKHVKKYAEIGETVSTAVKSYIDEVKNGVFPTEKNSFKVDDWIIDELDKVRFDI

SEQ ID NO: 7188 - protein, 227 aa, Haemophilus ducreyi 35000HP
MELVFIRHGFSEWNAKNLFTGWRDVNLTERGVEEAKAAGQKLLAAGYEFDIAFTSVLTRAIKTCNIVLEESNQLWIPQVKHWRLNERHYGELQGLDKKATAEKYGDEQVHIWRRSYDTLPPLLAPSDPNSAHNDRRYAHLPKEVVPNGENLKVTLERVLPFWEDQIAPALLSGKRVLVTAHGNSLRALAKHIIGISDAEIMDFEIPTGQPLVLKLDSKLNFIEKFYL

SEQ ID NO: 7189 - protein, 339 aa, Schizosaccharomyces pombe
MSYSFQGLLNRVNESAIVNTLKEYTGLNTPKWTFNDIPDLTGKVALVTGSSGGIGYVTALELARKGAKVYLAGRNEEKYQKVMKQIHDEVRHSKIRFLRLDLLDFESVYQAAESFIAKEEKLHILVNNAGIMNPPFELTKDGYELQIQTNYLSHYLFTELLLPTLRRTAEECRPGDVRIVHVASIAYLQAPYSGIYFPDLNLPHVLLGTFARYGQSKYAQILYSIALAKRLEKYGIYSVSLHPGVIRTELTRYSPTFALKLLEKSVFQYLLLDPIRGAMTSLYAATSPEISKEHLNGAYFTAIAQRGILHRAHDDAFVEELYRYTHKIFEDLKYLAPSP

SEQ ID NO: 7190 - protein, 145 aa, Brassica napus
GRPRIRRLRRLTAAPVNGHEALSVYIKYIEETVVTALENWSKMGEIEFLTHVRKLTFRIIMYIFMSTESEHVMDALEREYTNLNYGVRAMAINIPGFAYHKALKARKKLVAAFQSSVNNRRKHRKQNVTTSSKKDMLDNLIDAKD

SEQ ID NO: 7191 - protein, 323 aa, Geobacter sulfurreducens PCA
MDRKILELFRSRSGGVVSGEALSTLLGVSRTAVWKHIKNLKNLGYRIESVPSRGYRLVASPDILIPAEVSAGISVRRIGTHVVCFRETVSTNTVASHLAAEGAAEGTVVLADAQTGGKGRLGRRWESPPGVNVYCSIILRPPISPLHSPQLTLLSAVATAEAIERTSGLVPAIKWPNDILVNGFKVAGMLNELSAETERVEYLVLGIGVNINMERDQFPGDLRYPASSLALEAGRTVERIPFVRALLESLDRLYDEYLLKGFSPVRDAWLARSAVMGRRVKVDGGAGILAGTVEGIDEIGALLVRTAGGSLERVLAGDVSLEG

SEQ ID NO: 7192 - protein, 606 aa, Thermobifida fusca YX
MTTQPAPGARPTPTGSVPDTFTHAKPRDPYWYKHAVFYEVLVRGFYDSNGDGTGDLRGLIEKLDYLQWLGIDCLWLLPIYESPLRDGGYDVSDYMKILPEFGRISDFVELVEKAHQRGIRVITDLVMNHTSDQHPWFQASRHDPDGPYGNFYVWSDTTERYSDARIIFIDTEQSNWTYDEVRGQYYWHRFFSHQPDLNFENPDVQDAILEVMRFWLDLGIDGFRLDAVPYLYEREGTNCENLKETHEFLKRIRAEVDRLYPDRVLLSEANQWPADVVDYFGDYESGGDECHMNFHFPLMPRMFMAVRREQRYPISEILAQTPPIPRNCQWAIFLRNHDELTLEMVSDEERDYMYSEYAKDPRMRANMGIRRRLAPLLENDLNQIKLFTALLLSLPGSPVLYYGDEIGMGDNIWLGDRDSVRTPMQWTPDRNAGFSRCDPGRLYLPVIMDPIYGYQAINVEAQQNNPNSLLNWTRNMIQIRKQHPVFGTGDFTELHASNPSVFAFVREYGDDRMLCVNNLSRFPQPVELDLRRFEGITPIECTGGVHFPPIGELPYLLTLPGHGFYWFQLPPVAEEQPLAQPVTTVPAAPQPPAPADRPASDPTQRS

SEQ ID NO: 7193 - protein, 243 aa, Novosphingobium aromaticivorans DSM 12444
MIATVAEIPSTNAALLARLGGGELLNEGDWLVADRQTAGRGRAGRSWSDGFGNFMGSTVVQLRGADPLPQTLALVTGLAAHQAVMALAPRLSDLRLKWPNDLLVGEAKLAGILLERHANAVVVGIGVNLAQAPDVPDRKTASLSGLGYAIARDAFATELADRFADALARWHLGEWPLLREQWLARALPTGTLVSVKDRDQGTIIGAFGGIDEDGVALMRLADGSVRAIHAGDIEMVGSHASGG

SEQ ID NO: 7194 - protein, 572 aa, Acinetobacter sp. ADP1
MPHDVDLIILLAVGFGIALIFGYIAARLRLPPLIGYLIAGIIISPNTPGVVADMQLANQLAELGVMFLMFGVGMHFSLNDLLQVRRIALPGAILQIAVATLLGFGVSMWWGWNFGSALVFGLSLSCASTVVLLKALGDRGLLDSVNGKIAVGWLLVEDLVMVLVLVLLPATAVLLGGKELAHAGASQNIWLTLGITLLKVAGFIAFMLIIGKRLVPLIMQFVARLGSRELFTLTVVAAAVSIAYGSYAIFGVSMALGAFFAGMVVKESDFSHRAEEETLPLREIFSILFFVSVGMLFDPRILVEQPLHILAVIAIIMIGKTLAAMALVLFFRYPINTALTVGASLAQIGEFSFILATLGVSLGLLTLDAQNLILAGALFSITLNTFIFSAIEPIQRWIRERSHLARLLERSGDPLAMLPDEVDQNYLRDQVVMVGYGEVGRRITKTLMQQEIKVVIAEENREIVEDLRKKGIAAVSGEATEPSVLIQAHIMHARMLILSPMDILDIHRIVDIAKQLNPQIEVLCCAENKEEAEIIRQDEIGLVFYAKEEMAKNMSHHILGQIERAHHLSLGH

SEQ ID NO: 7195 - protein, 350 aa, Glycine max
  misc_feature (170)..(170): Xaa can be any naturally occurring amino acid
  misc_feature (204)..(204): Xaa can be any naturally occurring amino acid
  unsure (1)..(350): unsure at all Xaa locations
MRLGFASWRFIPCTLVAFLILQDSGARKIATTSGKEIQLKEEVSYDLQKLATEGLVLDSIIQLEGADIEKKKHVHKDDDEDEDDRVKKGMGFDKEEDEEEDKDEHKKMVGKDVHGYKPSHKHMDLELNVFFTPNDLKVGKIMPVYFSKKNSSTSPKFLTREEADQIPFLXKHLPSLLKFFSIPQHSPQAKAMKYTLKQCEFEPXEGETKFCATSLESLFDFAHYLFGSNAQFKVLTTVHLTNSTALLQNYTISEVKVISVPNVIGCHPMPYPYAVFYCHSQHSDTNLYEVMVEGENGGRVQAAAICHMDTSKWDRDHVSFRVLKVQPGTSPVCHFFPPDNLVWVPLPLPP

SEQ ID NO: 7196 - protein, 435 aa, Zea mays
MDPCPFVRVLVGNLALRMPVAPPAAGAGAGVHPSTSPCYCKIRLGKMPVQSVPAPLVVSDGGEQTPASGALAAAFHLSKADLEWFNGKPSLFSSRGEASLKVSVYAGRKGSACGVSSGRLLGKATIALDLKGAEAKPAVLHSGWISIGKRSGKGSTAATELSLTVRAEPDPRFVFEFDGEPECSPQVLQVRGSMKQPMFTCKFGCRSNSDLRRPGMQPERDAASAKERKGWSVTVHDLKGSAVAMASMVTPFVPSPGTDRVSRSNPSAWLILRPAGDGAWEPWARLECWRERGGAGASDSLGYHFALLVPGADHAVALADSSIPSSNGGKFVIDLTAAQPLSRGGTPGCSPRGSGDLSNWPLGNYRGFVMSAAVQGEGRCSKPTVEVGVAHIGCAEDAAAFVALAAAVDLSMDACRLFSHRLRKELSHLQADLLR

SEQ ID NO: 7197 - protein, 398 aa, Ralstonia eutropha JMP134
MSSNRGVVYLGPGQVEVQKIDYPKMVDPSGRAIGHGVILKVVTTNICGSDQHMVRGRTTAPTGLVLGHEITGEVIEIGRDVETLKLGDLVSVPFNVACGRCAMCKEQHTGVCLTVNPSRAGGAYGYVDMGGWIGGQSEYVMVPYADFNLLRFPDRDQAMAKIRDLTCLSDILPTGYHGAVTAGVKPGSTVYIAGAGPVGMAAAASARLLGAACTIVGDMNPARLAHAKAMGFEVVDLSKDATLGEQIAEILGTPEIDCAVDCVGFEAHGHGSSGYVEEAPATVLNSLMEITRPAGAIGIPGLYVTDDPGAQDAAAQRGSLSIRFGLGWAKSHSFHTGQTPVLKYNRNLMQAILHNRLPIAEIVNVTVIPLDQAPEGYKQFDGGAPRKFVIDPHGLLAA

SEQ ID NO: 7198 - protein, 719 aa, Elaeis guineensis
EIPYNIGFLQVATLSLQGNRLTGKIPEVIGLMQALAVLDLSENELVGTIPPILGNLSYTGKLYLHGNKLTGPIPPELGNMTKLSYLQLNDNKLVGTIPAELGKLEELFELNLANNNLEGPIPQNISLCTALNKFNVHGNRLNGSIPLQFQKLESLTYLNFSSNNFKGKVPWELGRIINLDTLDLSNNHFSGPIPDSIGDLEHLLELNLSRNNLNGPLPTEFGNLRSGQTIDISYNKLSGPIPEELGQVQTIDTLILNNNDLYGEIPVQLTNCFSLSSLNLSFNNFSGDVPLSKNFSRFPQESFLGNPMLCGNWLGSSCGQDLHGSKVTISRAAVVCITLGCITLLSMMLVAIYKSSQPKQFIKGSNRTVQGPPKLVVLRMDMAIHTYEDIMRITENLSEKYIIGYGASSTVYKCVLKNSKPIAIKRLYSQYPHNLHEFETELETIGSIRHRNLVSLHGYSLSPHGNLLFYDYMENGSLWDLLHGPSKKVKLDWDTRLKIAVGAAQGLAYLHHDCNPRIIHRDVKSSNILLDENFEAHLSDFGIAKCIPAAKTHASTYVLGTIGYIDPEYARTSRLNEKSDVYSFGIVLLELLTGKKAVDNDSNLHQLILSKADDNTVMEAVDFEVRSPAWIWGCQKAFQLAICAQRSDRPTMHEVARVLVSLLPVPSLKPGLVPQKPMDYAHYLAAGPDVKIKRTHDDNSSSDGQWFLRFGEVISKNTL

SEQ ID NO: 7199 - protein, 484 aa, Erwinia carotovora subsp. atroseptica SCRI1043
MSGNHLQDHELFKTGYFVAGKWQQGAATFEVVNPATGESIARVAKAGKKETQAAIDAAHAAFPAWKRKTAKERSEILYRWYELILENKRYLAELMTAEQGKPVQEAEGEVVYAANFIQWFAEQGKRVNGEIIPPAKPGSKIYATREPVGVVVAITPWNFPLAMLTRKLGPALAAGCTGVIKPANNTPLSAFALLALAQQAGVPDGVLNGVAGDTQAISDTVMASDKVRKISFTGSTAVGKTLVRNAADTMKKVSMELGGNAPYIVFDDADIQAAVKGAIANRFRNAGQVCVSANRFYIQDGVYDEFVSLLAEEVKKLKVGNGMDDGVVLGPLIDEAAVEKVEKHVNDAVEKGGKALVGGKRHKLGHSFFEPTVIVDANEAMLLAQEETFGPVAPCFRFKTEEEVIQRANNTPFGLAAYFYSQNLQRVFRVAEALESGMIGINECAVSTELAPFGGVKESGLGREGSVLGLDEFLEVKTWHVGGL

SEQ ID NO: 7200 - protein, 470 aa, Triticum aestivum
NSLYKKAAGTGPEFPGYRRPTRPEAGMNVARLNMSHGDHASHQKVIDLVKEYNAQTKDNVIALMVDTKGPEVRSGDLPQPIFLETGQEFTFTIKRGVGTETCVSVNYDDFVNDVEAGDMLLVDGGMMSFLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATITGGETPSNLGQVFKNHMSEMFAYHSTMMSNTLGTSIVVFTRTGFMSILLSHYRPSGTIFAFTDQEIVRQRSALYQGVCPVHMEFSDCAEKTFGDALSYLLKHGMVKQGEEVALVQSGRQPIWRSQSTRNIQVRKV

SEQ ID NO: 7201 - protein, 147 aa, Triticum aestivum
  misc_feature (67)..(67): Xaa can be any naturally occurring amino acid
  misc_feature (81)..(81): Xaa can be any naturally occurring amino acid
  misc_feature (95)..(95): Xaa can be any naturally occurring amino acid
  misc_feature (100)..(100): Xaa can be any naturally occurring amino acid
  misc_feature (106)..(106): Xaa can be any naturally occurring amino acid
  misc_feature (115)..(115): Xaa can be any naturally occurring amino acid
  misc_feature (124)..(124): Xaa can be any naturally occurring amino acid
  unsure (1)..(147): unsure at all Xaa locations
MAAALRSPASAKVSSPAAASKVRQASRVAVGGFRQHPRSRVGPVAVRASLFSPKPAAAKDARPTKVXELYVYEMNERDREXPAYLRLNAKQTENXAGRLXPFTNKXYNGTWDKRXGITAGLLLXQHFPDATATVQASTLFIRFGRAY

SEQ ID NO: 7202 - protein, 336 aa, Thermotoga maritima MSB8
MMKALILAGGSGERFWPLSTPETPKQFLKLFGNKSLMRWTFERVLEEMDPKDVIVVTHKDYVERTKKELPELPDENIIAEPMKKNTAPACFIGTKLADDDEPVLVLPADHRIPDTKKFWKTVKKALDALEKYDGLFTFGIVPTRPETGYGYIEIGEELEEGVHKVAQFREKPDLETAKKFVESGRFLWNSGMFLWKAREFIEEVKVCEPSIYENLKDVDPRNFEELKKAYEKVPSISVDYAVMEKSKKVRVVKADFEWSDVGNWSSVREIEGYTEESDEVILVDSDRVFVKTHNKPIAVVGLSDVIVIDTPNGILICKEEYAQKVREVVKKLFRTS

SEQ ID NO: 7203 - protein, 343 aa, Vibrio vulnificus CMCP6
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMAELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 7204 - protein, 384 aa, Oryza sativa
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPPELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 7205 - protein, 447 aa, Leifsonia xyli subsp. xyli str. CTCB07
MAAAAIGEANLAQFGRAQRVIPGGVNSPVRAFRSVGGTPRFMVFANGPYIVDAEGREYVDLVASWGPAILGHAHPAVVSAVQEAAARGLSFGASTPAETELAEAVIARVPFVEKLRLVSTGTEATMTAIRLARGFTGRPLLIKFAGHYHGHSDSLLAEAGSGLATLSLPGSAGVTEATAAQTLVLPYNDLGAVRAVFEANGPDIAAVIAEAAAANMGVVPPDEGFNAALTDLAHEYGALLILDEVLTGFRVSEAGFWGLDRGYTPDLVAFGKVIGGGMPLAAVGGRAELMDILAPAGPVYQAGTLSGNPVAVAAGLATLAHAGEAVYDRLDIVAGTLSAAVSDALTAEGVAHSVQRAGNLFSFVFGDVAAAPRTFAEVQRQEAFRYRAFFHAMLDAGVSLPPSVFEAWFVTAAHDDAAVGRVLEALPAAARAAASACPGRPLLFVRR

SEQ ID NO: 7206 - protein, 294 aa, Triticum aestivum
MGGLSLQHPWAFAFGLLGNVISFMTYLAPLPTFYRIYRSKSTQGFQSVPYVVALFSAMLWIYYALLKSDECLLITINSAGCVIETIYIIIYLTYAPKQAKLFTAKILLLLNVGVFGLILLLTLLLSEGEKRVVMLGWVCVGFSVSVFIAPLSVIRLVVRTRSVEFMPFSLSLSLTVSAVVWFLYGLLIKDKYVALPNILGFAFGVIQMGLYALYRNAMPSPAPKQVDDADAIKVPEHVIHIAKLGPAAAIELNTHNPMERGMPPPMEDNGLACASDMTKGGIDMVEKATRVEQV

SEQ ID NO: 7207 - protein, 485 aa, Photobacterium profundum SS9
MEFQMSEQLRRTKIVTTLGPATDRDNNLEKIIAAGANVVRMNFSHGSPEDHIQRTKMVREIAAKLGKHIAILGDLQGPKIRVSTFKDGKIQLAIGDKFTLDSDLPKGEGHQDAVGLDYKELPNDVVTGDLLLLDDGRVQLKVTAVSGNKVHTEVTVGGPLSNNKGINKKGGGLSAEALTEKDKADIITAAQMGVDYLAVSFPRNGEDMKYARSLALDAGLEAKLVAKVERAEAVATTEAMDDIIMASDVVMVARGDLGVEIGDPELVGVQKKLIRRARSLNRTVITATQMMESMITSPMPTRAEVMDVANAVLDGTDAVMLSAETAAGDFPVETVQAMSSVCVGAEKEPSINVSNHRLTRTFASPEETIAMSTMYAANHMEGVKAMVAMTESGRTALMMSRISSGLPIFAMSRNESTLNRSSLYRGVTPVYFDRDSDAGLEAAKHALVVLKEHGYLATGDLVIITQGDVMDTIGSTNNMRILTVE

SEQ ID NO: 7208 - protein, 367 aa, Shewanella sp. MR-7
MALHSIEEIIEDIRQGKMVILMDDEDRENEGDLIMAAELVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSELHGIKIGTIAALIEYRNTKETTVVREAKCKLPTRFGEFDMVTFRDTIDNQLHFALVKGEVKPDCLVRVHLQNTFNDLLHSERDQQRSWPLEKAMERISAEGGVLVLLGNQEHPCEILSKVKAFEAEDQGQAPASAKWQGTSRRVGVGSQILASLGVTKMRLLSSPKRYHSLSGFGLEVTEYVAE

SEQ ID NO: 7209 - protein, 283 aa, Oryza sativa
  misc_feature (101)..(101): Xaa can be any naturally occurring amino acid
  misc_feature (111)..(111): Xaa can be any naturally occurring amino acid
  unsure (1)..(283): unsure at all Xaa locations
MSVIDILTRVDSICKKYDKYDVERLNGANVAGEDPFARLYGSIDADINECVEKAEAAKQEKNRATVVALNAEIRRTKAKLVEEDLPKLQRLALKKVTDLYXSPFLVWVNHXDLRILWPEDSVSPCLLIYLLDLEWKLIYVGSAEDENYDQQLESVLVGPVNVGTYRFVLQADPPDPSKIREEDIIGVTVLLLTCSYMGQEFMRVGYYVNNDYDDEQLREEPPAKLLIDRVQRNILADKPRVTKFPINFHPEPSTSAGQQQQEPQTASPENHTGGEGSKPAADQ

SEQ ID NO: 7210 - protein, 818 aa, Pasteurella multocida subsp. multocida str. Pm70
MIMDNFDSPFLYNRPEITVDSLKKSIVYKLIFSIGRSPKEASQRDWLNATLYAVRDFVTEGWITTARQSRSEETRRVYYLSMEFLIGRTLSNAMLAEGVYDVAKQALSELNVNLEDVLEKEVDPGLGNGGLGRLAACFMDSIATLALPGVGYGIRYEYGMFKQEIEDGHQVEKPDAWLDKGAAWEFIRPSKRHTVRFGGGIHFEGKKCIWTSKEEVEALAYDQMIPGYANDSAATLRLWSAYAGDRFDLADFNKGDYFAAVQDRTLSKNISRVLYPDDSTWSGRELRLRQEYFLVSASLQDIIYRHKRIHNTMENFADKVAIHLNDTHPALAIPELMVILIDQEGYEWKKAWDITRRVFSYTCHTLMSEALETWPVEMMAHILPRHLQMIFEINDYFLEYVRTYVSTDAEFIRRVSLIEEGDHRKVRMGWLSVVGSNKVNGVAAIHSELMVTSTFADFARIYPERFTNVTNGITPRRWIGVANPELSALFDRYIGKEWRRDLSQLTLLKDKVQDPELKKSIAQIKYNNKVKLANYIKNELGVEVDPNALFDVQVKRIHEYKRQILNVLHIIARYNAMLENPEKDWVPRVFILAGKAASAYYAAKQTINLINDVANIINHDERLQGRLKVVFIPNYSVSLAELIIPAADISEQISLAGTEASGTSNMKFALNGALTIGTLDGANVEILDNVGQDHIFIFGNTVEQVESLRRHGYRPFDYYQNDEELRKVVDQIISGRFSPTDANRYHQLLQSLQYHDYYQAFADFRSYVDMQQNVDAKYQDQNAWIDSTLQNIVNMSYFSSDRTILEYAEKIWKIKPVK

SEQ ID NO: 7211 - protein, 491 aa, Roseovarius nubinhibens ISM
MMTDTNLKSLLKDPSLLAEKSYVNGEWIDGEGGTFDVTNPARGDVIAQVTDLSRAQVSKAIDAAVTAQKDWASWTGKERAAVLRKWFDLMMENADDLATILTAEQGKPLAEAKGEIAYGASFFEFFGEEAKRIYGETIPGHQRDKRITVIKQPIGVAASITPWNFPNAMITRKAAPALAAGCAFVGRPAAETPLSATAMAVLAERAGVPAGVFNIVTSSRSSEIGKEFCENPGIRKLTFTGSTEVGRILLRQAADQVMKCSMELGGNAPFIVFDDADLDAAVEGAIMCKFRNNGQTCVCANRIYVQSGVYDAFSKKLAEAVSKLKIGDGLDDGTQLGPLINSDAITKVQEHVADAKSKGAEVILGGGEPMEGEGYFLPPTIITGATQDMAVATDETFGPLAPLFKFDDVDDVIAMANDTIFGLASYFYAKDLSRVYKVAEALEYGIVGVNTGIISTEVAPFGGVKQSGLGREGSHHGIEDYLEMKYICMSV

SEQ ID NO: 7212 - protein, 104 aa, Glycine max
  misc_feature (10)..(10): Xaa can be any naturally occurring amino acid
  misc_feature (31)..(31): Xaa can be any naturally occurring amino acid
  misc_feature (34)..(34): Xaa can be any naturally occurring amino acid
  misc_feature (38)..(38): Xaa can be any naturally occurring amino acid
  misc_feature (45)..(45): Xaa can be any naturally occurring amino acid
  misc_feature (52)..(52): Xaa can be any naturally occurring amino acid
  misc_feature (54)..(54): Xaa can be any naturally occurring amino acid
  misc_feature (67)..(67): Xaa can be any naturally occurring amino acid
  misc_feature (70)..(70): Xaa can be any naturally occurring amino acid
  misc_feature (74)..(74): Xaa can be any naturally occurring amino acid
  misc_feature (77)..(78): Xaa can be any naturally occurring amino acid
  misc_feature (81)..(81): Xaa can be any naturally occurring amino acid
  unsure (1)..(104): unsure at all Xaa locations
TSGPVVCMAXHGVGVLASARRLIGATDPLQXEPXTIIXDLAVQTXRNVLHGXDXPQNGKRDIPLWFXEGXVCYXDPXXSPXLIICPTFNLSTLYLPAPVLFFLL

SEQ ID NO: 7213 - protein, 403 aa, Novosphingobium aromaticivorans DSM 12444
MSLSLEQSPTTGDEVITNYTINFGPQHPAAHGVLRMVMELDGEIIERIDPHVGLLHRGTEKLIEHKTYLQALPYFDRLDYCSPLGMEHSYVLAVEKLLNIEVPLRAQYLRVLFAELTRICNHMLNLGSHVMDVGAMTPNLWLFEIREDCLNFFERASGARMHSAWFRPGGVHQDVPLKLLTDMADWIDERLHPLFDDAMSLVVDNRIFKQRNVDIAVVSKEDALRWGFSGPMIRGSGIPWDLRKSQPYDVYDRMEFDIPVGTSGDCYDRFMVRVEEVRQSARIMKQCIEQMPDGPVASTDRKVVPPKRAEMKQSMEALIHHFKLYTEGFHVPAGEVYVATESPKGEFGVYLVSDGSNKPYRCKIRPTAFSHLQAMDFMCKGHMLPDATAILGAIDVVFGECDR

SEQ ID NO: 7214 - protein, 222 aa, Candidatus Blochmannia floridanus
MISKDKLKKLVGWEALKYIKSNTIIGVGTGSTVNYFIEALSSIKQQIEGVVSSSQHSSNQLKKLGIPLYNLNNLNDLEIYIDSADEIDLHMQMIKGGGGALTKEKIIAFAAKKFICIVDDSKQVNILGRKGPIPVEVIPMARSVVSKSLICLGGLPEYRNGVITDNGNSILDVYNMNITDASLLEQRINNIPGVVSVGLFAQRKADIALIGTQKGIKILNSN

SEQ ID NO: 7215 - protein, 155 aa, Glycine max
MRKRGSHEYDGDSGNTNSKRHLLLWILAAVILIALWSMFAGSVTLKWSLSNNDDLDSTILEDLDVLEVEEREKVVRHMWDLYSHTNTKSVGLPKFWWEAFEAAYQQLVSDVPAVRDAAVSEIAKMSLRSLPIQIQSHSSITASRKIKQAKSRTGQ

SEQ ID NO: 7216 - protein, 338 aa, Zea mays
  misc_feature (323)..(323): Xaa can be any naturally occurring amino acid
  unsure (1)..(338): unsure at all Xaa locations
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYXSTRVVDLIRHMNSTN

SEQ ID NO: 7217 - protein, 369 aa, Oryza sativa
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 7218 - protein, 474 aa, Ralstonia metallidurans CH34
MGLRSQSRHPSGDSLKNLQRNLSARHIRFLALGSAIGTGLFYGSASAIQLAGPAVILAYIVGGAAVYMVMRALGEMAVREPVTGSFGRYASEYLGPLAGFLTGWTYILEMIIVCLADVTAFGIYMGFWFPEVPQWIWVLGIVMLICGLNLCNVKVFGELEFWLALVKILAIAAMIIGGTLILFLGVKMNGEHSPGLTNLWAHGGFLPHGAGGLIASLAVVMFAYGGIEIIGITGGEAQNPEKVIPRAINAVPARILLFYVLTMTVLMAIFPWTGIGSQGSPFVQIFSGLGIKSAAAVLNLIVISAAISAINSNIFGAGRMMYGMAEQGQAPRLFATTSRHGVPWVTVLAMAAALLGGVVLNYLIPEQVFVIIASIATFATVWVWLMILLSQVAMRRRLSAEEVRALKFKVPLWPVGPALAIAFMLFVIGVLGYVEDTRVALYVGAGWVVLLSLAWFLRAKPKADALLARETSVS

SEQ ID NO: 7219 - protein, 379 aa, Streptococcus mutans UA159
MSNLFQNYTRADLEFIKAEGNYLFDTQGKKYLDFSTGIGVTNLGFHPQVQVALQKQAEQIWHTPNLYQNSLQEEVAAKLMAGKDYLAFFCNSGAEANEAAIKIARKATGKQEIITFQNSFHGRTFGSMSATGQDKIKVGFGDAVPHFHYAVFNDLNSVKALVTENTAAVMLELVQGESGVLPAEQDFVTALADYCQKNGLLLIIDEVQTGMGRTGKLYAFQHYGIEPDIFTLAKGLANGVPVGAMLAKKQFGSAFGPGSHGSTFGGNKLAMAASSAVLDIMTKAGFLEQAWENAHYLQEQLTSALQVADTVTQVRGLGYMIGIETTADLGQLVKATRDRGLIVLTAGTNVIRLLPPLTLTKDEIDQGIMILQEVFEQHN

SEQ ID NO: 7220 - protein, 425 aa, Silicibacter sp. TM1040
MLNAEISIRRNAAISRGVGMQTQVYVSRAEGAEVWDVEGHRYIDFAAGIAVVNTGHCHPKVMEAVRSQSAAFTHTCHQVLPYESYIRLAERLNDKVPGNFDKKTAFVTTGAEAVENAIKIARAATGRSAILAFGGGFHGRTFMGMSLTGKVAPYKKGFGAMMPDVYHVPFPVDLHGISTADALGAIDRLFKADLDPDRLAAIILEPVQGEGGFYPAPKELMHALRELCDAHGILLIADEIQTGFARTGHLFAMEGYDVAPDLTTMAKGLAGGLPLAAVTGRAEVMDAAAPGGLGGTYGGNPLGIAAAHAVLDVIEEEDLCTRANALGARLKQRLSAIQERVPEIADIRGPGFMVAAEFNTTDGSAPNPEMANAIRTEALERGLVLLTCGVYGNVIRFLAPITIPDAVFSEALEILEASILAAKDA

SEQ ID NO: 7221 - protein, 489 aa, Silicibacter sp. TM1040
MSTPTSLSLRDPSLLETRAYVNGQWINGATTFDVIDPATGRLVAEVADLDVAAAAKAVDAAHAAGPSWAALAGKERSSILRRWHDLLVENADDLATILTAEMGKPWAEARGEILYGASFIEWFAEEAKRIYGDVIPGPQRDKRIMVLKQPIGVVGSITPWNFPNAMIARKVGPALAAGCTFVARPAELTPLSALAMAVLAERAGIPAGVFNVIPSNDAPGVGRELCTNPKVRKITFTGSTRVGRILMEQASGTIKKMSLELGGNAPFIVFDDADLDAAVEGAMIAKFRNNGQTCVCANRIYVQASVYDAFAEKLAGEVKSLQVGNGFDDATTAGPLINEAALRKVEAHISDAVGKGARIVTGGHRSDLGGTFFEPTVLRDVNPHMVVCHEETFGPLAALVRFDSEEEVIALANDSEFGLAAYFYARDLSRVWRVAESLESGMVGANTGLISTEVAPFGGIKQSGLGREGSKYGIDDFVELKNICLGGMS

SEQ ID NO: 7222 - protein, 481 aa, Photobacterium sp. SKA34
MTERLRRTKIVTTLGPATDRDNNLEKIIAAGANVVRMNFSHGSPEDHIQRTKQVREIAAKLGKNVAILGDLQGPKIRVSTFKEDKIQLTIGDKFTLDSDLPKGEGDQFAVGLDYKELPKDVATGDILLLDDGRVQLKVTSVEGNKVHTEVTVAGPLSNNKGINKKGGGLSAEALTDKDKADILTAAAMSVDYLAVSFPRNGEDMKYARRLATEAGLNAKLVAKVERAEAVATTEAMDDIILASDVVMVARGDLGVEIGDPELVGVQKKLIRRARSLNRTVITATQMMESMITSPMPTRAEVMDVANAVLDGTDAVMLSAETAAGQFPEETVKAMASVCLGAEKEPSINVSNHRLDRFFSSPEETIAMSTMYAANHMEGVKAMVAMTESGRTPLMMSRISSGLPIFALSRNENTLNQASLYRGVTPVFFNRDSDAGLEAAKHALDVLRDAGFVNVGDLVIITQGDVMDTVGSTNNMRILTVE

SEQ ID NO: 7223 - protein, 866 aa, Cryptococcus neoformans var. neoformans JEC21
MFAYLDEHTPHLRRLHAQLALPAAALDHDLHRIEAAVKAVITGIVREREAQVDQLNDDIAAATRDLATLARAVGDRRERDREADDSETLPRQLERLNEQAGELKQVYDERLAHIRQQQATLDRLSTLLGPPWQPSKPLEAIASTSRSANALSGPSHASSGMGMGHADGKRTSGSTQTIAQAIALGHAHTAQGQTPHDTERGQWYDVRESVVEEIDQAVTLALAERDARRRTLCQSLFTLTWLHSELALPPIPTSSPHNFPPHLLPPYAEEEQPGMYASYERLLHTIITLNPLPPMDDDNEEWPMVEDLEGLDDTEPEIPLIEWVDETMELWTSEKEEHEARIQELYNMVEPLWTKLGVEQETMDCFVEMNRGSGEATIRAYEAEYERLLELRRASLSSFILSARSTIVALQTSLLMSPRSQSTFFPEMHDDEYTEDLLHLHEKQVERLEEEVESKKNILPKVREWFKLVEDEEELERNERDPNRFSRRGGAMLREEKLRKRVNVLKPKIEMDLLSLLPTWEEENGRPFMVSGRRVVDRIHDAMEEKELVKEAKKVCPLFIHVDRLLICDQRAKQGLLPLHPSASGPAGNARTLVPSRTIRATPSHASSSRSTRQAAATGGGISNLYSKSSTAPSSTSAAGTGTRLGKRPIGALASASGAGAGAGPGPTPTVGNKRAKVGAGVGLGTSRNAGAGVGAGRGVGAGRGVGRSVSSRSGAAGGGGSPTPRHRDVYPHNQQRSVSHPSAIPSHSTYPPSHTNLPGVPPPPTGVKSLALAPPPKRAINPLALGAGGQLHAAEGEVRRAPRRSFKPRSSVVHGTHGLGGVGSNGNASASASASGEGIGIDGLGGWREGLEGDDGGLEGDDDVF

SEQ ID NO: 7224 - protein, 815 aa, Coccidioides immitis RS
MSAEPDHSHHKHKVNLNDPSGAEKKDELDTATAILKKKKKPNSLIVTDAVNDDNSVIALSNNTMETLQLFRGDTVLVKGKMRRDTVLIVLADDDLDDGSARINRVVRHNLRVKHGDVITVHPCPDIKYAKRIAVLPIADTVEGLTGSLFDVFLAPYFREAYRPVRQGDLFTVRGGMRQVEFKVVEVDPPEYGIVAQDTVIHCEGEPIQREDEEGNLNDVGYDDIGGCRKQMAQIRELVELPLRHPQLFKSIGIKPPRGILMFGPPGTGKTLMARAVANETGAFFFLINGPEIMSKMAGESESNLRKAFEEAEKNSPAIIFIDEIDSIAPKRDKTNGEVERRVVSQLLTLMDGMKARSNVVVMAATNRPNSVDPALRRFGRFDREVDIGIPDPTGRLEILQIHTKNMKLAEDVDLESIAAETHGYVGSDLASLCSEAAMQQIREKMDLIDLDEDTIDAEVLDSLGVTMENFRFALGVSNPSALREVAVVEVPNVRWEDIGGLETVKRELIESVQYPVDHPEKFLKFGLSPSKGVLFYGPPGTGKTLLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALCRPGRLDTLVYVPLPNEAERVSILKAQLRKTPVAPDVDLEFIASKTHGFSGADLGFVTQRAAKLAIKQAISMEIERTKEREAAGEDVMDEDMDDPVPELTRAHFEEAMQMARRSVNDTEIRRYEAFAQSMKNSSGSNFFRFPTEQEAGQAGFGDAGNDDSLYD

SEQ ID NO: 7225 - protein, 1010 aa, Glycine max
MRVLVLFFLFLHSLQAARISEYRALLSFKASSLTDDPTHALSSWNSSTPFCSWFGLTCDSRRHVTSLNLTSLSLSGTLSDDLSHLPFLSHLSLADNKFSGPIPASFSALSALRFLNLSNNVFNATFPSQLNRLANLEVLDLYNNNMTGELPLSVAAMPLLRHLHLGGNFFSGQIPPEYGTWQHLQYLALSGNELAGTIAPELGNLSSLRELYIGYYNTYSGGIPPEIGNLSNLVRLDAAYCGLSGEIPAELGKLQNLDTLFLQVNALSGSLTPELGSLKSLKSMDLSNNMLSGEVPASFAELKNLTLLNLFRNKLHGAIPEFVGELPALEVLQLWENNFTGSIPQNLGNNGRLTLVDLSSNKITGTLPPNMCYGNRLQTLITLGNYLFGPIPDSLGKCKSLNRIRMGENFLNGSIPKGLFGLPKLTQVELQDNLLTGQFPEDGSIATDLGQISLSNNQLSGSLPSTIGNFTSMQKLLLNGNEFTGRIPPQIGRLQQLSKIDFSHNKFSGPIAPEISRCKLLTFIDLSGNELSGEIPNKITSMRILNYLNLSRNHLDGSIPGNIASMQSLTSVDFSYNNFSGLVPGTGQFGYFNYTSFLGNPELCGPYLGPCKDGVANGPRQPHVKGPFSSSLKLLLVIGLLVCSILFAVAAIFKARALKKASEARAWKLTAFQRLDFTVDDVLDCLKEDNIIGKGGAGIVYKGAMPNGGNVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNFEAHVADFGLAKFLQDSGASECMSAIAGSYGYIAPEYAYTLKVDEKSDVYSFGVVLLELVTGRKPVGEFGDGVDIVQWVRKMTDSNKEGVLKVLDPRLPSVPLHEVMHVFYVAMLCVEEQAVERPTMREVVQILTELPKPPSSKQGDLTITESSLSSSNSLESPTTASKEPKDQHPPQSPPTDLLSI

SEQ ID NO: 7226 - protein, 348 aa, Leptospira interrogans serovar Lai str. 56601
MGIMGMKAAVLESGKKILEIRDVSVPQLRAEQVKVRIKACGICGSDVHLVVHGTLKCKHFPRVPGHESSGIIEEVGENVRRFRKGDRVVIAAGTSCGVCSYCKEGKENLCKDLGVFGFDRDGSFAEFNIVEERYLYSLPDEIPFDQGAILADAVSTPYHAIRYRGNIQESDTVAIFGCGGLGIHAVAIARAMTKGKVIALDVDSGALENATKYGADEVVNLKEVRNSGKVLKEVSKGVDLLADFSGYMSNVEDSIRAMNPGGRIVLVGIGRQPLKFQIPFILIEKMISVSGSYGSDRRAIPELIELYLKGKINLSHSITSHHPLEELNECLEALDQRKGNPIRFIVEP

SEQ ID NO: 7227 - protein, 72 aa, Arabidopsis thaliana
  misc_feature (4)..(4): Xaa can be any naturally occurring amino acid
  misc_feature (30)..(30): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(49): Xaa can be any naturally occurring amino acid
  misc_feature (54)..(54): Xaa can be any naturally occurring amino acid
  misc_feature (56)..(56): Xaa can be any naturally occurring amino acid
  unsure (1)..(72): unsure at all Xaa locations
MASXMLSSATMVASPAQATMVAPFNGLKSXAVFPATRKANNXITXITXXGGRVXCXQGPEKKGLYFLPVYGE

SEQ ID NO: 7228 - protein, 241 aa, Triticum aestivum
  misc_feature (139)..(139): Xaa can be any naturally occurring amino acid
  misc_feature (157)..(157): Xaa can be any naturally occurring amino acid
  misc_feature (176)..(176): Xaa can be any naturally occurring amino acid
  misc_feature (189)..(189): Xaa can be any naturally occurring amino acid
  misc_feature (202)..(202): Xaa can be any naturally occurring amino acid
  unsure (1)..(241): unsure at all Xaa locations
MSGVFGRVFGKSKEQSQASALASIDKLSETLEMLEKKENLLMKKVNLEVEKAKAFTKAKNKKAALQCLKRKRLYEQQVEQLGNFQLRIHDQMIMLEGAKATTETVDALRTGASAMKAMPKSTNIDDVDKTMDEIYDNMXENMRQIQDLLSAPYGSSXSDSDEDELEAELADLEGEXLEAQLLAPTTSAXDCSTRVLSISRPXAQSSKTEDDDWQLTTEMAMYYFTGRGMLRQMSIYWDTYS

SEQ ID NO: 7229 - protein, 225 aa, Coccidioides immitis RS
MFTFFTLPLYFQNNASASQAMVSALNKIFDSYRGAMKYLGDIKVQLDEVVCLAISELLRSPSMGEFTRESFIDGWKDSGSDTLAKQASFASNLRKRIRNEPDLFKRVYRYAFILCRLPGQRHLTLEIATEQWRLFFTADNGGISWNTSTTPWLDWWLEFVEGSWKRPINKDLWEQTEVLMRKTLEDPSLKWWSPDGAWPGAVDDFIVFAKGKLGQNSSSEAMDVE

SEQ ID NO: 7230 - protein, 528 aa, Mycobacterium sp. MCS
MSLPVVLIADKLAESTVAALGDQVEIRWVDGPDREKLLAAVPEADALLVRSATTVDAEVLAAAPKLKIVARAGVGLDNVDVDAATARGVLVVNAPTSNIHSAAEHALALLLSAARQIPAADSTLRERTWKRSSFNGTEIYGKTAGVVGLGRIGQLVAARLAAFGTHVVAYDPYVSHARAAQLGIELLSLEDLLARSDFISVHLPKTPETAGLIGREALAKTKKGVIIVNAARGGLIDEQALADAVTGGHVRAAGLDVFATEPCTDSPLFELPQVVVTPHLGASTAEAQDRAGTDVAASVRLALAGEFVPDAVNVGGGVVGEEVAPWLDLVRKLGLLAGTLATEPTTTLSVRVCGELAAEEVEVLRLSALRGLFSTVTDQQVTFVNAPALAAERGVQSELTTASESPNHRSVVDVRAVGSDGSVTNVAGTLSGPQQVEKIVQINGRNFDLRAEGVNLIVNYIDQPGALGKIGTLLGTAEVNIHAAQLSEDAEGPGATILLRLDRDVPAELRSALAEAVDAKTLEVVDLS

SEQ ID NO: 7231 - protein, 146 aa, Lactobacillus acidophilus NCFM
MTKTWRLNERHYGALRGLNKDVSRKVFGVEQVLLWRRGFNSIPPAQGSPVIDRRYKLCDQHLMPRAESLHQTQNRLMPYYYDHIAPKLLNGEDQLIVAHGSSLRALIKKLENINDHDIVNLEVPNAEPIVYTMDDQLNIINKKILR

SEQ ID NO: 7232 - protein, 478 aa, Mesorhizobium loti MAFF303099
MRRSRKVKILATIGPASSSEEMLQKLFEAGADVFRINMSHTDHELMRTLVGRIRAVEEKVGRPIGILADLQGPKLRVGKFANGKEVLTPGQTFTLDDNPEPGTSSRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMDRIATKVETDPTYAGIINAQRSEPEATGADAISLAAREIAETLKLSAIITYTASGTTGLRAARERPQVPIIALSPILNTARRLSLLWGTHCVVSPDATDLDDMVNRACRIALEEEFGKPGDRVIITAGVPLRTPGSTNMLRIAYVGSEKQGSR

SEQ ID NO: 7233 - protein, 557 aa, Aspergillus nidulans FGSC A4
MIEELVSKTTPGQAVVYLLGAFFLACLARKIQVQWQLSRLGSRAPKIPFRLPYGLLIPSISRNSHADRRLSSAMDFIYKSMQANKSDQDLEYFTDVMRNAKGAPLAEDKKTVELDAGISSRIIFTRDPENIKAILTGQFSDYGKGESFHRDWREFLGDSIFVTDGEQWSASRHLIRPMFVRDRLVDTEIFEKHVQHLIPLLAGNNESKIVDVTSLFFRYTLDAATNYLLGQGTDSLQNPETEFAEAFRYVQRRQAQYFRLGVFKFVLSRTEFRRQLKVMDDFIKPYIDRVLAMSPAELDQKLSKSDTFLHALARFTRDRRTLRDQLVAILLAGRDTTAATLSFCLFELARNPEVTAKLREEIASRLGLGASAQKPSYTDLKEMKYLNAVLNESMRLYPVVPFNVRFSLKDTTLPRGGGPDGLAPVAVRAGTRVVYSTMIMQRSPENYDPPSAPNYFDPAQWNPERWLSGWQPKPWQFIPFNGGPRICIGQQFAMIEMGYTVVRILQAFERIQAVPEAGKSVVEDPRLRFEVTLTPASELNCVFVRDGEGREDEKISR

SEQ ID NO: 7234 - protein, 473 aa, Bacillus thuringiensis serovar konkukian str. 97-27
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 7235 - protein, 230 aa, Lactobacillus plantarum WCFS1
MAKLVLIRHGQSEWNLSNQFTGWVDVDLSEKGVEEAKAAGQKVKEAGLEFDYAFTSVLTRAIKTLHYVLEESDQLWIPETKTWRLNERHYGALQGLNKKETAEKYGDDQVHIWRRSYDVLPPLLSADDEGSAVNDRRYADLDPNIVPGGENLKVTLERVMPFWEDQIAPKLLDGKNVIIAAHGNSLRALSKYIEQISDDDIMDLEMATGEPVVYDFDEKLKVLGKEKLGK

SEQ ID NO: 7236 - protein, 584 aa, Saccharomyces pastorianus
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMRVGEVAHGSDNALYTSAARYEVSEVFSFTHVEVGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 7237 - protein, 202 aa, Arabidopsis thaliana
  misc_feature (4)..(4): Xaa can be any naturally occurring amino acid
  misc_feature (7)..(7): Xaa can be any naturally occurring amino acid
  misc_feature (125)..(125): Xaa can be any naturally occurring amino acid
  unsure (1)..(202): unsure at all Xaa locations
MSKXENXYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRXRGFTGRDKIIKFEGCYHGHATAAVKPVLRTLGNRAFGRFAYPNLTYNFPPSLLREGSFKFCPLNWWDKVPFCQLQNG

SEQ ID NO: 7238 - protein, 336 aa, Glycine max
MEGAILPSLPNTRLAARPYMLSCSWRRHVALQLAEISSTAVARVAVVTGGNKGIGFEVCRQLASGGIAVVLTARDEMRGGEAVERLNALGLSHVVFHQLEITDASSAAALAGFLKARFGKLDILVNNAAVGGVEYGQEFDTNEEKFGGMDFHQRVEWMLKNAREPIDSAKNSVKTNYYGTKHVIEALLPLLQASSEGRIVNVSSNYGLLRHIGNEEVRQELNDVDNLTEERLDELLDKFMKDFEAGALEPHGWPTKFSAYKVAKTAMNAYSRILARRHPELRVNCAHPGFVKTDMSMGSGVLTPEEGARNLVKVALLPDGGPTGAYFAMGEEALFV

SEQ ID NO: 7239 - protein, 366 aa, Bacillus halodurans C-125
MKIQAAVLHNKGEPFSIEEVELAEPKADEILVKIVASGVCHTDAVAREQLIPIPLPAVLGHEGSGVVEAVGTHVTSVKPGDHVVLTFTTCGECENCQSGHPSFCTEFAPLNFFGKMSDRTNRIQQNGKDVSTFFGQASFGTYAIANARNVVKVDPDVDLALLGPLACGIQTGAGTVLNKLRPEFGSSVAIFGCGAVGLSAVMAAKIVGCQKIIAIDIHDSRLALAKELGATHVFNGNDSRLVEAIQAVTNGGTNYAVETTGISHVFHQSIKALTTLGVVAVVGVGGDVTVNMNDDILSQGKTITGVIEGDVVPQLFIPKLIDYYKAGHFPFDRLVKLYELDEINQAFEDSKNGSAVKPIIKMNHHI

SEQ ID NO: 7240 - protein, 278 aa, Brodoa intestiniformis
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRVEKSVTYDQIKETMKKASEGELKGIMAYSEDALVSTDLNGDNHSCIFDATAG

SEQ ID NO: 7241 - protein, 255 aa, Phanerochaete chrysosporium
MAQSREDSVYLAKLAEQAERYEEMVENMKRVASSDQELTVEERNLLSAAYKNVIGARRASWRIVSSIEQKEESKGNEAQVAMIKGYREKIESELAKICEDILDVLEKHLIPSAASGESKVFYHKMMGDYHRYLAEFATGDKRKESADKSLEAYKAASDVAVTELPPTHPIRLGLALNFSVFYYEILNSPDRACHLAKQAFDDAIAELDTLSEESYKDSTLIMQLPRDNLTLWTSDMQDSDKPADEKPSDEADNES

SEQ ID NO: 7242 - protein, 458 aa, Pseudomonas aeruginosa UCBPP-PA14
MSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGDPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTGEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNQVEPGAPIEGNSYEQLEPSLPNNLRDALRELDDSEILAKYIDPKYIDIFVACKESELEEFEYSISDLEYNWYLHTV

SEQ ID NO: 7243 - protein, 278 aa, Almbornia azaniensis
VEHGEVKVVAVNDPFIEPHYAAYMLKYDSQHGQFKGTIEVKGSDLIVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMNDNFTIIEGLMTTIHSYTATQKTVDGPSSKDWRGGRTAAQNIIPSSTGAAKAVGKVIPSLNGKLTGMSMRVPTSNVSVVDLTCRLEKSVSYDQIKETMKKASEGELKGIMAYSEDALVSTDLNGDNHSCIFDATAG

SEQ ID NO: 7244 - protein, 817 aa, Vibrio sp. Ex25
MKPTQQKQFDKKSFQESVKKHLSVTYAHTIENADSRAWYLAMGHALAEFTTLDLLATEEDPRIKSAKSVNYLSLEFLIGRLTGNNLISMGLYEQVTEAMAELGYNLTDLLEEERDPSLGNGGLGRLAACFMDSCAAQEFPTVGYGLHYEYGLFKQSFKDGRQQEAPDAWRGVEGYPWEIARPELAQEIGFYGHVEVVNENGKEVRKWVPGMSVRAMPWDLPIVGYESDTVYPLRLWECQAIAPFSLASFNNGDYFEAQHALIDAGNITKVLYPNDNHEKGKTLRLMQQYFHSAASVRDILRRHEAAGYSLADLPKQETIQLNDTHPTIAIPELMRILMDEKGLTWEAAWEISSQTFAYTNHTLLPEALETWPESLIQHLLPRHMEIIYEINHRFLQDVRAMWPGDVAKQQKLSIIEEGFHRMVRMANLCVIGSYAVNGVAALHSELVKKDLFPEFHEMYPTRLHNVTNGITPRRWLKFCNPGLSKLITEKVGPEWPAKLEQLEGIAKYATDEKFQKEFMAVKKENKERLANWVKENMGIELDTNAIFDVQIKRLHEYKRQHLDLLHVLSLYHRIINEPGFECVPRVVFFAAKAAPGYHLAKEIIFAINKIAEKVNNDPRIGNKLKVVFIPDYRVSMAEIIIPAADVSQQISLAGKEASGTGNMKMALNGALTIGTMDGANVEIREEVGDENIYIFGLDVEGVKALKAQGYNPFDYYNADHLLKASMDLLLGEEFTPGQPGLLRATYDSLLDGGDPYLCLADFASYVKAHEDMSEQYKDQAGWAKKAILNTALVGKFTSDRSIRDYVNNIWKLKAVHR

SEQ ID NO: 7245 - protein, 374 aa, Methanothermobacter thermautotrophicus str. Delta H
MIMRKFASRVKDIQLSEIRKIFEVADEDTINLGIGEPDFSVPDHVREAVKDAVDEGLTHYTSNMGMEELREAIADKLKSENRVHAEPESIIVTVGASEAIFMCTQALLDIGDHALIPDPGFLSYDACVRLSGAVSIPVPLSMDEGFSMSPERVESLITQDTRVIIMNSPSNPTGSVMGKDDVKGIAEIAEDNDLIIISDEIYEKIIYDGKHYSPAQFTDNALIVNGFSKTYAMTGLRIGYVAGCEDIIEELLKVHQYNTACAPSISQYAALAAIRGPQNCVKDMVDEFRRRRDLMFRSLTDMGLECVLPGGAFYMFPYAGDSEEFTKLSLEAGVAVVPGSAFGNEGKGYIRMSYATSYELIEEAMERLKTVCGV

SEQ ID NO: 7246 - protein, 294 aa, Staphylococcus aureus subsp. aureus MSSA476
MVIQWYPGHMAKAKREVSEQLKKVDVVFELVDARIPYSSRNPMIDEVINQKPRVVILNKKDMSNLNEMSKWEQFFIDKGYYPVSVDAKHGKNLKKVEAAAIKATAEKFEREKAKGLKPRAIRAMIVGIPNVGKSTLINKLAKRSIAQTGNKPGVTKQQQWIKVGNALQLLDTPGILWPKFEDEEVGKKLSLTGAIKDSIVHLDEVAIYGLNFLIQHDLARLKSHYNIEVPEDAEIIAWFDAIGKKRGLIRRGNEIDYEAVIELIIYDIRNAKIGNYCFDIFKDMTEELANDANN

SEQ ID NO: 7247 - protein, 400 aa, Rubrobacter xylanophilus DSM 9941
MPFSPVEEIIEEIRAGRMVIVCDDEDRENEGDLTVAAELVTPEHINFMAKYGRGLICLPMAQELIERLEIPEMVRHNSSRMGTAFTVSIEAREGISTGISAADRAHTCRVAVSDEAGPEDIVMPGHVFPLKARKGGVLQRPGQTEAAVDLARLAGLKPAGVICEVMKDDGTMARVPDLERFSAEHGIKMVTVAQIIEYRRAYETQVRCAAQTRLPTPFGEFRLRAYENDVDELTHLALIMGEPEGKEDVLVRIHSACLTGDALHSLRCDCGEQLRASMERVAAEGEGVIVYMQQEGRGIGLLNKMKAYHLQDEGLDTVEANQKLGLAPDLRDYGIAAQILKDLGLERIRLLTNNLTKVVGLQGFGLTIGERIQIEVPPNGHNERYLRTKREKLNHLLREV

SEQ ID NO: 7248 - protein, 351 aa, Magnaporthe grisea 70-15
MSSPKEFRLFCLENPLLDIQAVGDEALLNKYGLKANDAILAEAKHAGIFEELLNNYDAKLIPGGAAQNTARGAQYMLPPNSVVYSGGVGDDKYSAILRDAVQKVGLRVEYRVDPKETTGRCAVVITGHNRSMCTELGAANHYEVEFLKKPEVWELVKGAEVYYIGGYHFTVCPPAIMELAKEAATNNKTFILSLSAPFIPQFFKDPLDAALPYCDYVIGNETEAAAFAESHDMADKKDDVRAIAKAIANLPKENSQRKRVAIITQGTLPTIVAVQGEEEVKEYPVHEIAKEQINDTNGAGDAFAAGFCAGVVENKALAECVDRGQWLARLSIQELGPSYPFPKQTYQPKSA

SEQ ID NO: 7249 - protein, 528 aa, Thermobifida fusca YX
MPKPVVLVAEELSPAGIALLEEDFEVRHVNGADRSQLLPALAGVDALIVRSATKVDAEVLAAAPSLKVVARAGVGLDNVDVEAATKAGVLVVNAPTSNIISAAEQAINLLLATARNTAAAHAALVRGEWKRSKYTGVELYDKTVGIVGLGRIGVLVAQRLQAFGTKLIAYDPFVQPARAAQLGVELVELDELLERSDFITIHLPKTKDTIGLIGEEELRKVKPTVRIINAARGGIVDETALYHALKEGRVAGAGLDVFAKEPCTDSPLFELENVVVAPHLGASTHEAQEKAGTQVARSVKLALAGEFVPDAVNIQGKGVAEDIKPGLPLTEKLGRILAALADGAITRVEVEVRGEIVAHDVKVIELAALKGLFTDIVEEAVTYVNAPLVAKERGIEVSLTTEEESPDWRNVITVRAILSDGQRVSVSGTLTGPRQLEKLVEVNGYTMEIAPSEHMAFFSYHDRPGVVGVVGQLLGQAQVNIAGMQVSRDKEGGAALIALTVDSAIPDETLETISKEIGAEISRVDLVD

SEQ ID NO: 7250 - protein, 469 aa, Aquifex aeolicus VF5
MPKYTPEEVLDLIQKEGVQYVDLRFSDPFGQWQHLTIPAYEISKETFEVGRGFDGSSIRGWQSINESDMLAKPDPNTAFIDPFIEPKTLVMICDIYDPVTGERYGRDTRYIAQKAEQYLKQTGIGDTAYFGPEAEFFIFDSVEFGTAANYAFWRVDSEEGWWNREVPSSGYKIPHKRGYFPAPPVDKMMQLRNEMVSIMSDLGIIVELHHHEVATAGQGEIDIRYDSLLNQADKLFLYKYIVRMVAAKHGKYATFMAKVLPNDNGSGMHTHFSIWKNGENLFAGSEYAGLSKTALYAIGGILKHGPAIAAFTNPTVNSYHRLVPGYEAPVRLAYSARNRSAAIRIPMYSQNPKAKRIEVRFPDATSNPYLAFAAILMAAIDGIENEIDPGEPFDKDIYSLPPEELEGIPQLPGSLEEALKALEEDYEFLLKGNVFTEEFIQLWIESKRAEIDELRFIPHPKEFELYWDI

SEQ ID NO: 7251 - protein, 985 aa, Crocosphaera watsonii WH 8501
MPNLDITANQPKTNDNRTYNIENTLAPTDSFINRHIGPNSQEIDKMLKVLGFSSLDKLIDATVPQGIHLSKTLILPEAQSEYGALAQLKSIASKNQIFRSYIGMGYHDCITPPVIQRNILENPGWYTAYTPYQAEIAQGRLKALLNYQTMIVELTGLEIANASLLDEGTAAAEAMSMSYGLCKNKNANAFFVDCHCHPQTIEVIKTRAYPLGIELIIADHRFFEFEQEIFGALLQYPATDGTIYDYRTFIESAHDKGALVTVAADPLSLALLTPPGEFGADIAVGSTQRFGVPLGYGGPHAAYFATREAYKRKIPGRIVGVSKDAQGNPALRLALQTREQHIRRDKATSNICTAQVLLAVIAGMYGVYHGPEGVKNIAQRIHQLTVILAKGLQKLSYTVNDEPFFDTVRVGVGDASVKAVIAAAAERKINLRLYTEGVLCISLDETTTVHDVVELWQIFAAKDELPFTVEEIAEEVNFDLPIFFQRTSEYLTDPVFNQYHSESKLLRYLHQLESKDLALNTSMIPLGSCTMKLNSAAEMMPVTWPEFGKLHPFAPLSQTEGYQILFQQLEVWLGEITGFDGISLQPNAGSQGEYAGLQVIRQYHENRGEANRNICLIPESAHGTNPASAVMCGMKVVPVKCDKEGNIDIADLQKQAEKHSENLGALMVTYPSTHGVFEEEIINICNIVHNHGGQVYMDGANMNAQVGVCRPADFGADVCHLNLHKTFCIPHGGGGPGMGPIGVKEHLIPFLPTTNLDKFTDPNSNGKVDTSIGAISAAPWGSASILVISWMYIAMMGEKGLTEATKVAILNANYMASRLADYYPILFKGASGCVAHECIIDLRPLKNQAEVGVDDIAKRLMDFGFHAPTVSWPVGGTMMVEPTESEDLAELDRFCDAMITIHQEAQAIADGTIDPANNPLKNAPHTAEMVICQEWDRPYSREKAAYPASWSKEHKFWPTVGRIDNAYGDRNLVCSCEGMDAYKED

SEQ ID NO: 7252 - protein, 334 aa, Geobacillus stearothermophilus
AVKVGINGFGRIGRNVFRAALKNPDIEVVAVNDLTNADGLAHLLKYDSVHGRLDAEVVVNDGDVSVNGKEIIVKAERNPENLAWGEIGVDIVVESTGRFTKREDAAKHLEAGAKKVIISAPAKVENITVVMGVNQDKYDPKAHHVISNASCTTNCLAPFAKVLHQEFGIVRGMMTTVHSYTNNQRILDLPHKDLRGARAAAESIIPTTTGAAKAVALVLPELKGKLNGMAMRVPTPNVSVVDLVAELEKEVTVEEVNAALKAAAEGELKGILAYSEEPLVSRNYNGSTVSSTIDALSTMVIDGKMVKVVSWYDNETGYSHRVVDLAAYINAKGL

SEQ ID NO: 7253 - protein, 405 aa, Zea mays
MHDLVVSSNFLEQEGVSSSACSALFYFTPSALELEPSPSPQTQASDLSHLRRRFVRVEGRREEMAATEGVLLGMGNPLLDISAVVDDAFLTKYDIKLNNAILAEEKHLPMYDELASKSNVEYIAGGATQNSIRVAQWMLQTPGATSYMGCIGKDKFGEEMKKNAQAAGVTAHYYEDETAPTGTCAVCVVGGERSLIANLSAANCYKSEHLKRPENWALVEKAKYIYIAGFFLTVSPDSIQLVAEHAAANNKVFLMNLSAPFICEFFRDAQEKVLPYADYIFGNETEAKIFAKVRGWETENIEEIALKISQLPLASGKQKRIAVITQGADPVVVAEDGKVKTFPVILLPKEKLVDTNGAGDAFVGGFLSQLVLGKGIEDCVRAGCYAANVIIQRPGCTYPEKPDFN

SEQ ID NO: 7254 - protein, 288 aa, Streptococcus mutans UA159
MEYITLNTGVKMPMEGFGVFQVTDPEICKESVLNAIKTGYRLFDTAAVYGNEKALGEAIHEAIEQGLVTRNELFITSKLWVQDMNYEAAKKGIERSLEKLGLDYLDLYLLHQAMRDYFGAYRALEEAYQAGKLRAIGVSNFYPNILTNFCETVSVIPAVNQIELHPFFTQEEALETARYYGVVPEAWAPLGGGRYDAFNNAILQEVASAHQKTVGQIMLRWNVQRGVVVIPKSTHKERIEENFAIWDFSLTDDEMTKIASLDMGYGDTRTKHFDPNFVRSVLNVKIHD

SEQ ID NO: 7255 - protein, 156 aa, Glycine max
  misc_feature (52)..(52): Xaa can be any naturally occurring amino acid
  misc_feature (142)..(142): Xaa can be any naturally occurring amino acid
  unsure (1)..(156): unsure at all Xaa locations
ANLKISCSAVTAVHRANASMIAPFTGLKSMAGCPLAKTANHITSIASNGGRXHCMHVWPPLVKMKFETISYLPDHDDAQLAKEIEYLLTIGWIPYFEFELEHGIAYREHDMSPRYYQRRYWYTLTCQFLTALIATTVSYELXQARTEYSIGYIRII

SEQ ID NO: 7256 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 7257 - protein, 131 aa, Cicer arietinum
ERGVGLEHEDENIADLYLAVQDGIISGTTDYDILFGQLLENESGLKGSPPTAKSFVENLPLVELTEEELKGKDIVCAVCKDEVMLEEKVRKLPCSHCYHGDCILPWLSIRNTCPVCRFELPTDDADYERSK

SEQ ID NO: 7258 - protein, 178 aa, Glycine max
FGTRIATTDLAQHTLEQIEPIRNLFAALFLASPATLTPPHFLWNHVDILVASVILVIVIKTIIIASVVKGFGYNNKTSIHVGMSMAQIGEFAFVLLSRASNLHLVEGKLYLLLLGTTALSLVTTPLLFKLIPAVVHLGVLLRWFSTDSSMEIGYKLDNLRSDSGKQRIILMDQESHDS

SEQ ID NO: 7259 - protein, 259 aa, Erwinia carotovora subsp. atroseptica SCRI1043
MSSRKLTLGVSLKMYFGYQQTLDWCQKIHEIAEQHPLASLPSARLFVLPAFPTLAPVVQRFAQSPVHVGAQDLHWTDNGAFTGEVSGTMLHEMGCRYVEIGHAERRRYFGETDEHFALKTAAAWRNGLTPVLCVGEEQRGSTQQAIDTCQAQLAAALNLAQKQQLTGDLVLAYEPQWAIGSTEPAPTAYISEVCQALKQHLPTQAGVREGRIIYGGSAGPGLLSQLGDAVDGLFLGRFAHDPAAFNAIMDEAFTLSSQA

SEQ ID NO: 7260 - protein, 255 aa, Streptomyces avermitilis MA-4680
MIEHATHQKIALITGANKGIGRAAAEQLAALGMTVLIGARDPRRGEEAAAALRAAGGNAHQVTLDVTDQATARAAAQQIDERFGHLDVLINNAGITGSGQVSPEDAHDQVPSSVNLDMVRAVFETNVFGVIAVTNAMLPLLRRSPAPRIVNVSSAAGSLTIASDPDGPLTGLPTSAAYTPSKTALNALTVQYANELRKNGFLVNAADPGYVDTEINNHSGYLTVAQGAAALVRLATLGADGPTGGFFSEDGPVPW

SEQ ID NO: 7261 - protein, 212 aa, Triticum aestivum
  misc_feature (184)..(184): Xaa can be any naturally occurring amino acid
  unsure (1)..(212): unsure at all Xaa locations
ASGMSIRSSSAHKISRVPDFRSQVRPTISICEKSYAVQKSEEIFNVAQELMPGGVNSTVCTFISVVGQPIVYDSVKVSNMWDVDGNEHIDYVASWGPAIMGHADDVVNHALIEPVKKGSSSGAPCALENVLHLMVISTVPSIEMVRFVNSASESSMGPLRLVSAFIGRENIIKFEGCSHGHADXFLVKAGSGVAALGLSVFPGVRKGIHRVP

SEQ ID NO: 7262 - protein, 252 aa, Prunus emarginata
AHYKYEADVGNAIAEAIRSGLVKREELFITSKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVNQFETHPYFQRASLVKFCWKHGVCPMAHTPLGGATANVKSFGSISPLDDPVLQGLAKKYKKSVAQIALRWNIDRNTPVIPKSSKIQRLKENLEVLTFKLEKEDIELINSIDKKSRTTL

SEQ ID NO: 7263 - protein, 453 aa, Brucella melitensis
MNLFTSQFRNSQLLASKAHALIPGGCHTYAKGDDQYPVLAPGFIQRGSGAHVFDVDGHEYIEYGMGNRAVGLGHAYPPVVRAVREALQDGCNFTRPSAIELDCAESFLELIEGAEMVKFCKDGSDATSGALRLARAYTGRDMVACCADHPFFSTDDWFIGTTKMSAGIPASVSALTATFRYNDIASVEALFEDYPGCIAAIIMEPARADEPQDNFLHEAMRIAQENGALFILDEMITGFRWHMRGAQKLYGIVPDLSCFGKALGNGFAISALAGKAEYMRLGGLHHTDFPRVFLLSTTHGAETHAMAAAIATMAIYRDEPVIERLYEQGAKLAAGINEAIAGHRLQDHVRLSGRPCCLTYSTLDGNGMPSQAFRTLFLQETIRRGVLMPSLVVSYTHSDADIARTIDAVHGALGIYVRALNDGVESCLVGRPSQVVYRRFNEDPASSCPPPRL

SEQ ID NO: 7264 - protein, 743 aa, Hordeum vulgare subsp. vulgare
  misc_feature (275)..(275): Xaa can be any naturally occurring amino acid
  unsure (1)..(743): unsure at all Xaa locations
MSSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKDTHFEEYIIGPDDELADDGLAPDQEKLKLYGAEEGVSWIARPVRXGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLPSIGIAMRLMDMSGRRFLLLSTIPVLIVALAILVLVNVLDVGTMVHAALSTISVIVYFCFFVMGFGPIPNILCAEIFPTSVRGICIAICALTFWIGDIIVTYTLPVMLNAIGLAGVFGIYAVVCMIAFVFVYMKVPETKGMPLEVITEFFSVGAKQGKEATD

SEQ ID NO: 7265 - protein, 486 aa, Nocardioides sp. JS614
MADFTLAQIPDLPLDLCVGGKEVPASDGGRFDVLDPATGAVLTSVANGTVEDALACVDAADAAAAAWAATAPRERSEILRKAFELMRERADELAHLISLENGKALADARGEVAYAAEFFRWYAEEAVRAAGSVMTAPSGANRIVVLQQPVGICVLVTPWNFPAAMATRKIGPALAAGCTVVLKPASDTPLTALLMAKILADAGVPAGVVNVLPARRSGAVVSAMLHDPRVRKLSFTGSTEVGRVLLREAADQVVNCSMELGGNAPFIVLDDADLDAAVDGAMIAKMRNAGEACTAANRFYVHADVADEFSRRLAERMAALRVGPGTADDTEVGPLVNDESAAKVDELVRGAVSAGARVVVGGRRPEREGYYYEPTVLLDVPVDAEILGEEIFGPVAPVVTFTDEDDAIRMANETEYGLVSYVYTRDLARGMRVSERLDSGMVGLNRGLVSDPAAPFGGTKQSGVGREGGHEGMLDYLESKYVAVSW

SEQ ID NO: 7266 - protein, 445 aa, Oryza sativa
MSLLALPLLAFLSIFLTPTTAVSSSTLQLARSHSVTPNAGAPLSAWAASVAAQSAADTARIVSMLTSGAGPLTTRAKPKPKNRANPPVPIAPGRQILSIPNYIARAGLGTPAQTLLVAIDPSNDAAWVPCSACAGCAASSPSFSPTQSSTYRTVPCGSPQCAQVPSPSCPAGVGSSCGFNLTYAASTFQAVLGQDSLALENNVVVSYTFGCLRVVSGNSVPPQGLIGFGRGPLSFLSQTKDTYGSVFSYCLPNYRSSNFSGTLKLGPIGQPKRIKTTPLLYNPHRPSLYYVNMIGIRVGSKVVQVPQSALAFNPVTGSGTIIDAGTMFTRLAAPVYAAVRDAFRGRVRTPVAPPLGGFDTCYNVTVSVPTVTFMFAGAVAVTLPEENVMIHSSSGGVACLAMAAGPSDGVNAALNVLASMQQQNQRVLFDVANGRVGFSRELCTA

SEQ ID NO: 7267 - protein, 753 aa, Hordeum vulgare subsp. vulgare
MRRGGWRSWRGCRGWRARRSSRLRRGWRRRRAGAGAGARKDLAALQAEWKSLEEEELVMAAAAKLVFLASNVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKTHIEEYIIGPDDELADDGLAPDQEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGRKEGGAQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLGYISDRIGARAITAASFMYCSIPALFFYRRAILVLVNVLDVGTMVHAALSTISVIVYFCFFVMGPIPEGSTSSVKIDTDRANAASLAKALLTFWIGDIIVTYTLPVMLNAIGLAGVFGIYAVVCMIAFVFVYMKVPETKGMPLEVITEFFSVGAKQGKEATDEVAEKIAESRPSEECRSPVDYVQDHVMEV

SEQ ID NO: 7268 - protein, 437 aa, Xanthobacter autotrophicus Py2
MKLAEWLSATGTKRSAFAKQVGMSPASVTALCNDDRAWISRETAEKIAQATGHEVTPNDFLGLPAPSIRGLAVTDNTQARVQSAIEAFARGEIVVVTDDDDRENEGDLILAASLATPEKMAFVIRNTSGIVCTPLPPSEAKRLRLDPMVSNNDAPMGTAFTISIDVKHGTTTGISAEERTNTVRALANPNMGAADFVRPGHVFPLIAKEGGVLMRSGHTEAAVDLCRLAGVPPVGVIAELVNDDGTVQRGPQVTAFSEKHGLTRISVADLISYRQAREKLVTRAAEFPVPTCVGELQGFSYVTPFDPVNHLALVKGRIGDGEKVLVRLHRADPIADAFGGGKTIQRALERIEAEGRGVLVYLRDGTAGVPAVAMGHGGEKSSSEIERDRHWREVGLGAQILRDLGIVSIRLLASKSRTYVGLAGFGIEIVDTEPLDA

SEQ ID NO: 7269 - protein, 252 aa, Prunus emarginata
AHYKSEADVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 7270 - protein, 260 aa, Arabidopsis thaliana
MPQGDYIDLHRKRNGYRLDHFERKRKKEAREVHKHSTMAQKSLGIKGKMIAKKNYAEKALMKKTLKMHEESSSRRKADENVQEGAVPAYLLDREDTTRAKVLSNTIKQKRKEKAGKWEVPLPKVRPVAEDEMFRVIRSGKRKTKQWKRMVTKATFVGPAFTRKPPKYERFIRPSGLRFTKAHVTHPELKCTFCLEIIGIKKNPNGPMYTSLGVMTRGTIIEVNVSELGLVTPAGKVVWGKYAQVTNNPENDGCINAVLLV

SEQ ID NO: 7271 - protein, 787 aa, Clostridium perfringens str. 13
MNKEQIKRGIERYLKVKYGKSSIKDAKDFEIFNALSLTLLEGIVDDWNHTEELYEKEKNAYYFSAEYLMGRALGNNLISLGLYNEVKEVLDELGFDLNRIEEIEEDAGLGNGGLGRLAACFMDSGASLEVPLKGYGIRYNNGLFSQYFEDGFQKEDVDSWLKYGEPWSIRKEDEFVTVDFEDMTVKAIPYDTPIIGYASKNINTLRLWKCEPVKEFDFKLFNEQKYDEALELKNRAEDISRVLYPNDSNREGKLLRLRQQYFLVSASLKDIIRKHKEVFGNVTEDFAKMHAVQLNDTHPVLAIPELIRLLVDEEGFTFEEAYNIASKTFAYTNHTILAEALEKWDVDLIEELFPRILEIIEKIDAEFIVSLEEKGYSEEEIEEFRIVNDGKVRMANLAIHVGFAVNGVAKLHTDILKNIELKNWYELYPEKFQNKTNGITPRRWLRLCNQELSALITELLGSEDWVKNLDLLKGLEKYKDDEEVLKRFMDIKHTKKEQLAAYIKEHEGVQLDPDSIFDIQIKRLHEYKRQLLNTLYILDLYYRLKENPDMDIPKVTFIYGAKAFPGYKRAKSIVKLTNEVAKLINNDESIKGKIKVVFVENYRVSYAEKLFPAADVSKQISTAGKEASGTGNMKFMLNGAPTFGTNDGANVEIVRESGVDNNFIFGLEVEEIEELKGKYNPVDYYESDADLKRVLDSLVDGTFDDGGNGDFEDLYNSLLEEGDQYFLLADFKAFKDTEDKVFEAYKDKLGWAKKAFENTCNAGMFSSDRTIQEYCDDIWGIKKCTNK

SEQ ID NO: 7272 - protein, 170 aa, Zea mays
  misc_feature (152)..(152): Xaa can be any naturally occurring amino acid
  unsure (1)..(170): unsure at all Xaa locations
MDGGGGVGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFSKELRLDTKVFYFDIGENKRGRYLKVSEASVNRNRSTIIVPAGSSGEEGXEAFRNVLLEINDEASRLY

SEQ ID NO: 7273 - protein, 834 aa, Myxococcus xanthus DK 1622
MAPPASASQPPRPAQPATTDDSGLGHDAASLRRSFLDHVRYSRGKNYESSTPHDRFMALSLAVRDRLADRWVKTSRTYYEKDVKRAYYLSAEYLLGRALGNNLLNLGMYEAASESMQEVGVDLTNLLEMEPDAGLGNGGLGRLAACFMESLATLAYPGMGYGIRYEFGIFTQDIVDGYQVERADEWLKFGNPWEIVRPEKAVPVRFFGRVEHHQGPDGRPVARWVGGKTVVGVPYDTPIAGYHNNTVNTLRLWQARASEEFDLLLFNAGDYERSVVEKNDSEVISKVLYPNDAFQAGKELRLKQQYFFVACSIADIVRRYLKNHTDFKDFSRKAAIQLNDTHPAIGVAELMRVLVDEKRLLWDEAWTITQETFGYTNHTLLAEAMEKWPATLFERLLPRHLEIIYEINSRFLRQVQIRYPYDQEKMQRMSLVEEGAEKKIRMAHLAVVGSHSVNGVAALHTDLLRRDVLTDFASMNPERFNNKTNGVTPRRWLAWCNPRLSKLITSRIGEGWVTDLDKLTKLEAHAEDPEFRKAFREVKRANKEDLARHIRDLRWVQLNPDAIFDVQIKRLHEYKRQLLNALHIVALWMKARRDPSTIIHPRAFIFGAKAAPGYHLAKLTIRLINGIAEVVNSDAGTTGLQVVFAPNYRVSLAERIIPAADVSEQISTAGMEASGTGNMKLMLNGALTLGTLDGANVEIRDAVGDENFFLFGLTADEVIARKREGYRPRDEYNQHQELREALDLISTGFFSPEDKHLFKPLVDSLLEEDRYLMLADFPSYMAKQEDVAHAYKDADGWARKCIINVARGGIFSSDRTIKQYAEEIWRIQQTPVDP

SEQ ID NO: 7274 - protein, 337 aa, Oryza sativa (japonica cultivar-group)
MFTFTPATKMSPCCRCLTRRLLFPAMSSTTCLISRGAFLLLAAAVAVALPCAAALQELQLQDAVLIDDVVQEAAQAWYHGRHRRTGVTYPVSLPGSLSGVAADVARFRAGSLRRYGVRRFGEFAVPPGLAVRGQASHLLAVRANLGNLSSVFDEYAASGGYRIASPVLGLTFYGLARRGGTARLEVLVTAAAIRVNFSMAVPALQPGARAALHGPWRLNGSCHRDRRAGREQHLPRVGPGTLRARPGRSRRRRRRGGGGRRGEQVEAGALRGGARRGRHGAPGAGPGGGAEHPAAQVGGGGDGAAGVRGGGVARVHGRARPRAVGGRVAHHAGRPRE

SEQ ID NO: 7275 - protein, 366 aa, Burkholderia xenovorans LB400
MTAMMKAAVFIEPGRIELADKPVPDVGANDALVRITTTTICGTDVHILKGEYPVAKGLTVGHEPVGVIEKLGSAVLGYQEGQRVVAGAICPNFNSYAAQDGVPSQDGSYLIARGLCGCHGYKATAGWRFGNMIDGTQAEYVLVPDAQANLAPVPDGLTDEQVLMCPDIMSTGFKGAENANIRIGDTVAVFAQGPIGLCATAGARLLGASTIIAVDGNDHRLEIARKMGADVTLNFKNCDVVDEILKLTGGRGVDSSIEALGTQSTFESALRILKPGGTLSSLGVYSSDLTIPLGAFAAGLGDHKINTALCPGGKERMRRLLNVVESGRVDLGALVTHHYKLDDIVAAYDLFANQRDGVLKVAIKPH

SEQ ID NO: 7276 - protein, 241 aa, Triticum aestivum
  misc_feature (33)..(33): Xaa can be any naturally occurring amino acid
  misc_feature (50)..(50): Xaa can be any naturally occurring amino acid
  misc_feature (73)..(73): Xaa can be any naturally occurring amino acid
  misc_feature (131)..(131): Xaa can be any naturally occurring amino acid
  misc_feature (159)..(159): Xaa can be any naturally occurring amino acid
  unsure (1)..(241): unsure at all Xaa locations
MSAFVGKYAEELIKTAKYIATPGKGILAADESXTGTIGKRLASINVENVXEANRQALREMLFTAPGALEYLSXGVILFEETLYQTAADGTPFVDILKAGNVVPGIKVDKGTVDIAGTVGETTTQGLDSLGXARCAKYYEGGARFAKWRAVLKIGPRGEXPPELPVKQNAEGAGPGTRSSGKKKGPGPPSGKPRNPSPERARTKLQGPGARRPPEPVLRPPILQGPPHRTHKGASFQRGPLP

SEQ ID NO: 7277 - protein, 289 aa, Fusobacterium nucleatum subsp. nucleatum ATCC 25586
MSMTQINWYPGHMKKTKDLIEENLKLIDVVLEIVDARIPLSSKNPNIASLSKNKKRIIVLNKSDLVSKQELDKWKKYFKEQDFADEVVEMSAETGYNVKKLYEAIEFVSKERKEKLLKKGLKKVSTRIIVLGIPNVGKSRLINRIVGKNSAAVGNKPGFTRGKQWVRIKEGIELLDTPGILWPKFESKTVGINLAITGAIRDEILPLEDVACSLLRKMLEQGRWESLKERYKLLEEDRDDKVLENILSKIALRMAMLNKGGELNVLQAAYTLLRDYRVAKLGKFGLDEI

SEQ ID NO: 7278 - protein, 93 aa, Zea mays
MASKAFGNGLKELRFLFCQTSEHSAATRNFLTRSYPAMKKANPSIPIMIREASGTEPTVFARFDFGKERKLPLKGLDDKAIEQQVSELVQKGA

SEQ ID NO: 7279 - protein, 567 aa, Nocardioides sp. JS614
MGDGRRGTDASGDVRGDVAPRGGDALRRRCRRHRPGPGAVRPTPPARARAGRDRRRGLRRRALRHPAGPGRVRAGGIVSTTYDVSAADLAPTLGARLADGFRVALVSGVEDDDGFRVVYVLVRPGDAPVELVLRVPRHEPTIPSLAYLDYATGRFERELRDLYGITPSGHPLPRRLVRHGHWPRGWYPMRRDAGPPPPFDADIGAFPFLEVEGDGVYEIPVGPVHAGMIEPGHFRFSVIGETILRLKARLWFVHRGVEKLFEGRRPEDAVELAERISGDTAVGHTTAFATAVEDALGIEVPERDRLGRALLLELERMHNHAADLGALANDVGYGIVNTHALRIRESLLRLNKATTGHRLLRGGVGIGGTRIDALPDPAALEAVAAEVAELAEITLGNSTVRDRFTGTAVLAAESARDLGTLGYVARASGIDRDARRDHPFVDLGDRFHVVVETGGDVLARYRVRVREIAVSAAVAGDLVRRLSSGTGVDSHTSAPGGGHGLGLVEGWRGTIAHRVEIDPSGRLSRVKIVDPSFFNWPALPIALADTIVPDFPLANKSFNQSYAGNDL

SEQ ID NO: 7280 - protein, 478 aa, Burkholderia mallei ATCC 23344
MHRATKIVATIGPASSSPEVLSQMMHAGLDVVRLNFSHGSADDHRERAEMVREAARRVGREIAIMADLQGPKIRVGKFEAGKTTLTPGQPFILDATCELGNDERVGLDYKDLPRDLKPGDVLLLNDGLIVLKVDRVLGDEIHTTVKVGGDLSNNKGINRQGGGLSAPALTAKDMEDIRTAMSLGADLVAVSFPKNATDMEMARQLANIAGAPYGIKPKMIAKIERAEAIPALQEILDASDGIMVARGDLAVEVGNAAVPALQKRMIRMARESNKLVITATQMMESMIHAPVPTRAEVSDVANAVLDGTDAVMLSAETATGKYPAVTIEAMAAVCVEAEKSEHVELDKDFLDRTFTRIDQSIAMGALFTAYHLGAKAIVALTESGATALWMSRHYTHVPIFALTPRVGSERAMALFRNVTPLHVDFNSDRDSALQQALELIVRRGYVAHGDMVVLTVGEPMGQAGGTNTLKIVRVGEHY

SEQ ID NO: 7281 - protein, 826 aa, Nanoarchaeum equitans Kin4-M
MLCMSEEGIKLKVAEAYQEDVYLGKVRVDYDVLDRLGLSPGDIIEIEGTRKTYAIADVLYPEDQGLGIIRMDGVIRKNAGVGVGEYVIVRKPPKPQIAKKVVLAPVKKEEQIIIDEYYLRNLLNGFVVTKGDYVVVRFDNLGFFIDFLPLKEMWFKVVSTNPPKGPVIIGRDTIIEIKPGGVQEIPEVTYEDIGGMKDVIQKVRELVELPLRHPEIFERLGIEPPKGVLLYGPPGTGKTLLAKAVANESGAYFISINGPEIVSKYVGESEAKLREIFEEAQKNAPAIIFIDEIDAIAPKRDEAVGEVERRLVAQLLTLMDGLKSRGKVIVIAATNRPNALDPALRRPGRFDREIEVPVPNEEARYEILKVHTRRVPLGKRVVEKVDGKTVEKYVPLTKEEKEQLLRKLAAMTHGFVGADLAALVKEAAMNAIRRVIPDILALKEEKLPKELLEKLMVTEEDFKEALKMVTPSAMREFYIEIPKVKWEDIGGLEEVKQELRETVEWPLKYRIEELGIKPPKGVLLYGPPGTGKTLLAKAAASESGANFIAVKGPEILNKWVGESERAIREIFRKAKQAAPAIIFIDEIDAIAPARGSDVNRVTDRIVNQLLTEMDGITDRGDVIVIGATNRPDILDPALLRPGRFDRVIYVPPPDKKARVEIFKIHARKIPKDPELKERFEEFKKNLEKLKEIKPDIDIEKYKNLSLEEALELYKKSKEFRDIVDTVLFYIPLAEKTEGYTGADIEAVVREAVMLALRELFEQAKKEKWDDKKINEMIGKLKVKMKHFEKALEKVGPSVDKETIRAYEEFAKNFRKRINKKNNPYLG

SEQ ID NO: 7282 - protein, 817 aa, Treponema denticola ATCC 35405
MVISKEEVKDSVIRRLKRNFSKSLDKATRREIYDAVASTVMELIQSNWIKTMNAQEKTGVRRMYYLSAEFLMGRALINNINNMGIRKTIEEIADEISEPLSIIEDEEPDAGLGNGGLGRLAACFLDSLATMNYPGHGYGIRYKYGMFEQRIENGYQVEYPDRWLFARDPWEVRRSDLSVKVYFGGIPSSRTSESGKLYYDLNGAEEIIATPYDMPIVGYGTDTVNTLRLWEASSDDGFDLPLFNSMEYNRAFQKQIDAESISCILYPNDSGPPGMNLRLKQQYFFTSASLQDIIRSFIHREGTDFTKLPDYVVIQLNDTHPVVGIPELMRILMDDYHLEWDAAWDITKKVFAYTNHTILAEALEKWPIDVFQKLLPRIYQIVEEINRRFLAKLYEKYPGDWKKHNNMAIMADGKIHMARLAIAGAFSVNGVAALHTEILKHKELADFYDLYPHKFNNKTNGVTQRRWLLTANPLLSEFITKYIGGGWITNLNELKKLEAFIDNEEFLEGFIEVKHKNKIRLAEYLEKNQGIFINPDSIYDVQIKRLHEYKRQLLNILHIMTLYNRIINDPSYDPVPQTFIFGAKAAAAYRRAKEIIKLINTVADRINNDHRVAGKLRVVFVENYRVSAAEKIFPAADISEQISTAGKEASGTGNMKFMINGAVTIGTLDGANIEIIEEAGAENEFIFGLKAEEILKMDKENTYNPREYLAANPELEKAVNQLIDGTYTLPGEQTFRGLYDSLIYGVEGQRPDTYYILADFKSYQKAHEQIISEYYHRHAWAKKCILNIARSGKFSSDRTIQNYVDEIWRLERINVNQ

SEQ ID NO: 7283 - protein, 488 aa, Pseudomonas aeruginosa
MNAVAPLIPCIVSGGSGTRLWPVSRESMPKPFMRLADDQSLLQKTFLRIAGLPDVARLLTVTNRDLLFRTLDDYRAVNRSGLAQDLLLEPVGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFPQAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKRSLSLQMHHHRSEHWIVVSGMALVENGEREFLLNTNESTFIPAGHSHRLSNPGIIDLVMIEVQSGEYLGEDDIVRFNDIYGRAPASDEKKA

SEQ ID NO: 7284 - protein, 348 aa, Crocosphaera watsonii WH 8501
MTSVQIPVIPEQSLDRECTTLSRHVLQQLQSFSPEAQDLSAIMNRIALAGKLISRRLSQAGLMADVLGFTGETNVQGESVKKMDVYANDVFISVFKQSGLVCRLASEEMDKPYYIPENCPIGRYTLLYDPIDGSSNVDINLNVGSIFAIRQQSGEDLDGEATDLLQDGRGQLAAGYIVYGPSTMLVYTIGHGVHSFILDPSLGEFILAQENIQIPDHGPVYSTNEGNFWQWDEAIRDYTRYVHRHEGYTARYSGALVGDIHRILMQGGVFLYPGTVKKPEGKLRLLYETAPLAFLMEQAGGKASDGVKPILDVVPDKLHARSPLVIGSKEDVSLVESFIQDHQRRGNA

SEQ ID NO: 7285 - protein, 143 aa, Acinetobacter sp. ADP1
MAVERTLSIIKPDAVGKNHIGEIIARFEKAGLKPVAMKYKHLSQAEAEGFYAEHKERGFFADLVAFMTSGPVVVSALEGENAVLAHREILGATNPKEAAPGTIRADFATSIDENAAHGSDSVASAEREIAYFFAADEIFPRTR

SEQ ID NO: 7286 - protein, 519 aa, Yarrowia lipolytica CLIB122
MLTNLTIVLITLLVTYTVLTRTALRIQRARKAKQMGATLPPRVNNGILGWYGLWLVIQNARSMKLPHTLGKRFANGPTWLTPVAGNEPINTIDPENVKAILATQFKDFCLGIRHRALSPSIGDGIFTLDGEGWTHSRALLRPQFSRQQISRVHSLERLMQILFKLIRKENGEYFDLQNLFFMFTLDSATEFLYGASVDTLADLLGEPVEGDHGGVGEEVRKAYQQSINNAQDISAIRTRLQGLYWIAGNIYQRNLYQKSNKGVKDFSQFFVDKALNTSKEKLKEMEDSDNYVFLYELVKSTRNPVVIRDQLINILVAGRDTTASLLSFTFYTLGRRPDVLKKLRAAILEDFGTSPDEITFESLKRCDYLRYVLNEVLRLYPSVPINARSATRDTTLPRGGGPDGKQPVFVYKGQMVAYCVYWMHRDKKYWGEDALEFNPDRWDPKVQPQNKGWEYLPFNGGPRICLGQQFALTEAGYVVTRMLQEFDTVHCKNQKEEEHPPYALDLTMRHGEGVWVSMK

SEQ ID NO: 7287 - protein, 560 aa, Arabidopsis thaliana
  misc_feature (347)..(347): Xaa can be any naturally occurring amino acid
  unsure (1)..(560): unsure at all Xaa locations
MNFNSSYNLTFNDVFFSSSSSSDPLVSRRLFLLRDVQILELLIAIFVFVAIHALRQKKYQGLPVWPFLGMLPSLAFGLRGNIYEWLSDVLCLQNGTFQFRGPWFSSLNSTITCDPRNVEHLLKNRFSVFPKGSYFRDNLRDLLGDGIFNADDETWQRQRKTASIEFHSAKFRQLTTQSLFELVHKRLLPVLETSVKSSSPIDLQDVLLRLTFDNVCMIAFGVDPGCLGPDQPVIPFAKAFEDATEAAVVRFVMPTCVWKFMRYLDIGTEKKLKESIKGVDDFADEVIRTRKKELSLEGETTKRSDLLTVFMGLRDEKGESFSDKFLRDICVNFILAGRDTSSVALSXWFFWLLEKNPEVEEKIMVEMCKILRQRDDHGNAEKSDYEPVFGPEEIKKMDYLQAALSEALRLYPSVPVDHKEVQEDDVFPDGTMLKKGDKVIYAIYAMGRMEAIWGKDCLEFRPERWLRDGRFMSESAYKFTAFNGGPRLCLGKDFAYYQMKSTAAAIVYRYKVKVVNGHKVEPKLALTMYMKHGLMVNLINRSVSEIDQYYAKSFDEGYIN

SEQ ID NO: 7288 - protein, 531 aa, Yarrowia lipolytica CLIB122
MLQLFGVLVLALTTALLAQLAYNKYEYNRKVKQFGCGELTVAKNGFLGWKGIRAVLHVLKTKKGPAALKERIDAYGRTYVFHIGPAPVISTMEPENIKAMLATQFKDFSLGTRYRSLAPTLGDGIFTLDGHGWTHSRALLRPQFAREQVSRLDSLEAHFQILKMCVDKEMREKGNDPRGFDIQNLFFLFTLDSATEFLFGSSVDSLVDFLDDPSVRTGDHGGVDEAARKGFNNSFNHAQELCALRSRLHTLYWIVGSVVKKEPFERYNKEIKTFVDFFAAKALKARKEKDMSLMDNDQYIFMYELVKETTNPVTLRDQMLNILLAGRDTTASMLSWIYFRLARDPKLYAKLRSAILEDFGTTPEAITFESLKQCDYLRYVLNEALRLYPVVPINGRTATRDTTLPRGGGPDQSQPIFIPKGQTVSYSVYWTHRDPRFWGEDAEEFIPERWDPRNGNIGRGWEYLPFNGGPRICLGQQFALTEVGYVLSRLVQTYETLETCDHKPLPPLYNHALTMCHEEGVWVKMYKGEKA

SEQ ID NO: 7289 - protein, 301 aa, Pediococcus pentosaceus ATCC 25745
MEELMNNQMDIGNPTRTRAILEKYGLSAKKSLGQNFLTDPNVLLNIVDAAEVSPEDDVIEVGPGIGSLTEQIAKRAHHVLAFEIDRNLMNVLDETLSPYDNITVVNQDVLKANVNEEVENHLDGKRRLKLVANLPYYITTPILKTFMASTLPIDKMVVMMQKEVAERLTAQPGDKEYGSLSVVVQYRMNTQIEFDVSSKVFVPRPKVDSAIVSLTPRAGWEVMPEDDKDFFKTVHGCFMHRRKNIWNNMQGLYGKEPEIKAKIQNVLDDLGIDPQVRPERLTVLDFIKLHNRIQIEGLKRK

SEQ ID NO: 7290 - protein, 523 aa, Yarrowia lipolytica CLIB122
MSNALNLSLALGVFLLAYYGFSVIQYHIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 7291 - protein, 163 aa, Oryza sativa
  misc_feature (25)..(25): Xaa can be any naturally occurring amino acid
  misc_feature (44)..(44): Xaa can be any naturally occurring amino acid
  misc_feature (64)..(64): Xaa can be any naturally occurring amino acid
  unsure (1)..(163): unsure at all Xaa locations
NEFEDRGPTKDRPSVMVKPDGVPPXGLGGTITQRFEDKGLKLVXAMKMVWPTEAHLKERSADLXSRPFFPGLVKYMSSGPVVPMVWEGLNAVKTGRVMLGETNPKDSAPGTIRGDFCVQVGRNIIHGSDSVESATKEIKLWFGDEKKKEVIAWASWAEKWIYE

SEQ ID NO: 7292 - protein, 550 aa, Silicibacter sp. TM1040
MNAQTTINPASVLSNDPDWWRGAVIYQIYPRSYQDSNGDGIGDLQGITSRLDHIASLGVDAIWISPFFTSPMKDYGYDVSDYCDVDPMFGNLADFDALVARAHDLGLRVMIDLVLSHSSDQHPWFAESRQSRDNPKADWYVWADPQEDGTPPNNWLSIFGGSAWHWDARREQYYLHNFLVSQPDLNFHCPDVQNALLDVTRFWLERGVDGFRLDTINFYIHDKELRSNPALPKDQRNANIAPSVNPYNHQEHLYSKNQPENLDFLARFRALLDEYPAKTAVGEVGDAQRGLELLGQYTAGNTGVHMCYAFEFLAKDPLTAARVAEVFERTDEVAADGWACWAFSNHDVQRHVSRWGLSDAALRLHATLIMCLRGSVCIYQGEELGLPEADISFEDLQDPYGIEFWPEFKGRDGCRTPMVWRSDNTHGGFSEARPWLPVSLEHAALSVAEQEANPDALLHHYRRVIALRRAHAALSHGTHDKVVASGSVVHFLRSAESEDIFCAFNLGEAAAEVSLPAGTWEQLGADIGTAEINGDLVKLGPWQACLVRRV

SEQ ID NO: 7293 - protein, 261 aa, Methanothermobacter thermautotrophicus str. Delta H
MVEDYDPCEVEVDTEYIGHEIKCFDEVDSTNNVAKRMAEDGATEGTVVIAKTQSRGRGRRGKPWISPQGGIWMSIILRPEVHPSRAPLLTLVAGVAVARTLRDECGLDVGIKWPNDILIGDKKVCGILTEAHARFNTLEYVVVGVGIDTNVDISHFPDDLREGATSIKNELKRDIKSSELIARFLRNFEETYNSFKDGKMDEILTEWRKLSKTIGRRVEIRKQLGEIVHGDAVGINSEGALILELDDGTLRKVISGECIHR

SEQ ID NO: 7294 - protein, 222 aa, Triticum aestivum
DITVVVGEQSFHLHKFPLLSKSGLLERLIREKIEKGEDSCAIDLSDIPGGAKAFELAAKFCYGVKFELTSSNVVHLRCASEYLEMAEEIAEGNLIAQTENFLTQTVLKSWKDSIKALHTCDDVIDLAEKLQVVKKCGDSVATKSSTDPDVFGWPVAQYGGPTQSPGGSFLWNGISTGARPRNCSSNWWYDDVSCLSLPLYKKVISAMEYRGVNQDIIVGSLN

SEQ ID NO: 7295 - protein, 283 aa, Streptomyces avermitilis MA-4680
MMAVPEQTPPSSLEVGDYYDRLTDLMNRALGGNTHLGYWPQPGDGSSPGKAADRLTDLLIGKLRGITGRRVLDVGCGSGKPAVRLALSAPVDVVGVTVSEVQVGLATALAKQSHVADRVVFTRADAMELPFPDGSFDAAWALECLLHMPSPAQVIREIARVLRPGGRLAVTDVALRAFGRTGMKRGECTSQLLAVPALVHIDEYAGMIADAGLELHELTDIGDQVVGPSFAALRDHVNEHLDEYAAAFGIGVAEMRKVVAQCTTLPWTPDIGYVVLTARRPGE

SEQ ID NO: 7296 - protein, 156 aa, Triticum aestivum
  misc_feature (70)..(70): Xaa can be any naturally occurring amino acid
  misc_feature (82)..(82): Xaa can be any naturally occurring amino acid
  misc_feature (91)..(91): Xaa can be any naturally occurring amino acid
  misc_feature (110)..(110): Xaa can be any naturally occurring amino acid
  misc_feature (141)..(141): Xaa can be any naturally occurring amino acid
  unsure (1)..(156): unsure at all Xaa locations
MAPTVMASSATSVAPFQGLKSTAGLPVSRRSNGASLGSVSNGGRIRCMQVWPIEGIKKFETLSYLPPLKXTEALLKQVDYLXIRSKWVPLXLSSSKVGFIFREHNASPGXYYDGRYWTMWKLPMFGCTDAHQVINEVEEVXKEYPDAYVASSHNLK

SEQ ID NO: 7297 - protein, 368 aa, delta proteobacterium MLMS-1
MVIVPVILAGGRGTRLWPLSRELHPKQLLPLADGESMLQQTLRRLSALPPMTPPVVVCLEEHRFMVAEQVRALELEAVILVEPVGRETAPAVALAALEAQRRTAEQEVLLLVLPVDHQLERLEQFRLALERALPAAAAGHLVTFGIVARRPETAYGYIEPGEALNGDAEIFAVRRFVEKPDAAGAAACLVAGCLWNSGILVVSAATYLAELARFEPEMAARVAQCYQRRRRERDFVYLDHDSLAASPSRSLDHAVLERTARAAVVPLACGWDDIGSWPSLAGSGAEQRDSAGNTARGPVVIKNSRNCQAWSSGRLLTLLGVDDLVVVETADAVLVAHRDQVQDIRQLVAELKEQGWPEVISHPAGHRN

SEQ ID NO: 7298 - protein, 271 aa, Azoarcus sp. EbN1
MARFDGFECMERKLVVGNWKMNGDLVSNQALFEQLVDRSPSSIDTALCVPFPYLAQGQRALSGSAIMLGAQNLSEFDAGAYTGEVSGRMLSDFDCRFVIVGHSERRTVFREDDQLVARKARAALAAGLVPIVCVGESLAERDAGQAEDVLLRQLEALVQLLDGASLARLVIAYEPVWAIGTGRAASPEQVQEILSFVRRWLSGHVGNSRAIRILYGGSVKADSAAALFSLPDSDGGLIGGASLVAQQFLEICEAAAKAAQDGNMGDFKGSR

SEQ ID NO: 7299 - protein, 632 aa, Archaeoglobus fulgidus DSM 4304
MTKYLDEIREKVKEYLPPKVRVKSIEFEGPQLVIYVENPQELAEVDIVKKLAKDLRKRIIIRADPKSLKPPEKARQIIMQIVPEDARISNIFFDEENGEVIIEAEKPGVVIGKQGSTFREIMRAVGWSPRVVRTPPIKSKIIDNIRNYLLSVREERSEILKRIGERIHRTSLIDEKWVRVTFLGGSREVGRSCYLLQTPESRILIDCGVNVSNLSSTPYLYVPEVQPLDALDAVVITHAHLDHCGLVPLLYKFGYRGPIYLTPPTRDLMVLLQLDFLEVAGREGTNPPYSSNLIREALKHTITLDYGVVTDISPDVRLTFYNAGHILGSAIAHFHIGEGHYNIAFTGDFKFEKTRLFDRAATNFPRLEALVMEATYGGPNDFQPSRKEAEERLIEVINRTLDRGGKVLIPTFAVGRSQEVMIVLEEAMREKRLRETYVYLDGMIYEATAIHTAYPEYLNAQLRDLIFYHGINPFISENFVRVDSSSKREEVISDPSPSIIIATSGMLNGGPVMEYFRHLAEDERNTIVFVGYQAEGTLGRKIQKGWKEVPFPVDGRREVVEVKMEVETVDGFSGHSDRKQLMNYIRYLNSKPEKVATVHGDESKCIDLASSIYKTYRIETRAPMNLETIRFV

SEQ ID NO: 7300 - protein, 955 aa, Porphyromonas gingivalis W83
MNTNKFENRHIGIAERDLSVMLRTIGVESMDQLIRETIPGDILLPEPLDLPEAMTERELLEHFMELGSKNKIFTSYIGQGWYDTVTPAPIQRNVLENPAWYTSYTPYQAEVSQGRLEALFNFQTVITELTGLPLTNCSLLDEATAGAEAARMFFDTRSRTQIKAGANVLFVDKKVFRSTIEVIRTRIIPQGMQIVVDDYKTFSFTPEVFAAIVQFPDAEGSVNDYKSFIEAAHAANAKVAVVADLLSMTILTPPGEWGADIVFGSAQRFGIPMYYGGPSAGYLATSMDYKRNIPGRIIGMSKDAYGRPAYRLALQTREQHIKREKATSNICTAQALLATMSSFYAVYHGADGLRHIAGRVHAYAGFISEKLSGLGYKLTNKDFFDTLRVELPAGVTADKVRELAEECSVNFFYPADGSILISLDETTLPSDLGVLLYIFSSVLGKEETISEDIAIDKRYFDGAFARTSNFLDYDVFNNYHTETELMRYIKRLERKDISLAHSMIPLGSCTMKLNAASELFNLSMPQFNAIHPYAPKDQTEGYNEMLESLERYLAVITGFDATSLQPNSGAAGEYTGLLTIRGYLNSIGQGHRHLVILPASAHGTNPASAIQCGYDTVTVACDERGNVDMEDFMAKTEQHKDEIAAMMITYPSTHGIFETNIIDLCHRIHECGGQVYMDGANMNAQVGLTSPGFIGADVCHLNLHKTFAIPHGGGGPGVGPICVAKHLTPFLPSHPLREDYNGLEVSAAPYGSAGVTTITYAYIRLMGYEGLRRATKIAILNSNYMANRLKDTFGIVYTGATGRIGHELILECRKIKESGIDENDIAKRLMDFGYHAPTLSFPVHGTLMIEPTESESLAELDRFIDVMNCIWEEIQEVARGEQEATDNVLKNAPHPQYEVTANDWSHPYSREKAAYPLEYLRENKFWLNVARIDNGYGDRNLVPSLCSACEVFNNQ

SEQ ID NO: 7301 - protein, 135 aa, Triticum aestivum
MASPMVATPIRLSSLRYAPPSPAPRGRFVAARVRASAEAMATEKLGVRVERNPAESRLSELGVRQWPKWGCDKSKFPWTYSAKETCYLLQGKVKVYPDGEEGFVEIAAGDLVVFPKGMSCTWDVTEAVDKHYKFE

SEQ ID NO: 7302 - protein, 294 aa, Nocardioides sp. JS614
MANRLMDGASARCHDDAVNEVNQVSSFYSGPRGLVAAIGSALDAAGMERASLRPADLAPVDEFHIRGRAASLEILEALGLDADSHVLDLGSGLGGPARTLAELSGCTVTGVDLTSEFCEVATALSQWTGLSDRTRFQAGDATATGLPDAAVDAALTVHVGMNIPDKAALYAEAFRVLRPGGRFVVYDVLQGEGGEVRYPVPWADDPSTSFLATPQDMRGLLPEAGFELISEADSSDESLTWFQEMRARIERDGPPPVTFAAFLGDRFGQMAANQVANLAERRIRTVMYTCSRPT

SEQ ID NO: 7303 - protein, 533 aa, Mesorhizobium loti MAFF303099
MAPRVLVSDKLSPTAVQIFKDRGVEVDYLPDLGKDKEKLLEVIDQYDGLAIRSATKVTEKLINAATRLKVIGRAGIGVDNVDIPAASRKGIIVMNTPFGNSITTAEHAVAMIFALARQIPEANASTHAGKWEKNRFMGVEITGKTLGVIGCGNIGSIVATRGVGLKMHVVAFDPFLSDKRAEELGVEKVELDELFARADFITLHTPLTDKTRNIIDAGAIAKMKNGVRIINCARGGLIVEADLIAALKSGKVAGAGIDVFEVEPAEQNALFGMENVVATPHLGASTAEAQENVALQVAEQMSDYLIKGAVSNAINMPSITAEEAPRLKPFVKLAEVLGAFVGQVTEDPIMEVEILFDGSTATMNTRALISATLAGLIRPQVSDVNMVSAPIMVKERGIIVAEVKRDKSGVFDGYIKLTVKTEHRTRSIAGTCFSDGKPRFIQIKGINLDAEVGQHMLYTTNADAPGIIGLLGTVCGENGVNIANFQLGRNRPGGDAIALLYLDAPFPEKVLEQVRAHKSIDSAKRLQFDVGGI

SEQ ID NO: 7304 - protein, 265 aa, Aquifex aeolicus VF5
MHAIILTMRVGIVGFGNMGQAFALCFSKKLGKENIIVTDKVQEKRNLATEMGIAFASDVKFLADNSDVVLVAVKPKDSQEVLQKLKDYKGIILSIMAGVSIEKMEKILGKDKKIVRVMPNVNVAVGSGVMAITDNGNLSEEERSKVEELLLSCGTLYRIEERLFDAFTALAGSGPAFVFSFIDALALAGVHQGFSYEQALRIALDTVMGSAKLLKEFQVNPNELIAKVTSPGGTTIEGIKYLEEKGFKGTVMECINRTSQKAKKL

SEQ ID NO: 7305 - protein, 818 aa, Oryza sativa (japonica cultivar-group)
MEASSWLCYQARGFGSSRVWLWLLLALVLLNCSLVLSASPYLVGMGSFDITGPAADVNMMGYANTEQIASGIHFRLKSRAFIVAEPNGKRVVFVNIDACMASQIVTIKVLERLKARYGDLYNENNVAISGIHTHAGPGGYLQYVVYIVTSLGFVRQSFDVIVDGIEQSIVEAHNNLRPGKIFVNKGDLLDAGVNRSPSAYLNNPAEERSKYEYNVDKEMTLIKFVDDELGPVGSFNWFATHGTSMSRTNSLISGDNKGAAARFMEDWAEQMGLPKQSAHANSDDLRSLHKTSVLPRRVSTIIPEPNEITDDLIQLASSYEASGGRRLAGSSITRRIRSTQQNKPKFVSAFCQSNCGDVSPNVLGTFCIDTNLPCDFNHSTCNGKNELCYGRGPGYPDEFESTRVIGNRQFLKARDLFDSASEEIQGKIDYRHTYLDFSKLEVKVSTSAGGQQTVKTCPAAMGFAFAAGTTDGPGAFDFRQGDVKGNPFWKLVRNLLKTPGKDQVECHSPKPILLDTGEMKEPYDWAPAILPVQMIRIGQLVILCVPGEFTTMAGRRLRDAVKTVLTSGNSEFDKNIHVVLAGLTNSYSQYITTFEEYQIQRYEGASTLYGPHTLSAYIQEFQKLAMAMIANKEVPTNFQPPDMLDKQIGLLPGVVFDSTPLGVKFGDVNSDVPGNSTFNKGSTVNATFYSACPRNDLLTDGTFALVEKLDGNNNWVPVYDDDDWSLRFKWSRPARLSSRSFATLEWTVPEDAAAGVYRLRHFGASKPMFGSVRHFTGTSRAFALCVELHTAQVYRLDGLMKAFVTGYGPFTWGLFTDP

SEQ ID NO: 7306 - protein, 241 aa, Triticum aestivum
  misc_feature (156)..(156): Xaa can be any naturally occurring amino acid
  unsure (1)..(241): unsure at all Xaa locations
WFERMKESGISPSPFTYSILIDGLCKTNRTEKAMMLLEEMDEKGFPPCPAAYCSLIDALGKAKRYDLAHELFQELKENCGSSSARVYAVMIKHLGKAGRLDDAVDLFDEMNRLGCTPNVYAYNALMSGLARAGMLDEALTTMRRMQDHGCIPDINXSYNIILNALAKTGGPDRAMGMLSNMKQSAIKPDAVSYNTVLGALSHAGMFEEAAKLMKEMNALGFDYDLITYSPRVRPRVRPRVR

SEQ ID NO: 7307 - protein, 252 aa, Streptococcus mutans UA159
MSRKPIIAGNWKMNKTAAEAREFIDAVKNNIPSNNLVDTVIGSPALFLEGMKKGVKGTELQVAAQNCYWEDFGAFTGETSPAALAALGVDYVIIGHSERRDYFHETDQEINKKAHAIFKHKMTPILCCGESLETYEAGKTAEWIEGQITADLKGLSAEQVSSMVIAYEPIWAIGTGKSADANIADDICGVVRATVEKLYGKEVAQAVRIQYGGSVKPENVAEYMAKENVDGALVGGASLQADSFLALLDFVK

SEQ ID NO: 7308 - protein, 492 aa, Burkholderia xenovorans LB400
MNEATARKPHPLDKLKDPSLLRTQAYVDGRSQGGAQEFAVFDPATGAEIARVPNLAAAEARQAIDAANAALPAWRALTGKQRAAMLRRWYELIVAHAADLAAIMTAEQGKPLAEARAEALYGASFVEWFAEEAKRVSGDVLASPADDRKIVVIRQPIGVCVSITPWNFPLAMITRKVAPALAAGCTIVVKPAEQTPLSALALAELAHRAGLPAGVLNVLTGDAANAIEIGKVFCESEIVRHLSFTGSTPVGRLLMQQCAPTVKKVALELGGHAPFIVFDDADVDAAVQGAMVSKYRNAGQTCVCANRFYVHDAVYERFVRQFAEASRGVKVGNGFLEGVDQGPLIDDDAVAKVRQHVDDALAKGARQVMGGRIEGRFVEPVLLAEVTHDMLIAREETFGPVAAVFRFRDEAEVTRLANDTQFGLASYFYSRDIGRVWRVAEALEYGMVGINTGLISNEVAPFGGVKQSGLGREGSKYGIEEYLQIKYLCMGV

SEQ ID NO: 7309 - protein, 376 aa, Vibrio vulnificus YJ016
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHDQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 7310 - protein, 463 aa, Acinetobacter sp. ADP1
MLDSAAPLKRAMSTRHLVMLSLGGAIGTGLFLGSGEVITQTGPIGAVIAYMLGGLIAYMVMLCLGELAVHMPVSGSFGAYAKKYIGPGTGYMISWVYWLTWTATLGTEFTAAALLMQEWFPHTSMWIWTIIFALTIFGLNLSSTHIFAESEFWLSLVKVLTVISFIILGLLAIFGIIHFEGHASAPLFSNLTSHGWFPQGLMPIFATMLIVNFAFSGTELIGVAAGETKDPSINVPKAINAAIWRLLIFFVGTIVVISALLPYDQTGLGGHNVSNSPFVTVFQYIGIPYADHIIRFVIITALLSAANSGLYAASRMMWSLSNQRQLPSVFSKLTASGTPIIALVVTMFGAIPGLLSEQFAPETIFKNLLGVAAFTMVIVWMSICLSQFNFRRHWYKQGYHAKDLKFAAPLFPILPILGFLFCLITGLSMAKDPEMLPGFIGCLIFVACCYLSHYIFYREKSKL

SEQ ID NO: 7311 - protein, 434 aa, Streptococcus mutans UA159
MKEKVFRDPVHNYIPVEDELIYDLINSKEFQRLRRIKQLGSSSFTFHGAEHSRFSHCLGVYYLARRVTNIFDKKYSDIWNSNESLLTMTAALLHDIGHGAYSHTFERLFDTNHETITQQIILSPETEINTILRRVSPDFPDKVASVINHTYSNKQVEQLISSQIDVDRMDYLLRDSYFTGASYGEFDLTRVLRVIRPIENGIAFSRDGMHAVEDYIISRYQMYMQVYFHPASRAMEVLLQNLLKRAKYLYPKEKEFFTVTSPHLIPFFENRVTLEDYLSLDDGVMNTYFQTWMQSADKILSDLASRFINRKVFKSITFDEKDLSNLEKLRKIVKDLGFDPTYYTALHLNFDLPYDVYKPDVQNPRTQIEMLQEDGSIAELSTLSPLVHTLSGTTHGDRRFYFPKEMLIKDGLFVEAKEKFSHYIKNKHFYNLRE

SEQ ID NO: 7312 - protein, 142 aa, Brassica napus
  misc_feature (62)..(62): Xaa can be any naturally occurring amino acid
  unsure (1)..(142): unsure at all Xaa locations
EVVLTNYAGLYRYRLGDVVKIMSFYNKTPQLKFVCRRNLILSINIDKNTERDLQLSVESAAXRLSEEKIEVIDFSSHVDLSTEPGHYVIFWEISGETNEDVLQDCCNCLDKGFIDAGYMSSRKCKNIGALELRVLEKGTFKK

SEQ ID NO: 7313 - protein, 175 aa, Triticum aestivum
  misc_feature (166)..(166): Xaa can be any naturally occurring amino acid
  unsure (1)..(175): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKXPGCEESGKA

SEQ ID NO: 7314 - protein, 238 aa, Pyrobaculum aerophilum str. IM2
MTAGVIGAGKLGSQIALRLHGNSVRVIASVKTERSRQRLSALGLEVYTDNKIVVENSDVLFLAVKPANLAELNFYVDKPLISFVAGATLEYLKRLSARPYRAMTNVGLTAIAVAGPYDEEVNKLLSYIAPTFWVEERLIDPLTVLLGSGPAIVAELALALIRAGVNIGIPWDLSREIVLSLMASLPSLDDKFSMEKLAQYVATPGGTTIKALVELSPAGQLVGRAVEEAYLRISKLRQ

SEQ ID NO: 7315 - protein, 217 aa, Erwinia carotovora subsp. atroseptica SCRI1043
MNQTLLSEFGNPTERVERALDALRHGRGVLVLDDEDRENEGDMIFSAESMTVEQMALTIRHGSGIVCLCLTEERRQQLELPMMVEKNSSHYQTAFTVTIEAAEGVTTGVSAADRLTTIRAAIADNARPSDLNRPGHVFPLRAQPGGVLTRGGHTEATVDLMTLAGLKPSGVLCELTNDDGSMAHAPEVIAFAKQHDMLVLTIEDLVAYRIAAERKAS

SEQ ID NO: 7316 - protein, 145 aa, Zea mays
MTSPMVATPVQLRSTGRLSFCSFPSSASGTAPSRRRFGAVTVRASAETMATEKLGIKVERNPPESRLSELGVRQWPTWGCEKSKFPWTYSAKETCYLLQGKVKVYPDGHGEEFVEIAAGDLVVFPKGMSCTWDVAEAVDKHYNFE

SEQ ID NO: 7317 - protein, 383 aa, Zea mays
MAEDRSPKPIHCKAAVCRAAGEPLTIEEIVVDPPKAYEIRIRVVCTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDNELQLDALVTHELGLQDINKAFDLLLQGKSLRCILWMDKDK

SEQ ID NO: 7318 - protein, 309 aa, Prochlorococcus marinus subsp. marinus str. CCMP1375
MIAFLLPIVSLLVLSLIFLWLFNDRKYKSSESVSSAYDSWTNDRLLEKLWGEHIHLGYYENSYKTKDFRQAKIDFVHKLAHWSGLSTLPKGSRIIDIGCGIGGSSRILAKDYGFDVVGITISSEQVKRANQLTPKELKCHFEIMNALNLKFEDGSFDGVWSVEAGPHILNKQLFADEMLRVLRPGGVLAVADWNRRDYAKKEIGFLNSLVLKQLLNQWSHPDFATIYGFRNNLSDSIYSAGRVETDDWTKYTIPSWNDSIIEGIRRPNVFFDLGLGSFFKAIREVPTIVLMRWAFHTGLMQFGVFRSRG

SEQ ID NO: 7319 - protein, 359 aa, Dehalococcoides ethenogenes 195
MARTVIPFGPQHPVFPEPVQLKLECEDETVVGVTPVIGYVHRGVEKACEINTLRQNIFLVERICGICSIQHALCYCQGIEELAGIEVPQRAHYLRTAWAELSRLHSHSLWLGLLADALGFESLFMQIWRAREIILDILEMTAGHRVITSACVVGGVRRDIDTEMLKKTSDMLAEFRKMMDKTILPTLLNDPTLKKRTVGKGILSYDQAVTLGACGPTMRGSGVPSDARATGYAAFKELGFEPVVETAGDSYARTLVRTREIYQSIDLTLAALQQMPAGEIMVKAEAYPEGEIFTRVEQPRGELTYYIKANGTNHLDRCKIRTPTFANIPTLLVMLPGCELADVPVITLSIDPCISCTER

SEQ ID NO: 7320 - protein, 265 aa, Bordetella pertussis Tohama I
MSAHQARKRFGQHFLTDESVVESIVRAIGPARDDRVVEIGPGLSALTRPLLDRIDHLTAVEIDRDLAARLRRQYPAERLTVVEADALTVDFAQFGQGLRVVGNLPYNISSPLLFHLMGAAEQVRDQHFMLQREVIDRMVAEPGSGDYSRLSVMLQARYRMEKLFDVAPEAFDPPPRVVSAVVRMAPLPADRLRPASDAAFETVVARAFSQRRKMLRRVLDDWAALTPWDELGIAPTARAEEVGVAQFIGLADALLAAGAPGLARP

SEQ ID NO: 7321 - protein, 330 aa, Nostoc punctiforme PCC 73102
MKPKVVITHWVHPEIITNLSEYCEVVANPTRETLPREEILKLAQDAEALMVFMPDRIDEAFLKACPKLKIIAGALKGYDNFDVDACTRQGIWFTIVPSLLAVPTAELTIGLIIGLARQMLLGDRLIRQGTFAGWRPHLYGMGLANRTLGIVGMGSLGQALAQRLSSFEMNLIYTDAIPLPKEKAAAWCLSQVSLDTLLATSDFVVLMVPLQPETFHLINEKSLARMKPGSFLINPCRGSVVDEQAVSDALASGHLAGYAADVFELEDWARSDRPSKIPPSLLEKQDQTFFTPHLGSAVDDLRYDIAIEASQNILQVLQGHSPQGAINCPS

SEQ ID NO: 7322 - protein, 244 aa, Kryptoperidinium foliaceum
TFNVPAMYVNIQAVLSLYASGRTTGCVLDSGDGVTHTVPIYEGYALPHAVVRLDLAGRDLTDYLMKILTERGYSLTTTAEREIVRDIKESLCFVAVDFEEEMKKAAESSALEKSFELPDGNIIVIGNERFRCPEVLFQPNLTGLEMDGVADSTFQTIMKCDVDIRKDLYANIVMSGGTTMFPGIAERMSKEVTALAPASIKVKIVAPPERKYSVWIGGSILASLSTFQSMWISKEEYDESGPSI

SEQ ID NO: 7323 - protein, 436 aa, Oceanobacter sp. RED65
MAMTKDKSMTTSIIQQITKTALLGIFAVSLPLQAQIQTIDSIAAVVDDGIIMESELEQRIDTIKRQSQGMRLPPDDILQDQVLERLIIENLQLQMAERSGMRISDEQLNQTIINIAKQNGLTLREFKKALEKDGVSYAQAREQIRRERIISEVQRYRVGSKINISEQDVDNFLNSVRGKSATAEEYRLGHILIQVPSQASRAQLKRAQNKAEDIVKKLRNGADFQQMAISQSEGRNALKGGDLGWRKEAELPTLFADIVPDLKKGQVSNPIRSASGYHIIKISDKRGGDTQMVRQTKARHILIQENEIRNSQQAKKLINDLYKKLKNGADFDELAKEYSDDPGSKLSGGDLGWVNQGDMVPAFEQTMNATKKGQISEPFKSRFGWHVLQVTDYRQKDVGEEIQRNQARQLLYSRRFEEELPIWLRQIRADAYVEVK

SEQ ID NO: 7324 - protein, 471 aa, Rhodopirellula baltica SH 1
MSDCNSVSVPEVHLMDRGPSRLRIPPAMDVPVTARVQRLIDTSPMRRLASISQLGLVSMVYPGAMHSRLEHSLGVYTWALRVLNQVGQQSPVEQGSANQIAEDMRASESFIVASLVHDAGHWPFCHPIEDMGQSGMPRHEERVEAMLRSGPLADALAADWSCTADDVMAIVCPKKIDQYPAATSSEHIAFYASCLSGPIDVDKLDYLQRDSLHAGVPYGRNFDPMRIIASLVRHPDRPKLAIHEKGRTAAEMMVFGRYVMFSEVYWHHTVRAATAMLQRAVHELQQSAGGEKADITEWMDLSESAWVRQFVDAADRRGGPVKSLADGLFGPTRKLLKRAAQFNVESGEDMHQMLARRPYWWLASCSQPLATSIGDAIGKPVEPELVLIDAPPVKLEVDINIDIVLRSGEVATLGDVSPVASVLANRQFDNHVKRVRVFVPEWVRDRLADLPGDSMRRWLTDAVAETEKQWA

SEQ ID NO: 7325 - protein, 637 aa, Triticum aestivum
TTASHEKHRPFFQPRHDDPPPLAAAGKRRSIFRGPALACSLSPDRAWQMARAASLAALCLLLLAAAAAAGARMDPIYSGQLVPDWSREPKIKPQNFSLNREDNLQLLSRSRDVTRRKLGERTGVIKMETVQQDDEALVKLENAGFERSKAVDSAVLGKYSLWRRENENEKADANVRLMRDQMIMARIYSVLAKSRDKLDLYRELLARIKESQRSLGEATADSDLPKSASERAKAMGLVLSKARDQLYNCKEITHRLRSMLQSADEQVRSLKKQSTFLSQLAAKTIPNGIHCLSMRLTIDYYLLSPEKRKFPNSENLEDPDLYHYALFSDNVLAASVVVNSTIVNAKEPEKHVFHLVTDKLNFGAMNMWFLLNPPGDATIHVENVDDFKWLNSSYCPVLKQLESAAMKEYYFKADRQKTLSAGSSNLKYRNPKYLSMLNHLRFYLPQVYPKLNKILFLDDDIVVQKDLTGLWDVDLNGNVNGAVETCGESFHRFDKYLNFSNPNISQNFDPNACGWAYGMNIFDLEEWKKKDITGIYHKWQNMNENRLLWKLGTLPPGLMTFYKLTHPLDKSWHVPWVRVQPDGRARGDRHRRRHPLQREHEAVAGDCDDQVPALLDAVHQLRALLCPGLQDQSIGSS

SEQ ID NO: 7326 - protein, 491 aa, Coxiella burnetii RSA 493
MLIFEKSRKNRRTLAHAIADKMDANDIPANLLRHDAPRLPELSELEVVRHFTRLSTQNFSIDTHFYPLGSCTMKYNPRAANRLASLPGYLKRHPLSPAPQSQAFLQCLYELQTMLTEITGMEKISLTSMAGAQGEFAGVAMIKAYHESRGDYDRTEMIVPDAAHGTNPASAAMCGFTVKEISTTKDGDIDLEKLRQMAGAKTAGIMLTNPSTLGVFERQISEVAKIIHNAGGLLYYDGANLNAILGKYRPGDMGFDVMHLNLHKTFATPHGGGGPGAGPVAAGPRLSKFLPVPMVGKNKEGYDWLTEKECPKSIGRLSAFMGNSGVLLRAYIYLRLLGKEGLSRVAEFSTLNANYLMKRLEQLGFTLAFPNRRASHEFIITLKPLTRAYGVTALDIAKRLLDYGFHAPTIYFPLLVPECLLIEPTETESKQTLDHFIEAMEKILTEIKTTPDLLRNAPHQQLINRLDEVKAARELDLRWYPIAKETEIFIQ

SEQ ID NO: 7327 - protein, 446 aa, Coxiella burnetii RSA 493
MPFIPHTPDDIEKMLAVIGAESIDQLFDEIPSALANIQQVPPGLNEAGITRLMEKREPNKQLCFIGAGAYEHHIPAAVWEIATRGEFYTAYTPYQAEASQGSLQLIYEYQTMMAELMAMDVSNASLYDGASALAEAALMAVRIKRGKAQRILVPASVNPFYRKVLSSIVEQQKINVEIIPFDPTMGIVNSELLKAKNAEGAAAIIIPQPNFFGCLEAVDVLTDWAHANDLLVIASVNPTAMALLKPPGQWGQKGADIVCGEGQPLGVPLASGGPYFGFMCCKKDYVRQLPGRIVGRTVDKKGREGFTLTLQAREQHIRRSKATSNICTNQGLAVVAATIYLSLLGATGLREVALASHTQSRDLFQRLSAVKGVSPVFSSPIFHEFVVRLEKPVEEVLAAMAEQGIQAGFSLKNDYPKLGNGLLICVTDTKTDDDLMAYENALRSIQ

SEQ ID NO: 7328 - protein, 541 aa, Streptococcus agalactiae 2603V/R
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWAPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 7329 - protein, 477 aa, Medicago truncatula
MENIAAQLKRGISRQFSSGSLRKTLSRQFTRQASLDPRRNNLRFSFGRQSSLDPIRRSPGDDEDQAELTVPENLDSTMQLLFMACRGDVKGVEDLLNEGIDVNSIDLDGRTALHIAACEGHVDVAKLLLSRKANLDARDRWGSTAAADAKYYGNTEVYYMLKARGAKVPKTRKTPMTVANPREVPEYELNPLELQVRKSDGISTGTYQVAKWNGTKVAVKILDKDSYSDPDTINIFKHELTLLEKVRHPNVVQFVGAVTQNIPMMIVREYHAKGDLTGYIQKKGRLSPSKVLRFSLDIARGMNYLHECKPDPIIHCDLKPKNILLDNGGQLKVAGFGTVRFSLITPDKALLEQPEANIDPSSLYVAPEIYRGDVFDRSVDAYSFGLIVYEMIEGIPPFHPKPAEEALKLMCLEGKRPQFKIKTKSYPPDLKELIEECWDPEPEVRPTFSQVIARLDKIVANCSKQGWWKDAFKLPWK

SEQ ID NO: 7330 - protein, 479 aa, Yarrowia lipolytica CLIB122
MHLFVLIHGLWGSATHMAAVKEVLDTTYGVKAGGDMVAYATQSNHGTLTYDGVQVCARRCYLEIKEVIRRYADDEGVTFDRISILGYSLGGLIARYLCGIFLDEGFFDKVKPVLFSTIATPHLGSKFHRTDKRWFSWMNTLGSTYLGNTGRDLFLKDPTLADMSNPSSSAYKALEMFDNRVLLANCRNDRTVHFPTAFITAANPFANLRWLDLKFHEVKLQEPVVDSYGWSHSPRIIDFKRTTKRSLPFPVYHEHIRQKLIFWSFAATVGPLAITAVLIASMFFTNNSNHRVSKFLREGDKALMGEILESIKMETFDEEWLNEGDERKVGGKGEKTENTDKQSSPVSKTDASKVEEEADVMAAGITEAAVEDVILGDDLNNTDTPALSETKVVGLGEAMEAARHTGDRGLLANWANNAPFSEDVLSMIENMDKLGWEKYAVYITVIHSHAAIVARRGLTQQGQGAATLRLFSEIIRSKI

SEQ ID NO: 7331 - protein, 475 aa, Medicago sativa
MENIAAQLKRGISRQFSSGSLRKTLSCQFGTRLDPRRNNLRFSFGRQSSLDPIRRSPGDDQDQVELTVPENLDSTMQLLFMACRGDVKGVEDLLNEGIDVNSIDLDGRTALHIAACEGHVDVAKLLLSRKANLDARDRWGSTAAADAKYYGNTEVYYMLKARGAKVPKTRKTPMTVANPREVPEYELNPLELQVRKNDGISTGTYQVAKWNGTKVAVKILDKDSYSDPDTINIFKHELTLLEKVRHPNVVQFVGAVTQNIPMMIVREYHAKGDLTGYIQKKGRLSPSKVLRFSLDIARGMNYLHECKPDPIIHCDLKPKNILLDNGGQLKVAGFGTVRFSLITPDKALLEQPEANIDPSSLYVAPEIYRGDVFDRSVDAYSFGLIVYEMIEGIPPFHPKPAEEALKLMCLEGKRPQFKIKTKSYPPDLKELIEECWDPEPEVRPTFSQVIARLDKIVANCSKQGWWKDTFKLPWK

SEQ ID NO: 7332 - protein, 350 aa, Synechococcus sp. WH 5701
MTMLADGRSLDVVGIGNAIVDVLVSSNDAFLEEHGLSKGGMALVDAEQAQQLYAAAGPGLETSGGSAANTLAGLAMLGARAGFIGRVRDDQLGAIFSHDIRSVGARFETPAASSGAATARCLILVTPDAQRTMCTYLGASVDLEPADLDLDLVRQAGMLYLEGYLWDGEAAKRAFLAAAEVMRAAGGQVALSLSDAFCVERHRESFLELVDGHVDVLFANEAEITALYQCDGFEAAMEQVRGRCSIAVLTRGALGSVVLGGGEVHRIDPYVLGPLVDTTGAGDLYAAGFLYGLSRGEPLQRCGQLGSLCAGQVITQLGPRPRASLPQLVAEHLGTPPAPATAPVATGLPR

SEQ ID NO: 7333 - protein, 511 aa, Geobacillus stearothermophilus
MSKKPVALIILDGFALRDETYGNAVAQANKPNFDRYWNEYPHTTLKACGEAVGLPEGQMGNAEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 7334 - protein, 1424 aa, Ustilago maydis 521
MRPTLFRPFVLLALAHLIKPSYTLLDSGASANVGEASADSVPTRKDRVLSKDFPAGSLLVTDSEHSSNRPGCRRSTNFFEQVCSIPSGGSKDTDSRISSKLLAPLVAADLLICDLPEVEPLMQTESNLQASQKLPKAAYAISGTVVVQESDAKERLDAKNLAELTDSSCFTCENAVSENAITDPSGGQPDTSYPGPDDVGFWRQRDGLHEWHPALESVTKEIRTTRDTDSNVFQSSNQAGSRVPHHQDTSRLSEYDAWSAEQEQGAFLSFNEWKERHANDPSAQLRRAKTHNARADASDHTAQVRSPSTDPSVPIQQSEIDYQAAHMVADRDGHQGSTAQTTRRQRDDYTSTSPSATKTSAPLQTGATETTATDAPPRRSILDEAQESSAHKVGFSVAAHATSSQLLKLKHRWNFASLDCAAVVHRTNPEAKFASSILSEKKDRYMLSPCPQPGGKLKGGSQFVIVELCEKIKIDTIVLANYEFFSNMFKKFTVTAASQLTGMENDWTQLGVFRARNVRGQQVFRIPSAPRSEDFFRYVRIDFLEHFGSEFYCPVSLLRVYGITEIEAIKMEFERHSAELNLAPEVGEAEEDTVGDVQRPSLTSADAPNAEVPVARDLHPSIDSAGFTSQDEDIWRKHEQAFQRKHQNRTVIREAAELDIGVTFVAQIDNASSQNSSAPVQSGQAGTPATTHTVPGDDLGSNLADAAHCALENDPNFLARTNNICIRPRGQTKPFYHVSRFRTDARYTTSALDSGSAAKLDRPSVDSPTKSRPVPAATNGAESDLDRGRRATLQRPSGSLPSQQASQGSESVYRAIHRRLNALESNATLSHSYIEHSGQMLREVFARMERRQETRLSNMLRALNASNWQQIESLKRRQHVDLQRAIFEFDVHRQQADNERRALLREVQILAEEVLLEKRLSIAQLVMLLVVFIFVGMTRGSRPVPLLHAGFNKIGRGSKRSEAHIDATTVVSGSPSKATHRVEPSFDARRQKVSPLRESKLSQARKESRPECSNKSASGSHLARCNVEDAKLASRFSLYEAPGIPRIVASPKVGSQNYPRKSGKTLLATFAGRAAPRGEKMIGMHSHPRPTGHLMMILETLDALDRAAYRRRLSRTSTRRKLDVPRYALRSNTLNLPAAPHGTDLNLMPSSAMARRAARPNRSTATHKPELDFVHGRRHGTPGRDKWTGSLRLDDTAGMSSDWTERSENGEVSENAPNTSEDEDKAIRAARSDLINLEPVENVRAMMALDRTEGKQDIQEPSDRSSVIPASELASTGSAPPPDPADWPVGHSQLDKHIAATELPRIARADGHLSSSDSESEGGAWHRVLPRRTGNSNSLRRARQATIDDKTQRMDGEARVNTKTEASERRGSSRPSSAHGTGFRSQNPALSRLFRTGTPEHWGPESSQNQRSGTPDTIRDVRLA

SEQ ID NO: 7335 - protein, 540 aa, Vibrio sp. Ex25
MTGIFLQAFVYLIAAVIAVPLAKRLGLGSVLGYLIAGVVIGPIIGLVGEETTTIQHFAEFGVVMMLFLVGLELEPKMLWSMRNRLMGLGGLQVGGTIAAIMGIALYFEQPWTIALAIGLIFALSSTAIVLQTFSEKGLTKTEGGQNAFSVLLFQDIAVIPMLAFIPLLALPELVEQAQNAVQTAAQHHDDLNLVADLPGWAYGIVITASIAIVVVGGHFLSRPLLSYVASSGLREIFTATALMLVIGIAALMSLVGLSPALGTFLAGVVLANSEFRHELESNIEPFKGLLLGLFFITVGAGINFSVLFGDLWLIMALTISVMVLKALVLFILALIFRVKGSNRWLFTLSLAQAGEFGFVLLSFSVQNHVIPFELSQTLALVVAISMFLTPGLFILFDKLILPRFETQSNERESDTIEEKGTVIIAGIGRFGQIVNRLLVSNGVTTVVLDHQANQVDNMRQIGTRAYFGDATRPDMLHTAGIEHAAALVVAIDNQESSVELVKYVKHTYPKVTVIARAFDRGHGYLLRQAGADIIESETYH

SEQ ID NO: 7336 - protein, 316 aa, Nocardioides sp. JS614
MTTPWRTAATWSLADIPPQDGRTVLVTGTTVGGLGQFTALELARRGARVVLAGRTEQRLEETRAAITTEVPAAALETLVVDLADLASVRRAAVQAAGLGPIDVLVNNAGVMGTPYHRTGDGLELQLATNHFGPFLLTGLLLPQLVASGAGTVVTVSSQMHRVARSAPLDDPRSQHGRYQRWPTYARSKLANLLFTYELDRRARRAELPVRALAAHPGFAATHLAANGQYGRARGGRATILDAAIKAISPNRADEGAWPTLMAATADLPGGTYCGPSGFAEGGGVPHVTTSNKLSHDQAAQRRLWELSEQTTGIRYP

SEQ ID NO: 7337 - protein, 447 aa, Pseudomonas fluorescens PfO-1
MTTDGQRSLAQRLTGIDEIECVTPDLNGVPRGKVMTAEGFLEGRRLQLARGVLLQCIMGGYPAAKFYGSDDGDLALVADPAQIHPLPWSEEPRALAICDADELTGESSNLSTRGQLKKVIARYAALGLAPVVATELEFFVFAPNTDPTQPFQPPVGLDGRREDGHSAFSVSSNNGLRPFFSEVYKCMAALGLPRDTFMHEMGVSQFEINLLHGDPLLLADQTFLFKHLLKEVALKHGLTVVCMAKPLAHTPGSSMHIHQSIVEIGSGKNVFSDADGQPTAMFRHFIGGQQAGMADFTALFAPNVNSYQRLCHPFASPNNACWSHDNRAAGLRIPASSPVARRVENRLPGADANPYLAIAASLAAGLYGIEHELEPSEAIQGEFDVPDHLSLPCTLHAALERLKRSQLAKELFGTEFIEGYIASKTMELTSFFDEITPWERRVLAAQA

SEQ ID NO: 7338 - protein, 495 aa, Glycine max
MLSIKLLLWFLFLSWYHFAIPCEANQQGEYLYKFIQTKRAQKRSYGEASSMATNLGGDEHFSKVYVVKEQSGLMEGDKVKALPGQPSQGVDFDQYAGYVTVDAKAGRALFYYFVESPHNASNKPLVLWLNGGPGCSSFGYGAMQELGPFRVNSDGKTLYRNQYAWNNVANVIFLESPAGVGFSYSNTSSDYTKTGDKSTAMDSYTFLLNWLERFPQYKTRDLFITGESYAGHYVPQLADTILTYNKLTNHTVINLKGIAVGNGWIDDNMCGKGMYEYFWTHALNSDETHEGIQRHCDFENGNLTSECSKYQIRGDIEIGTIDIYGIYAPPCDSAATKAGASPATNSDSNYDPCSDDYTNSYLNLAEVQEALHAKASVWYPCRGVGWTDSPATILPTINRLISSGINTWIYSGDTDGRVPITSSRYSINSMKLPVETTWRPWYSSNEVGGYLVGYKGLTLITVRGAGHMVPSYQPQRALTMISFFLRGELPPEFTS

SEQ ID NO: 7339 - protein, 269 aa, Haemophilus somnus 129PT
MVNGKAIRVTSERDPANLKWNELGVDVAVEATGLFLDDATARKHITAGAKKVVLTGPSKDATPMFVNGVNFDAYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCSLTSVFDAAAGIALTDTFVKLVSWYDNETGYSNKVLDLVAHVHNYKG

SEQ ID NO: 7340 - protein, 226 aa, Methanocaldococcus jannaschii
MSNEDLKLKVAKEAVKLVKDGMVIGLGTGSTAALFIRELGNRIREEELTVFGIPTSFEAKMLAMQYEIPLVTLDEYDVDIAFDGADEVEETTLFLIKGGGGCHTQEKIVDYNANEFVVLVDESKLVKKLGEKFPIPVEVIPSAYRVVIRALSEMGGEAVIRLGDRKRGPVITDNGNMIIDVFMNIDDAIELEKEINNIPGVVENGIFTKVDKVLVGTKKGVKTLKK

SEQ ID NO: 7341 - protein, 490 aa, Escherichia coli O6
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 7342 - protein, 245 aa, Escherichia coli
MNKNIKYSQNFLTSEKVLNQIIKQLNLKETDTVYEIGTGKGHLTTKLAKISKQVTSIELDSHLFNLSSEKLKLNTRVTLIHQDILQFQFPNKQRYKIVGNIPYHLSTQIIKKVVFESHASDIYLIVEEGFYKRTLDIHRTLGLLLHTQVSIQQLLKLPAECFHPKPRVNSVLIKLTRHTTDVPDKYWKLYTYFVSKWVNREYRQLFTKNQFHQAMKHAKVNNLSTVTYEQVLSIFNSYLLFNGRK

SEQ ID NO: 7343 - protein, 521 aa, Debaryomyces hansenii CBS767
MSHFSDNDENDCCNHPKERRRSFLDLGGANSLNKFASSYTRAQSYLGLSLVETSVVQGTEDDLSPCTSLDDVVTESAIDDSPRGNERALDQINAFSFERNEESSLLSRRTSKADSERLITGDSTAPQTIFNCINTLMGIGMLSLPFGFRLSGWVLGTLMLLFSSIVTNISAKMLGKILRKYPHLMSYGDIAHLYGGRGINIVVTLVFSFDLLGAMISLIILFSDSFHILFPSLQRVLLKGIIVAVLFVLSFLPLSILSLCSLLGIICTSLLIVVIIICGLLTSTSPGSLVTPAVTNLWPSEYKYLFLSLGLFMAPWGGHPVFPELYRDMRHRSKFSKCCNIAFGITFNLDYLIAAIGFLMFGINCQDSLTKNLMTNKNYPDWVRPLICLFMGLLPVSKLPLITRPIITVYESFFKLNQTNYAVIKNGIRQEVYGIKRVLSRVVFCVLLLLVSLIFNSFGKVISFLGSAICFTICMTLPLIFYLKFYDDEITVMERLLIKFGILIGVVFSLIGTYGSIVIDI

SEQ ID NO: 7344 - protein, 460 aa, Acinetobacter sp. ADP1
MSQHSTLQRGLNTRHIRFLALGSAIGTGLFYGSATAIKMAGPSVLLAYMVAGIAIYIVMRALGEMAVHNPVSGSFSHYASQYIGLLAGFTTGWTYVFEMIIVALADVTAFGIYMGFWYPDVPRWIWILSLIMFLGAINLIHVKVFGELEFWLSMVKVTAIVAMILGGLGLMFYGFHTDHASFTPGIQNLWIHDGFMPNGIAGLVACLSVVVFAFGGIEIIGITAGESQDPKTTLPKAINAVPVRILLFYVLTIFVLMSIFPWNQIGSQGSPFVQIFENLGIGSAATVLNIVVITAAISAINSDVFGAGRMLYGMSNRGQAPQIFQKLSKNGVPWMTIVVMAGVLLVGVVLNYLIPENVFIIIASIATFATVWVWLMILVSQVAMRRKLSKAEIKALDFPVVGWPYAPAFAIVFMLFILAMMGYFPDSRPAIYVGAIWLILLWIAYMVWVKPNTIKTDMEL

SEQ ID NO: 7345 - protein, 235 aa, Dehalococcoides ethenogenes 195
MVVLGYDSTVSVTMEDMLHHLKAVVRGSQKAMVIADMPFMTYHLSPEQALLNAGRFMQEGGAQAVKLEGGVNVADKVKRIVDCGIPVMGHIGLTPQSVNQLSGFKVQGKTLTAALALLEDARALEKAGAFAIVLETMPAELAAMITAAVSIPTIGIGAGENCDGQVQVVSDMLGMFTDFVPKHTKKYADLNGIISKAVSGYVTEVAKGEFPTLKESFTLDKKVLEELKKCVSSEQ

SEQ ID NO: 7346 - protein, 488 aa, Oceanicola granulosus HTCC2516
MAAAANVAVALPSGQLYIDGAWVAGEGEFEVTNPADGSRVGAVAHATSAHALRALDAAEAAQAAWGRLAPRARADLMHRAYRLMLDQEDAFARIMTLESGKPLSESRAEFKLSADFLLWFAEQTAHVHGSYAESSHGGFRVMVHHQPIGPCLLITPWNFPLLMIVRKAGAALAAGCTAVVKTAQETPFTGALFTQVLHDAGFPSGVVNLLHTRTSSEISAPLLKDRRIRKVSFTGSTGVGALLMEQGARNIVNCSMELGGDGPFVVLDDADIDLAVAQAVICKFRNAGQACVAANRIIIDKKVEAEFTEKFIAKVKALTVGNGLDAVDVGPMISAKQRDGLAATLTKLTEAGGRTLAGGNPIAGPGYFFEPTVVRFEGPSEVMCSNELFAPIATIFPVDGAAEAIALANDTQFGLASYVFTRDISRAIGFAERLAFGMVGINRGIMADAAAPFGGTKASGIGREAGQDGIYEFMEPKYMALTVADELS

SEQ ID NO: 7347 - protein, 384 aa, Vibrio vulnificus YJ016
MSISVLALKLTGNIAMPISTPQEIIEDIRLGKMVILMDDEDRENEGDLIMAAEHITPEAINFMAKYGRGLICLTMTKERCQRLGLPPMVQDNNAQYTTNFTVSIEAAEGVTTGISAADRARTVQAAVAKEAKAADLVQPGHIFPLAAQDGGVLTRAGHTEAGCDLARLAGFEPASVIVEILNDDGTMARRPDLEVFAEQHGLKLGTIADLIEYRNNTETTIERVAECKLPTEFGEFDLVTYRDTIDNQIHFALRKGTVGDQTPLVRVHLQDTFTDLLRSDRNAERSWTLDKAMKRIGQEGGVLVILGNEESPELLIHRVKMFEAQDKEEAPKLAKKQGTSRRVGVGSQILADLGVHDMRLLSSSNKKYHALGGFGLNVIEYVCE

SEQ ID NO: 7348 - protein, 262 aa, Xanthomonas axonopodis pv. citri str. 306
MNSSFSAPAKKSLGQHFLADRYYIDRIVQAVDPRAGQHLVEIGPGQGAITFPLLRKHGALTVIEFDRDLIAPLTEAAAPIGALRIIHRDVLSVDFTALADGTPIRLVGNLPYNISSPILFHALDHAAAVADMHFMLQKEVVDRMAAGPGSKVYGRLSVMLQAYCEVTALFVVPPGAFRPPPKVDSAVVRLVPRDPATVLINDRRRFADVVRAGFGQRRKTLRNALSAICEPAHFDAAQVRPDARAEQLEVADFIRLANVELA

SEQ ID NO: 7349 - protein, 340 aa, Erwinia carotovora subsp. atroseptica SCRI1043
MKSIVIQQPNSLVIEERSIPQPAAGEVRVKVKLAGICGSDSHIYRGHNPFAKYPRVIGHEFFGVIEAVGDGVDAARLGERVSVDPVVSCGHCYPCSIGKPNVCTSLVVLGVHRDGGFSEYAAVSAKNAHVIPDEIPDEFAVMVEPFTISANVTAQVKPTEQDIALIYGAGPMGLTSVQVLKGVFKVKEVIVVDRIPERLEMALRSGADRVINNASLSLKDELETLNIKPTLIIDAACHPSILQEAITIASPAARIAIMGFSSEPCQISQQGITSKEISIFSSRLNANKFPIVIEWLKEKRIDPAKLITHRFDYQQVVQAIEVFEKDQKRCCKVLLTFNEA

SEQ ID NO: 7350 - protein, 362 aa, Ashbya gossypii ATCC 10895
MDIDNDVPMKDAMEDQLDQAIDEDSGVGSVSYFNASSGRTVSGIADTKSSKPLELTASSISQLDQWIEHLAKCQVLSEEDVGKLCKMAVDVLQFEENVQPVSVPVTICGDVHGQFHDLIELFKIGGPCPDTNYLFMGDYVDRGYYSVETVSYLVAMKVRYPNRITILRGNHESRQITQVYGFYDECLRKYGSANVWKMFTDLFDYFPITALVDNKIFCLHGGLSPMIETVDQVRELNRIQEVPHEGPMCDLLWSDPDDRGGWGISPRGAGFTFGQDISQQFNHTNDLSLIARAHQLVMDGYAWSHQQSVVTIFSAPNYCYRCGNQAAIMEVDENHNRQFLQYDPSVRPGEPTVSRKTPDYFL

SEQ ID NO: 7351 - protein, 181 aa, Brassica napus
MAYSMLSSAAVVTSPAQATMVAPFTGLKSSSAFPVTRKANNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 7352 - protein, 264 aa, Deinococcus radiodurans R1
MQLAIVGVGKLGLSLLTGVIARGVIAPQDIGIIEANAARAQDIAAQTGVQVITPPQLAQVGRIVVSVQPRVFPEVAPWLAQENAGYISTMAGVSAGTIGRRLGTRRVVRVMPNLAATIGRSQTAITGPREAHEAGDIAFAEQLFGAVGQVYELPEHLFNAFTGMSASGPAYVAVVAEALADGGVRMGLPRPLANELAARLLASTGELLLERAHPGLLKDEVASPGGTTIAGLEELEAAGVRGGVMRAVVAATRRGTELGKDQED

SEQ ID NO: 7353 - protein, 605 aa, Xanthomonas campestris pv. vesicatoria str. 85-10
MHSGGLELALVLMLAAIVAVPVFKRFGLGAVLAYLVAGVVLGPDGVGVVQDAERISGAAEIGVVMLLFVIGLELSPARLKVMRHSVFGAGATQVLVTAVILGGLLMAAQLGWKSALIVGVALALSSTAVGLQLLAERKALSSDYGRLAFAILLFQDLIAIPLLAAIPLLGGSKNATLQWQDVAKAMVALALVIVCGRFVLRHLFNVVARTRMPEVFTASALLVVLGTAWIMQEAGLSASLGAFIAGVLLADSEFRHELESQIEPFEGLLLGLFFISVGMGIDLHRVAAEPWLIAAGVAMLLVVKFSLLVGIGSVAKLPLRSSLMLGSVLWLGGEFAFVVFNEADRVGLLEPANHDRLVAIVGVSMALTPLLLLGMQRILNGPLRVRAPKTDRPYDTIDAQTPKVLVAGMGRFGQVVARLLTARHVPFVALEHNPDTVEDLRRFGSQLYYGDPTRPELLRAAGAERIKVFVIAVDDPDTNIKTVRLICRLYPQATVLARARNRQHAWKLMDLGAEPFREVFASSLELSERVLTSLGLGEALAHDHVKRFRQHDEDLLRRQHLVYDDEAKVIQTSRDARADLMNLFEADVKADVDGDEETVAATRDA

SEQ ID NO: 7354 - protein, 484 aa, Rubrobacter xylanophilus DSM 9941
MSGAAEHRMYVAGRWTGSASGARMEASSPATGERLGTVPEGTREDVRRAVAAAGKAATLWAGRSAFERAAAMERVAGIIEERREELSRTLVLDQGKTLAEARDEVEELALYFRMAAADAPRLEGSAPPSVDAGKRVLVYRVPRGVVGVISPWNWPYTMPAELIAPALACGNAVVWVPAPSTSVCAVALAGCLADAGLPAGVFNMVTGPGPVVGDEVAANPGTHAVGFIGSVETGRRVAARAAGKALLLEMGGNGPVVILDDADLDAAVEASISSAFMCAGQSCTAGELFMVHERVREAFLERLLAKVERGVRLGDPFSPETTMGPLNNEPTAQKVDRHVRDALERGARLLAGGSRAEGFPTRLYYEPTVLDGVTPQMQIFREETFGPVIPVAGIRDESEALSAVNASPYGLLSAVFTRDLERGLRFAEAVRTGWVNVNASSNHWESHLPFGGRSGSASGVGRVGGRYPMEAFTEPKTVILDLGR

SEQ ID NO: 7355 - protein, 261 aa, Vibrio sp. Ex25
MTINDLIKWKQEGRKFATSTAYDASFAQLFESQEMPVLLVGDSLGMVLQGHNDTLPVTVDDIAYHTRCVRAGSPNCLLMADMPFMSYTTPEQACENAATLMRAGANMVKIEGGDWLVDTVKMLTERSVPVCAHLGLTPQAVNIFGGYKVQGRDQEKADRMVKDALALQEAGAQIVLLECVPAELAERITQVLDVPVIGIGAGNVTDGQILVMHDMFGISANYMPKFSKNFLAETGDMRKAVAKYIEDVANGVFPDDAHTIA

SEQ ID NO: 7356 - protein, 433 aa, Prochlorococcus marinus subsp. marinus str. CCMP1375
MTNAFNTSNSQAVFHAAQELMPGGVSSPVRAFKSVNGDPIVFDRVKGAYAWDLDGNRFIDYVGSWGPAICGHSHPEVIASLQEALEKGTSFGAPCELENKLAEMVIEAVPSVEMVRFVNSGTEACMAVLRLMRAFTGRDKLIKFEGCYHGHADMFLVKAGSGVATLGLPDSPGVPRSTTSNTLTAPYNDLEAVKNLFAENPDAIAGVILEPIVGNAGFIQPEPGFLEGLRELTKENGSLLVFDEVMTGFRISYGGAQGRFGVTPDLTTMGKVIGGGLPVGAYGGRKDIMSMVAPAGPMYQAGTLSGNPLAMTAGIKTLEILQQEGTYERLASITNRLINGICESAKQAGIPITGSSISGMFGFYLCEGPVRNFEEAKQTNSDYFGKLHRAMLAKGVYLAPSAFEAGFTSLAHSEEDIDSTLKAFNECFNELSQ

SEQ ID NO: 7357 - protein, 492 aa, Porphyromonas gingivalis W83
MRCILLGSGTSTGVPEVGCHCRVCRSEDRHDKRTRTSLLIITDAGKRILIDCSPDFRQQALFAGIDSLDAVLLTHEHFDHVGGLDDLRTICWHRELAVYAEQNVLDSIRDRLHYVFRKNPYPGTPLLKLCEVKPDMPFQVADLTVEPLRIMHGRLPILGYKIGEMAFLTDMKDIAAEEIECLKSCRLLFINGLRYRKEHPSHQTIEQAIDTIGQIGNPESVLIHLSHHAPLHQEHLEILPPHIHSGYDGLEAIIDEKGIRIKDFEPHVSRSEYHYQDCGRIGYESALTLQRKLFHDAVADKLENRKPQNTLLFCEHEPVLTLGKHGHEENLLLSESELKSRDIRLFHIERGGDITYHGPGQITGYPIFDLEQYGIGLRSYIEMLEQCIIDLIAIFGLKGERSAGASGVWLDPDIPGRTRKICAIGVKSSRHITMHGFALNVNTDLDYFKLINPCGFSDRGVTSISRELGREQDFILVKQQLEAVFRRNFGAL

SEQ ID NO: 7358 - protein, 239 aa, Kluyveromyces lactis NRRL Y-1140
MVSGDVGSASFLNKQMKMRGLQKLRFYCQICQKQCRDENGFKSHSKSPSHLQKLSKVTHKDIEEYTVQFEKDFLRLLRLMHGEKKVEANKFYNEFIQDKDHVHMNATRFTSLTRFIQHLSQGGKVRIHGIDELTSDTDPGRFMISYIDSSSPNMIRKKQIESLKQAERSDQEIKLRLLEKQIEKANAEEVKSGQKEEEEEEEEIKANIRDGPINLTVSTSKVTKKKPKKKLKNVFKPTK

SEQ ID NO: 7359 - protein, 473 aa, Methylobacillus sp. 12S
MKIVPVILSGGSGTRLWPLSRQALPKQLLPLTSGHSMLQETLLRLSGVESIESPIVVCGNDHRFLVAEQLLEIGSKPKAIVLEPVGRNTAPAIAVAASRLLQENAEDVLMLVLPADHVIQNRAAFSAAIAVAAQAAKSGRLVTFGIKPTVPETGYGYINGGAALASCPGSFELSRFVEKPNLETAKQYLASGDYYWNSGMFLFSPKQYMEELTQFAPEIASKASEALEQSYTDLDFVRLHEASFKECPSQSVDYAVMEHTRNAAVVPVDIGWSDVGSWTALADVLDKDDAGNVTVGDVYLNGVKNSMVRSEGRMVAALGVENLIIVETSDAVLVAHKDAAQDVKKIVDYLKEQGRKEHEYHSRVYRPWGWYEGIDAAERFQVKRIMVKPGEKLSLQMHHHRAEHWVVVSGTAIVTKNGEAEMLCENQSTYIPIGATHRLENPGKLPLHLIEVQSGGYLGEDDIVRFEDTYGRS

SEQ ID NO: 7360 - protein, 1430 aa, Cryptococcus neoformans var. neoformans B-3501A
MVPPARAHTHNTTNTKQAQLSSAYHELANELGTDNISVVGNYTLGRVIGQGTYGSVHLATHRLTGTRAAVKKVPKSFTPHLTRELHHHRRLHHPHIVHLHEIIATESHIWLVTELCSGGELFDYLVERGRILEGEARRLFGELTLAVGWLHMHGVVHRDLKLENVLLDGELRIKLGDLGFAREWQKGRLMDTYCGTTGYASPEMLACQKYLGVETDIWSLGIILYTLLCGGLPFDDDDERVMKELIQKGEYEEPDWLSQEARDLIRGMLQHDPSKRLSIREILTHPWFKMTIVDKVYPNGDVPSIPPSPNPTSPTAAGDDFFAESALRQQQQQQSRLTPHVAGRSPLSTHLPTTPRQNSGSSEAENGDSRTERKASNMQRLNSAEFSTTEKELEQLHLCTSRPAATATGSGAISPRSISSPSMRGKTLRTLPEGQVDVDETPAGLPPPLSLIDEHPHLPVALHSRTPSRTKRRSVSSTLSLERRLSHHSSHNSYITFPPEDYLSKLDPSLLPNPDSSSSSTTTPPARSFTTPSETRLLRQLDDLGLDVGQLKHSVETDACDASAGLWWLLRQKQEERGETDEVVRRREKEVVRREEKVAEYAKEERRKAREAERERERIPTSPMGILGTRPGKRDSIEKSSEGLRFKEEQPPSIPTTPSYTSVIDLGPPVLPVDVDVDVERTAVGRDAPREAAGEEMKSWKRVESPQSVAISSQSSLDPAPTLPPPAAAGGGGAAGAKTQKEDGRDQAGLDPVAVATPMSNANSSTGASTVAKPEPNVNASANANTSANPRLKAKSPSMNMLQRATSVLGGVGKKGDDKDKDKNGMNEKREESTNDSLHPKRGGSSSPNKLKKPMPAGMKGLTSTLSRSESESEGLLAGGGGGGGGGDSPAVSASGSKTVTPGSSPRRKGLTPQGTPRGGLRDAGAKDSSGERASGNGNGNAGGGNEKGKGGKKDSLWTTFRHLFYEDRRRRKRESVTPSASSPLLLPPSDIKLPAGAVVLSRGANSRTSQFKRSNVGYAPSTGSRRTSLDGNRPVYSRRSSSVHTTSRRSSVGSLHFQDHQAMISDLSRRASQRSHGSQTPTSDREYLDYPSAAAPISRPGSSHSIRGGVGGGSRRSSFSVRSPSLHPETFSASAGGPTSTRFKSSVPPPASPLLGYRRRPAGGNDSSRVRHIKVIPESQIMRSSSVASSIRSNASSRASSMDRDRDRDRESEYESGRDDVSLRSGKRQKRRSGSQRSLAQQIHRTRSPLALSLENTYGSNSVANVGLGIGGASRIPKKPLRDVFQKKGKRKDGGDDDWVSEDEDGFACGLGQGRGIAKSFSNANANGTVWMNVNAKTNPARSAAAFPTSKMVAQPTAQGGTSRRRERGRRSSLEEERGRPQEGKGKAKGETVAQGLMGIESLSGRSRRNLPDRSTAPGIIEEEEEDEE

SEQ ID NO: 7361 - protein, 551 aa, Spinacia oleracea
MQASTFMVKGNLGFEVQNRRVAGLAGLKGLSSIRSNNLSFVNVNDNNYKSNPCKLSCGSLSMGAGFARLGLDHVMKSSPKYRSVKAQAASGGDLEDATPVKYQGKSSASVLPYVGVACLGAILFGYHLGVVNGALDYLSADLAIAGNTVLQGWVVSILLAGATVGSFTGGSLADKFGRTKTFQLDAIPLAIGAYLCATAQNVQIMMIGRLLCGIGIGISSALVPLYISEISPTEIRGALGSVNQLFICIGILAALVAGLPLAGNPLWWRTMFGIATVPSVLLALGMGFCPESPRWLFQQGKIVEAEKAVAALYGKERVPEVINDLRASVQGSSEPEAGWFDLFSSRYRKVVSVGAALFLFQQMAGINAVVYYSTSVFRSAGIASDVAASALVGASNVIGTAVASSLMDKQGRKSLLMTSFSGMAASMLLLSLSFTWKALAPYSGTLAVVGTVLYVLSFSLGAGPVPALLLPEIFASRIRAKAVALSLGMHWASNFVIGLYFLSVVTKFGISKVYLGFASVCVLAVLYIAGNVVETKGRSLEEIELALSPAV

SEQ ID NO: 7362 - protein, 391 aa, Streptococcus mutans UA159
MDLSKRFNKNLNKIEVSMIRQFDQSISDIPDVLKLTLGEPDFATPKHIKEAAKRAIDADESHYTGMAGLLALRQAASAFVKEKYHLTYNPDNEILVTIGATEALSASLTAILEPGDKVLLPAPAYPGYEPVVNLVGAEVVEIDTRSNDFVLTPEMLEEAILKEGEALKAVILNYPTNPTGVTYSRQQIKNLAEVLKKYPIFVISDEVYAELTYTGESHVSIAEYLPDQTILISGLSKSHAMTGWRLGLIFAPAVLTAQLIKSHQYLVTAATTSVQFAAIEALTNGKDDALPMKEEYIKRRDYIIEKMEAMKFKIIKPDGAFYIFAKIPVAQGQDSFKFLQDFAKEKAVAFIPGVAFGKYGEGYLRISYAASMETIKEAMKRLKEFMEQYAD

SEQ ID NO: 7363 - protein, 1110 aa, Desulfovibrio desulfuricans G20
MSIMIEPAGLDPQWYRDAIIYELHIKSFHDSDGDGMGDMAGLIEKLDYLQDLGVTALWLLPFYPSPLRDDGYDIADYMSINPDYGSMADFRKLLREAHSRGLRVITELVLNHTSDQHAWFRRARRAPAGSEERDFYVWSDTSDRYKDARIIFKDFEPSNWSWDPVARAYYWHRFYHHQPDLNYENPAVHKAMFRVIDFWLDMGVDGVRLDAVPYLYEEEGTNCENLPRTHDFLKALRSHIDSRFQGRMLLAEANQWPEDAARYFGDGDSCHMAFHFPLMPRMFMAIEMEDRHPVIDIMEQTPELPDGCQWAIFLRNHDELTLEMVTDEERDYMYRMYARDPRARINLGIRRRLAPLLGNDRRRVELLNVLLFTMPGTPVLYYGDEIGMGDNYYLGDRDGVRTPMQWSADRNAGFSRSNPQRLFLPVVIDPEYHYEAVNVETQQSNKSSLLWWMKRIIAMRRRYTAFSRGGISFLRPENSRVLAYMRSSGEEHVLVVTNLSRHAQAASLDLSGWEGYRPVEVFSNTRFPAVRQPAYTITLNPYGYYIFHMRREEAAEALTGLFSPPMLMPVSGARFLDVEVREALQRRVLPGYLTRRGLLGTSAVQLREAVILEAVPVGGKGAPSWLLIVEARYQERQPEWFGMLVSLLAGEPARQTVREAPVHLMCTFGEDAPEAVLVESFDASCRCGALLQLVSRTQTVKGRHGELAVAPAGGTRGRVRAACAEDAPALWKPHIHATSVVCGESVLFKVYRRMDEGVNPDVELLRFLTEEAGYPHVPAYMGVVEYRRSRTSSMAVAMLHEYVQAQGDAQEMCRDMVRRFFDRVLAARGEMDIRPRLYARSPVEAAGRPLPQEYRELMGDMDFAGMQLLGRRVGELHRALAFSSEDSAFAPEPFSTLYQRSVYQGMQSRVKQVLTRLERSLALLPESARDDAARVLELREEALRRMRGFLTRKLDCLKIRVHGNLHLGNVLRSGREYVIVNFEGRPDKSLSERRLKRSPLRDVADLVRSVHYTVLTVLMHESVLRPEDRAFLEPWADLWRIEASGAFMTTYLEAVGGSRLVPENEQGVQVLLEAFLLEKAFMELDAELKAPSGMVGLPLAAIITLLGAEG

SEQ ID NO: 7364 - protein, 376 aa, Oceanicola granulosus HTCC2516
MSETYQTPGPVERDWSDAISPIEEIIEDARNGRMFILVDHEDRENEGDLVIPAQMATPDAINFMATHGRGLICLALPGERIDALGLSLMSTHNSSRHETAFTVSIEAREGVTTGISAHDRAHTVAVAIDASKGAADIATPGHVFPLRARQGGVLVRAGHTEAAVDLARLAGLNASGVICEIMNEDGSMARLPELVAFAQRHGLKVGTIADLIAYRRRHDNLVRQMSERDVTSAFGGQWRMRVYSDTTHGDEHVVLIKGDISGDDPVLVRMHALDPLQDVVGLGPEGTANEFATAMRAVAAEGRGVVVLLRDTSMKLRLSGEASPQTLRQYGLGAQILSSLGLSQITLLTNSPKPRVVGLEAYGLEIVGTRRIEEPR

SEQ ID NO: 7365 - protein, 482 aa, Listeria monocytogenes str. 4b H7858
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCK

SEQ ID NO: 7366 - protein, 340 aa, Aeromicrobium erythreum (NRRL B-3381)
MAGPQDRPRGRGPSSGRPQRPVGGRSQRDRDRRVLGQNFLRDPATIRRIADAADVDPDGLVVEAGPGEGLLTRELARRAGRVRTYELDQRLARRLSTDLAQETSIEVVHADFLTAPHPEEPFQFVGAIPYGITSAIVDWCLTAPTLTSATLVTQQEFARKRTGDYGRWTALTVTTWPTFEWQYVAKVDRTLFTPVPRVHSAIMRLRRRPQPLLRDAAARSRFADMVEIGFVGKGGSLYRSLTREWPRSKVDSAFARADVHHDEIVAFVHPDQWITLFQLLDGSRGGAARGPGDQRGRRGRPGGGPRPDGRAGGGPRRDAGGRRTGDGRGGRPRPPRGGQA

SEQ ID NO: 7367 - protein, 491 aa, Oryza sativa
LRHNLSMSMPMPILLLLLLLPQGQGHGGAGDICIVGSGISGSSTAFFFTNYTTALSGAQLRVFERRAKVGGRLATVTVSGDHFEAGGSIIHPRNLHVRRFADLLGLEAKTDGDDDWLGIWDGHRFVFQTLRPLPPGTSWLRRKLHTLVNSLRLFKRYGLSLLKMDRFVQEMLQRFMLYYNGFESRPVFDTVEEMLKWSGLYGLTRRTLEAELLDAGLNSQTISELVTVITRINYGQSVSISGLAGAVSLAGSESGLWAVKGGNWQLAAGLLEAANATLHLQEGIDSIEYAGDHYILKSNKGLEYNCVATVVATPLDEVNITFSPPISIPARKTQHTHATFVRGILNPKFFGLSSVSDIPKLIGTMEVPEIPFSSISILKKYSEQDMTYKVFSRVKLNESLLDQIFSGRKETIRINWPAYPHYEAPEVFAPIILDGKQLYYVNTFESAASAMETGAVAAENVARLLIARLRLPLPSRPAAPAPDHHDQRADL

SEQ ID NO: 7368 - protein, 465 aa, Myxococcus xanthus DK 1622
MKRGESAPSPSLRVLDVMALTVGIVLGAGIFKAPSLVAAQSGSGEAMLLTWLLGGVASLVGALCYAELASAWPHPGGDYHYLYRALGKGPAFLFAWARLTVIPTGSIALLAFVFGDYATQLFPLGLYSSPVYAAMLVVGLTAVNIAGLRQGTRTQNLLTALEVLGVGAVVIVGLLFTPALVPAAAPPAPAASSGTAWGLAMVFVLLTYGGWNEVAYLSSEVRGSRRTIAWSLLASIGLVTALYLLVNVAYLRGLGLEGMARSEAVAADLMQRAVGSGGALVLSVIIAISALTSANATVLTGARTHYAFGRDSVLFNGLGQWHAKSNGPSRALLVQGAISLALVGLGTLTRQGFETMVEYTAPVFWLFFLLTGVSLMVLRVREPDAPRPFRVPLYPLTPLLFIGICAYVLYSSLAFTGLGALAGLAVLGTGGVLLAVEAVRTRRGSQGTSPKASSSPRLQRTKEAT

SEQ ID NO: 7369 - protein, 488 aa, Listeria monocytogenes str. 4b H7858
MNLEETMPLVFERSIPGRIGFSLPESDVPETKASDYFEQAYIRSVPADLPELSELEIMRHYTNLSNHNFGVDSGFYPLGSCTMKYNPKINEKVARFPGFANIHPNQPESSVQGALELLYDLQTSLVEITGMDEVTLQPAAGAHGEWTGLMLIRAFHEKNGDTKRTKVIIPDSAHGTNPASAAVAGFDVVTVKSNEKGLVDVADLKKVVGEDTAALMLTNPNTLGLFEKDIVEMAEIVHEAGGKLYYDGANLNAIMAKVRPGDMGFDVVHLNLHKTFTGPHGGGGPGSGPIGVKKELIPFLPTPVLTKKEEGYTFDYNYPDSIGRVKPYYGNFGINVRAYTYIRTMGPDGLKLVTEYAVLNANYMMRKLQEAYDLPFDQVCKHEFVLSGNRQKKLGVRTVDIAKRLLDHNFHPPTVYFPLIVGEAIMIEPTETESKETLDSFIDTMLKIAKEAEENPEIVQEAPHSTYVKRLDETRAARKPILRYQKEV

SEQ ID NO: 7370 - protein, 532 aa, Magnaporthe grisea 70-15
MSNFSFQLNSIALLITLTALLLIYKLLNSFVIRPLHNHLAARRLNCGSLPTEPSKWPFGIDTVLRGLQADRDQQMPDYVASRFAAMGRYTWRISVLGTSNIITAEPRNVQALLATQFDDFSMGDARTTNLRILLGRSIFAVDGAAWHGARETMRPLFARDNVSNVELLEGNFQKLLRCIKQELHKDAEGRLWTAPTSLAALLPSFTLDSASEAFLGSSAGALDARLDGSAQPHLLWALERMAPLLRVRFALRGLYFLYGTRELRRCADAMHAFVDAAMTRADDALKQDHDGQHLGGKRFEFLQKLRARCADRAEVREQVLGLLAAGTDTTAALVGWVFYSLIRHPRVFARLREAVLEDFGATGRQVTFERLKSCRYLQQVLSETLRRHSVVPLNSRRARRDTTLPTGGGADGTQRVFVPAGTEVNFSTHVLHRRGDLWGRDADDFRPERWAERRPGVFHYVPFNGGPRICIGQQFALTEAGFVVVRMLQEFDAVEGLHVDPERDWHNFGITCSPGSPEDRHAGVTCRLRLAS

SEQ ID NO: 7371 - protein, 334 aa, Ustilago maydis 521
MPRAVSAKLSRQHEPSAGLRSGSARSAASSSSSVHASNQNSSATTKNPIFNTDKFGQHILKNPLVAQGIVDKANLKPTDMVLEVGPGTGNLTVRILEKAKKTTVVEMDPRMAAELSKRVQGKPEQRKLDIMLGDFCKTDLPYFDVCISNTPYQISSPLVFKLLSHRPLFRCAILMFQREFALRLIARPGDNLWCRLSANVQLYSKVDHIMKVSRNSFRPPPQVESSVVRITPLNPPPAIPFEEFDGLTRIVFSRRNKTVRASFFDARGVIDMLESNYKTYCAVKEIMPEQGSFADMVKQVLVETGSAENRAAKMDIDDLLTLLAAFHEKGIHFS

SEQ ID NO: 7372 - protein, 780 aa, Magnaporthe grisea 70-15
MSATEIPRTTGPGRLIAAHERRAASSIDSSSSHSRTMTVPEQSESSHVESELQDVIEDTPKKPKTRHSIFRGISRIASSPAMGLGLGHSRSASVSYSSGSSISSVSLSTASSSSPYTPTSTSSYFPSSDSPLEREGAGSSSGSGTSSPGCSPGQWSPEEIRVRQLNVESLPHNDNDLGKSSIPAELVSTRKVSQRRKESWASMPLEIKIHILSHLNARELVLLARVSKELRELCFDGQLWTTFDASSFYKRIPSHVLTNTLVRAGSFVQHLNLRGCIQLSGSTPFDQVPKLCTNLHTLTLEGCFIKRNILHSLLESNVRLERINLTGLKSVCNSTCRIIAEMCPRLQVFNVSFCTDLDARGIKSVLDRCPLLTDVRAAEVRGFERHDVAAAIFRATNLTRLTLNGCREIDDASFKIMLLGKDPKFDLLTDLPMVPPRKWRHLGLSYCDGITNEGFGAMGHLVPDLESLELSRCGSLSDAGLGPVLATTPRLTRLDLEDCALLTNTTLSTHLAKAPCAPLLKHLTVSHCENLGDAGLMPVVRACKSLQVLEMDNTRASDLVICELSAMIRARSKHTTQLPQISLRVVAYDCSNITWMGIREVLSRNCEAAPRARKQASQNAWRAEAERVYALIEEVSSRAGPQGSGQASVASETNSTSAAKRQSKKAGVNPSEAPKQPSGQQTYPSDIIGIKCYYAWQQTVDEHTKRVLAGELTRASRLERSWAAWMQADEEQEAGGGIRLTRRRRTRAREAQMVHADEEVGGNGAGVRRRARTASSCVVM

SEQ ID NO: 7373 - protein, 137 aa, Glycine max
KVVLFQIGEIISRFERKGFYLKGLKLVTVDRPFAEKHYADLSAKPFFSGLVDYIVSGPVVAMIWEGKNVVTTGRKIIGATNPAQSEPGTIRGDFAIDIGRNVIHGSDSVESANKEIALWFPEGPANWQSSQHSWIYE

SEQ ID NO: 7374 - protein, 181 aa, Brassica napus
MASVMLSSATMTSSLAHSTMVAPFIGLKSSAAFPMTCKANTEITSITSNGGRVNCMKVWPPVGKKKFETLSYLPDLTDVEIAKEVDYLIRNKWTPCIEFELEHGFVYREHGNIPGYYDGRYWTMWKLPLFGCTDSTQVLKEVKKCKQEYPNAFIRIIGFDNNRQAQCISFIAYKPPSFTDV

SEQ ID NO: 7375 - protein, 465 aa, Mesorhizobium loti MAFF303099
MTKRWSAKGMAGNFSFDQLKKAVSSGEIDTVLACIVDMQGRLAGKRFLAQYFVDSAHDETHGCNYLLAADIDMEPVPGYKAASWSKGYGDFVMKPDLATLRRIPWLEKTALVICDVLDHHTHDDLPHSPRAILKKQVKRLSERGYIGYFASELEFYLFNETYDSARKKHWQGLDTASPYIGDYQIGITTKEEGVMRRLRNEMEAAGIPIENSKGEWGPGQEEINVRYAEALDMADRHVILKNGAKEIAESEGKAISFMSKYNYGLAGNSSHIHNSLWSADGKTPLFFDKKADWTLSTLGQQWAAGQLKYAKEFTWFLAPYINSYKRFQAGTFAPTKIMWSEDNRTAGFRLCGEGTKGIRMECRIGGADLNPYLAFAALIAAGLAGIDEKLELQKPFVGDAYQASRLPEIPKTLRDATETLAKSKMLKQALGEDVLEHYVHTAKWEQFEYDRRITDWELHRGFERY

SEQ ID NO: 7376 - protein, 223 aa, Coccidioides immitis RS
MWSWFGGASAQAKKDVPKKAILELRQQLEMLQKREKYLEAQMAEQDALARKYVTSNKNAAKAALRRKKGHERYLEQTTAQIIQMEHHIYSIESANLNQETFNAMKNAGAAMKHINKGLTIENVDAVMDDVREQHAISEEIANVISSAPMGDTVDESELEIELDGLEQEAIDERMLKTGTVPVGDRLDSLPVAANGELKGKTKAQIEEEDEEAELEKLKAEMAM

SEQ ID NO: 7377 - protein, 210 aa, Haemophilus somnus 129PT
MFTGWRDVNLTERGIEEAKAAGKKLLEAGYEFDIAFTSVLTRAIKTCNIVLEESNQLWIPQVKHWRLNERHYGALQGLDKKATAEQYGDEQVHIWRRSYDVSPPDLDPQDPNSAHNDRRYALLPKDVVPNAENLKITLERVLPFWEDQIAPALLSGKRVLVTAHGNSLRALAKHIIGISDEEIMAFEIPTGQPLVLKLDEQLNFVEKFYL

SEQ ID NO: 7378 - protein, 141 aa, Halomonas sp. #593
MATERTLSIIKPDAVAKNVIGEIESRFEKAGLKIVAAKMLQLSQEQAEGFYAEHKERPFFGDLVGFMTSGPVVVQVLEGENAIAANRDLMGATNPKEAEAGTIRADYAQSIDANAVHGSDSPESAAREIAYFFEESEICSR

SEQ ID NO: 7379 - protein, 390 aa, Glycine max
MGKREKQKQRHERGHRGRGSFNYLQEDHDFDDTPRSSPSEEEGADGSNEEKEEDEENVTISHENQSHDMPSKFLLYQQSVQSPKGDISYMQKFFLMYVGGRMPLHLQEDFCGTALLSTEWLRSDSRRTVVGLDLDLEALNWCMENNIPKVGADGFSRISLFHGNVLQPLQSKLVKVDPQELVSNISLSQNEENLQTGVPESDAPTGSIAQDDKYTKGNITLPGRDIVCAFNYSCCCLHKRAELVMYFKHARGALSTKGGIFVMDLYGGTSSEHKLRLQRRFPNFTYVWEQAEFDIIQRKTRISLHFHMKKEQRKLRHAFSYSWRLWTLPEIRDCLEEAGFRSVHFWVREMPDTTEIMKTEGFGAGKNVKYEEATSFQQQDSWNAYIVGVA

SEQ ID NO: 7380 - protein, 406 aa, Cytophaga hutchinsonii
MITTGGNKQEIDHMDNDHLTTLNLGPTHPATHGVFQNILKMDGERIVDAVPTVGYIHRAFEKIAERRAFYQITTLTDRMNYCSAPLNNMGWHMTVEKLAGIELPKRVEYMRVVIMELSRIADHLICNSILGVDAGAFTGFLYIMQSREQIYEIFEEICGARLTTNMGRIGGFERDFNDIAMRKIDKFLADYPAVLTEFENLFNRNRIFMDRTIGTGGITAERALNYGFTGPNLRAAGVDYDVRVTSPYSSYQDFDFTIPIGINGDTYDRFMVRNKEMWESLSIIRQAMEKIKALPKGVFHAEVPDFYLPPKEDVYSQMEALIYHFKIVMGETEIPKGEVYHSIEGANGELGYYLVSDGGRTPYRLHFRRPCFIYYQAYPEMIKGQLISDAVVTMSSLNLIAGEMDA

SEQ ID NO: 7381 - protein, 287 aa, Anaplasma marginale str. St. Maries
MSVAQMYHACYAVGADVEGFLLDMKVTILGCGYSMGVPTVGCDCSVCSSDSAFNKRTRTSALIENGDVRILVDASPDLRAQALRHKLHVLDSVLFTHCHADHCAGIAELQAFNVGGGANCMPVYADYGTLSMLLASNAYFFVPGKPGAPWKKCHYLVAHPVRYHTEFFVGGCKIVSFKQIHGEVNSSGFLFDDDIAYCTDVKSFPQNSWDLLHNRRLLILGCLRYEEVAAHAHVDLCIEWIKELKPDTAVLTHMSHDLDYHQLTDYVKEKLPGGNVLVAYDGLELNL

SEQ ID NO: 7382 - protein, 267 aa, Dehalococcoides ethenogenes 195
MKIAFIGGGNMGEAILGALIQKNICPPKDITVSEIKAERRTFLENTYGIKTTPSNPEAIKNAEVVLLAIKPQNLAELSAGLKGKLAETQLVISIIAGATLSKLSGGLEHKAVVRVMPNTPAMIGMGMSVWTALPAVSPAQKEQAKSILSAMGKEIYTGKETMLDAATAISGSGPAYFFLFMESLEKAAQEMGFTPEEATVLVSQTAAGSAVYAEKSGLPLAQLRKNVTSPGGTTAEAIKVFEQAGLETTVIKAAKAAFDRSVELGKG

SEQ ID NO: 7383 - protein, 266 aa, Dehalococcoides ethenogenes 195
MEKHMDEPVISLSDIKNNLHTCLMGREIIYLPETASTQTTAMDMARKGSQEGTLVITGKQTEGHGRLKRLWVSPQGNIYMSLILRPNQNQLSRLIMAASLAVSFAIENTTGLIGELKWPNDILIDGKKVCGMLVENDIRDGQVNFSTVGLGINVNTDMQSYPELKGIATSLINHTGKPVSCEKLIVSFLHEFERLYLGLNEYGECIFEMWRKRLITLGKEVDVTSGKDTYRGIVESVVPDGSLKIRLADGNLVHIVAGDVSLRHAE

SEQ ID NO: 7384 - protein, 409 aa, Helicobacter pylori 26695
MAQNFTKLNPQFENIIFEHDDNQMILNFGPQHPSSHGQLRLILELEGEKIIKATPEIGYLHRGCEKLGENMTYNEYMPTTDRLDYTSSTSNNYAYAYAVETLLNLEIPRRAQVIRTILLELNRMISHIFFISVHALDVGAMSVFLYAFKTREYGLDLMEDYCGARLTHNAIRIGGVPLDLPPNWLEGLKKFLGEMRECKKLIQGLLDKNRIWRMRLENVGVVTQKMAQSWGMSGIMLRGTGIAYDIRKEEPYELYKELDFDVPVGNYGDSYDRYCLYMLEIDESVRIIEQLIPMYAKTDTPIMAQNPHYISAPKEDIMTQNYALMQHFVLVAQGMRPPVGEVYAPTESPKGELGFFIHSEGEPYPHRLKIRAPSFYHIGALSDILVGQYLADAVTVIGSTNAVFGEVDR

SEQ ID NO: 7385 - protein, 258 aa, Cytophaga hutchinsonii ATCC 33406
MEKVKAKKHLGQHFLNDQQIAQDIVDGLTLHGSYKEVLEIGPGMGVLTQYLLKNNSYHTKVVDIDGESIEYLKKVFPQLKDDVIHGDFLKADLADWYPDKFAIIGNFPYNISTEILFKVLDYREQIPEVVGMFQKEVAERFAAKNGNKTYGITSVLLQAFYDIEYLFTVPEHVFTPPPKVKSGVIRLKRNNRTHLPCDEKEFFKVVKAGFNMRRKTLRNALKSINVQNISMDLPIFDKRAEQLSVQEFFDLTNMLSGK

SEQ ID NO: 7386 - protein, 341 aa, Chlamydomonas reinhardtii
MSGKIKIGINGFGRIGRLVMRATMLRPDIEVVAINDPFIDAEYMAYMFKYDSVHKTWPGHVNGSKDGFLVEGRKIHTFTESDPSKINWGAAGADIVIESTGVFTDIAKATAHLTGGAKKVIITAPSNDAPMYVMGVNHEKYNPATDHIISNASCTTNCLAPLAKVVNSKFGIKEGLMTTVHATTATQKTVDGPSKKDWRGGRAVNGNIIPSSTGAAKAVGKVLPELKGKLTGMAFRVPTNDVSVVDLTVTLEKATTYEDIMKALKEASEGEMKGVLAYTDEDVVSSDFVTDPASCTVDAKAGIMLSPTFVKLVAWYDNEWGYSNRVVDLALHVAKKAAVKV

SEQ ID NO: 7387 - protein, 48 aa, Brassica napus
STHASEPVKDLSTLKLMELRGIAKSRGLKGFSKMKKAQLVELLSSDSI

SEQ ID NO: 7388 - protein, 235 aa, Burkholderia mallei ATCC 23344
MTLPMTQDELKRLVGEAAARYVTENVPQGAVIGVGTGSTANCFIDALAAVKDRYRGAVSSSVATTERLKSHGIKVFDLNEIESLQVYVDGADEIDGSGAMIKGGGGALTREKIVASVAETFVCIADASKRVAVLGQFPLPVEVVPMARTAIGRRLAALGGVPVLRVKQDGAPYVTDNGNEILDVKGLRIDDPRALEAAINGWPGVVTVGLFAQRGADLCLLGTERGVETLRYAAH

SEQ ID NO: 7389 - protein, 447 aa, Ustilago maydis 521
MASIAGSLARQQLRQFVGRSTIISTPSCSYSTTSSASRNTPSASHSTESRRLRSAAAIAHSQFSTCTHVHSSWPAGAVGSAESDKLPPPVKGKAKTAPSIPSPSRSKTIADIQALKHHPSGSIPIVCLTAHDFPSALSVRAANVDLCLIGDSLANVALGYTSTQPLSLDAMIHHCQAVKRGLDAPLLATASLLDGIDLPQPPLVIADVPFGATFGSLDSGVAAVVRLIQESGVDGVKIEGSYETIPLIQRLTSHGIPVMGHLGLQPQRVGSTSGYRVQGKTAAQAKEMLDAALALEQAGCFSIVLECIPTRVGEHISRKLSIPTIGIGAGSKTDGQILVMNDMIGDLTGAGHVLAQLSVRTDADQARAAASAPLPTSSDLMPPAPKFVRNFSLAMGTSIGALRIAAVQAYTQAVRTREFPDDDKEGYKIKTDEWIAFLQLVSESGTK

SEQ ID NO: 7390 - protein, 215 aa, Xanthomonas campestris pv. vesicatoria str. 85-10
MSEAKRLAAEKAIDYVEDGMIVGVGTGSTVAYFIDALGRIGHRIKGAVSSSEQSTARLRQHGVEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQITDPVGLERSLNQIPGVVCVGLFARRPADVVIVGGEPPQVI

SEQ ID NO: 7391 - protein, 408 aa, Campylobacter coli RM2228
MQIPSKLKPYYENIAFEQEDSKMIINLGPQHPSAHGNLRLILELDGEQVVKARPAIGYMHRGMEKMAENMIYQEFIPTTDRMDYIAASANNYAYCAAVEKLCGLEIPRRAAVIRMILLELNRIASHLLWLATHALDIGAMSVFLYCFREREYVLDLIEKYCGARLTHSSMRIGGVMLDLPEGFLNELLAFCDKFPKDIADYEALLDDNRIWRLRTENVGVVSKEQAMNWGCTGVMLRGSGVRYDIRKEEPYLLYNEIDFGVPYATQGDSYARYKVYMQEFRESLKILRQCAALYKDTPPEILANHPEYVSASKEQILTQNYSLMQHFVLITQGLKPPKGEVYVPTESPKGELGFFIHSDGTGRPYRLKARTPSYWHCAFFEEMLVGTYLADVVAIMGNVNIVLGEIDR

SEQ ID NO: 7392 - protein, 338 aa, Zea mays
  misc_feature (35)..(35): Xaa can be any naturally occurring amino acid
  unsure (1)..(338): unsure at all Xaa locations
MGKIKIGINGFGRIGRLVARVALQSEDVELVAVNXDPFITTDYMTYMFKYDTVHGQWKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 7393 - protein, 706 aa, Glycine max
MDGYEATRIVFSRIQNLDPENASKIMGVLLLQDHGEKEMIRLAFGPEALVHSVILKARKELGLPSNSSPTPSTPPSPSPFISRQNLNTSSRLSGTNIPPALTIPNPSSWPTMSELQTPDDLMSPNHLVVGSSTTSLSLPFYANGGSDPIDEFQLQDQLAFLNDGSPTSTALSHKNNPDMFYPSNSDLSSSPTTAADPTLFPSDGWGGSLHRRSCSVSDACLGSEDPNSGLGWKPCLYFARGYCKNGTSCRFLHGGLGDADVGGAAAAMVGSPSKIEMMEQCHELLRSKSFQQQRLAAASQLMASSIFPYSPKSMNFLLQQQQNDTQRAAAAALMMSEDLHKFGRSRLERNDFSLNSPVMVNPASRQIYLTFPADSTFREEDVSNYFSIYGPVQDVRIPYQQKRMFGFVTFVYPETVKLILSKGNPHFVCDARVLVKPYKEKGKVPDKKQQQQVDRGDFSPCGTPTGLDARDQFDLQLGGRMLYNTQDMLWRRKLEEQADLQQALELQSRRLMGLQLLDIKKHHQRALSTGSPIPSPTHSPNMFNQNIVPSFHINSESPKESGSTSAPASTASVSAGQQPVNISVGKEVVVNGENGYKEGNGKQSSSHDDCDLQECLEHNLPDSPFASPTKGDGDFLVAFSNGPNEANDADASAASANSKFGTSTLLPAASALDMGTFKSFNCQIPRFSSGHGTIGMFAGTGGPIGI

SEQ ID NO: 7394 - protein, 333 aa, Prochlorococcus marinus subsp. marinus str. CCMP1375
MNPEKLDVVAIGNAIVDVLINTEESFLREHSLAKGNMTLITQEKAEELYSKSDPSLETSGGSAANTIAGLSELGSNAEFIGRVKKDALGNTFKDDICSTGAVFNTPPIKYGPSTARCFIYVTPDAERTMCTYLGASVLLETKDIDFSILGETKILYLEGYLWDLEKAKSALKASAEECKKLGGKIALSLSDSFCIERHRESFQELLEKNIDILFANENEIISLYNSSSLDDAIENIKPKCEIAVITIGGKGSIIISGDEKYLIKPYNFGKVIDTTGAGDLYASGFLHGYVNGLDLQTCGNIGSTCAGYIVSQLGSRSKVSLKDIVIERLGLPA

SEQ ID NO: 7395 - protein, 274 aa, Listeria monocytogenes
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELTEEEVAKISGLNKDERTGPDPDNFNF

SEQ ID NO: 7396 - protein, 297 aa, Triticum aestivum
  misc_feature (243)..(243): Xaa can be any naturally occurring amino acid
  unsure (1)..(297): unsure at all Xaa locations
LDAFIVSCHKDLQVLRECANRVYYNNLRIIVYDFTRQRLIIPDGSLPTTEHPTVLSVIQSENHTVLNVLVDQGHAERQVLVRDYEVGKSVAFDHRMRNIKEVYTSDGFRMFSRGSVQTILPPNKRPRPERWCSSPAEKIAELKNEVDGIQRIISEKNAQRRKLVNDRSNLEQKIANLKRKREPEERHLMNKKVQLEDGRRATAENNRHAAVDTTELEEDIKEEKNNIEQKELSLQKTNVKLTXSLREVNDRRTAFKTFMDSVNEERLHFSSANDELDLVKRKIDAAQQEKTHYEGVM

SEQ ID NO: 7397 - protein, 757 aa, Coccidioides immitis RS
MARLGIITCLVSFFLGTFFVIQLLSNPGVSQQRRWLRFPSSQRAGRARYGDIDDDVYLLGVGKADITGPVAEIIFMGYANSEQVGSGLRQRLYSRAFIVGSRENPENRFVYIVLDTVAGDTAIRDGILKGLAELGGEYVHYGQHNLALTGTHSHAGPGAWLNSLIPQISTNGFNKESYQAIVDGTILSIKRAHESLAPGRLSFASGQLDNTSINRSPFAYLANPEEERARYNGDTEKQFSLLRFDREEDDKTIGVLTFYSVHGTSLYRNNTLVSGDNKGVASYLFERGVRHDHRFAEDFVAGFSQSSVGDVSPNIEGAFCEDTGLPCKFEDSTCNGKAVLCHGRGPFFREKDEGSKSCFEIGRRQFFAALNLYGKMDRQTVRGSSAVSSFHTFQDFSKYKFISPFNKSRELTSCSAALGFAFAGGTTDGPGYFDFTQNGTDSPSTRNPLWNFARDLLHPPTKQQKECHSPKKILLDVGELHFPYQWTPNIVDIQLLRVGQVVIIVSSGEVSTMAGRRWREAVAKTAKHALDISEPIVLLGGPANTYVHYITTEEEYGIQRYEGASTLHGPHTLAAHVNLTLTYLPNLAEDATSLPPVPPGPSPEVNTNRSMSFILPVVLDTPPIQKNFGDVLSGPSSDQVFRPGDIVKTKFVAANPRNNFRLEGTFAAVERQTGRNTWEVVRDDSDWNLVYHWGRKSPGLSSSAVTIEWEIENDYYSIGSPRVQSGTYRMIYYGDAKGWDGKIRGFKGTGPSFKVSA

SEQ ID NO: 7398 - protein, 281 aa, Euglena gracilis
MDLDYEGQAPTTSLLLLFPPHLVPEYIGTISNNLRSAEVNHRPSKTFLEEVQVDITRLMRAILVDWMNEVTEEFRLKMETLCLAVNYVDRYLSRVPVPRHQLQLVGVASLLIASKMEEIMHPQIDEFVYITDSTYNREQVLRMELSILNALRYDMTVVTPRDFVGIYLKVAQASPEVCMLADYLLELILQEYAFLHWEPSMIAASAVVLALFGFRLPCWSDDLRRITQYQPNELNACLKEMHRVFQNAPHNNLQAVREKYSHGRFMHISMVAQLPPSPPVF

SEQ ID NO: 7399 - protein, 101 aa, Thermotoga maritima
MGSDKIHHHHHHMEVKIEKPTPEKLKELSVEKWPIWEKEVSEFDWYYDTNETCYILEGKVEVTTEDGKKYVIEKGDLVTFPKGLRCRWKVLEPVRKHYNLF

SEQ ID NO: 7400 - protein, 259 aa, Triticum aestivum
  misc_feature (180)..(180): Xaa can be any naturally occurring amino acid
  misc_feature (186)..(186): Xaa can be any naturally occurring amino acid
  misc_feature (218)..(218): Xaa can be any naturally occurring amino acid
  misc_feature (225)..(225): Xaa can be any naturally occurring amino acid
  unsure (1)..(259): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAGLKIGAPEPSQLSIDQNAQGLARYAIICQENGLVXPIVEPXILGVGPHDIGPWAYATGNGLVGWFKALKKPEXLLEGALXKPKRGPPGFEPKRGPPGGLLGHPPGPLQGPALFG

SEQ ID NO: 7401 - protein, 210 aa, Anaplasma marginale str. St. Maries
MNVEPLASGVFAPIDEVIEAASQGKAFVLLDDAERENEGDLVVLADKVSVATINMMIRYGSGIICLAISEQHANRLGLALMPRRNAKDGCTAFTTSIDARYGITTGVSAYDRATTILAAVAEHSTADDIVTPGHVFPIIADSGGVTKRAGHTEASVEIAKLAGATSAAVICELMNPDGTMSRLPEIIAFAQAHDVGVTTIKGLVEYLSNS

SEQ ID NO: 7402 - protein, 170 aa, Glycine max
LEPIRLEARTVGVAVDFSPTSKLALRWAVDNLINKGDQIILITVQPPQAHHTRKELFEDTGSPLVPLEELRELNFTKQYGIARDPEVIGILDTASKTKGAKAVAKVYWGDPREKLCNAVEDLHLDSLVVGSRGLGPIKRVLLGSVSKHVMTNASCPVTVVKGKQSSNSRH

SEQ ID NO: 7403 - protein, 348 aa, Neisseria gonorrhoeae FA 1090
MKMQAVVVNKNVAGDVEVVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGTHVVAIDINDDKLAFAKETGADLVVNAAKEDAAKVIQEKTGGAHAAVVTAVSAAAFNSAVNCVRAGGRVVAVGLPPESMDLSIPRLVLDGIEVVGSLVGTRKDLEEAFQFGAEGLVVPKVQLRALDEAPAIFQEMREGKITGRMVIDMKKECGCDHHH

SEQ ID NO: 7404 - protein, 393 aa, Pseudomonas aeruginosa UCBPP-PA14
MVYLGPGKVEVQNIPYPKMQDPQGRQIDHGVILRVVSTNICGSDQHMVRGRTTAPEGLVLGHEITGEVVEIGRGVETMKIGDLVSVPFNVACGHCRTCKEQHTGVCLTVNPARAGGAYGYVDMGGWVGGQAEYVLVPYADFNLLKLPNREAAMEKIRDLTCLSDILPTGYHGAVTAGVGPGSTVYIAGAGPVGLAAAASARLLGAAVVIVGDVNPTRLAHAKKQGFEIADLSKDTPLHEQIAALLGEPEVDCAVDAVGFEARGHGHSGSQQEAPATVLNSLMGITRVAGKIGIPGLYVTEDPGAVDAAAKHGALSIRFGLGWAKSHSFHTGQTPVMKYNRQLMQAIMWDRIKIADIVGVEVITLDDAPKGYGEFDAGVPKKFVIDPHNLFRAA

SEQ ID NO: 7405 - protein, 432 aa, Acinetobacter sp. ADP1
MSLSPKQVQLFEQASKHIPGGVNSPVRAFNGVGGTPVFIKKAQGAYLWDEDDKRYVDYVGSWGPMILGHAHPDIIQAVQTAAVDGLSFGAPTVHETTLADIICDIMPSIEMVRMTNSGTEATMTAIRLARGYTGRDKIVKFEGCYHGHSDSLLVKAGSGLLTLGEGEPTSKGVPVDFAKHTLTLPYNNIEALKECFAKFGHEIAGVIVEPVAGNMNLVTPIDGFLQAIRDVCDEYGSVFIIDEVMTGFRVALGGAQSVYQVKPDLTTLGKIIGAGLPVGAFGGKREIMECIAPLGGVYQAGTLSGNPLAMRAGITMFKHLREPDFYSKLEAKLQKLLTGLQAAANEAGIAFKTQQVGGMFGLYFTDQEDITSFDSMLACDTDAFKKFFHGMLERGVNLAPSAFEAGFISSAHSDEDIELTIQAAKETFAEMK

SEQ ID NO: 7406 - protein, 492 aa, Burkholderia xenovorans LB400
MSTNLEQLARALIRTDNFINGQWIAAASGRRFAVTDPATGNLIADVADSGPADARAATDAAAKALPAWRALLASERAAILHRWHALIVANRDALGALISLEQGKPLTEGRGEVGYGASYVAWFADEATRIYGDLIPQQQRGKRMSAVKEPIGVVAAITPWNFPLAMIARKIAPALAAGCTVVAKPAEDTPLTAIALVMLAHEAGVPDGVLNLISASRAAAAETVGDWLADSRVRKITFTGSTPVGKHLARESAGTLKKLSLELGGNAPFIVFDDADLDAAVNGLLAAKFRNGGQTCVCPNRVYVQHGVYEHFAALLRARVAELRVGPASDPTSQIGPMINVRAVDKIARHVDDAVEHGAVVLTGGRRLTELGPHYYAPTVLGNASASMALCGEETFGPVVPLFPFDTEQDAVQAANDTPFGLASYFYSENMRRIERVSRALEAGIVGINEGALASEAAPFGGVKESGYGREGSKYGLDDYLSIKYLCQGGLQ

SEQ ID NO: 7407 - protein, 82 aa, Zea mays
  misc_feature (71)..(71): Xaa can be any naturally occurring amino acid
  unsure (1)..(82): unsure at all Xaa locations
ARMASLLLDNQEYTEALTLGTCLIKEVRILDDLLLLVDIDLMESKLHSFLKNLSKAKASFNTARTAANAIXIPSAQLGTIDL

SEQ ID NO: 7408 - protein, 580 aa, Cryptococcus neoformans var. neoformans JEC21
MTSPYIPLPAAPLPLSEDPSSMELSSSADDDEGHGRPRLGRSATINSLGDFEFEHALLPLTLSGDADVDSHKEERHVELWHGVALVVGAQVGSGIFSSPGVVVQEVGSVGASLMVWVISGVLAWTGASSYAELGCAIPLSGGSQAYLAYAFGPITSYLFTWTAVSALKPGSAAMIALIFGEYVNRLISHSLGDSEVPAWSIEVTAVFAIFLCSILNAISPTMGTNSTVVLTVIKIGALVFVAVLGAIVLLRDGPGEGLMPSGLFKGTLADAGNYAIAIYSGLWAFDGWDACCYVAGEMRDTNRDLPRALHSSMAIVVVLFLGANLSYFIVLSPSVVASSNTVALDFGKVTIGKFGAVVFSTLVAISCFGALNGGLYTTARLIYAASKEHFLPSIFSRLHPQRRTPDNAILLQGGLAIFFVIFGGGFRALLNFFSVASWTFYLLTVLGLLVLRVKEPHLDRPYRAWLVTPIVFCAVSMFLLLMPIFAAPWEAFAAFVFIASGMPVYYLTVRSRTRNAELDGASSSGWGVRVTLSDAWIKFREDIDRLLPREWQQPYRPQPHYNSDRRRGMLGEQVEMSERR

SEQ ID NO: 7409 - protein, 464 aa, Bacillus licheniformis ATCC 14580
MTSMLEVYNPATGEKIKSVPQQSAKEVEEAVVRSHEAFQKWSKTSAAERAGLLKKWFDLIVEQKDELAKLITLENGKPYAEAQGEVLYSAGYIEWYAEEAKRIYGRTVPASVTNKRIIVTRQGVGPVAAITPWNFPAAMITRKAGPALAAGCTFIIKPAPDTPLTALELVRLGHEAGIPKDVLQCVIGDGQEIGSIFTSHPLIRKITFTGSTPVGKHLMKNSAETVKHVSMELGGHAPLIVDEDANIDLAVKQTMLSKYRNAGQTCVCANRLIVHESVKDEFAEKLRAEVAKLKVGNGLEEGVSIGPIINKNGFQKIVDQINDAVNKGAKVLIGAEYESDDEKSCYFVHPTVLTDVDPSMTIMHEETFGPVAPITSFKTLDEAVKLANDTPYGLAAYFFTENYRRGIYLSENLDYGILGWNDGGPSTVQAPFGGMKESGIGREGGLEGIEPYLETKYLSIGLDE

SEQ ID NO: 7410 - protein, 404 aa, Leptospira interrogans serovar Lai str. 56601
MDLSAKRLNVIEPSPTLVITAKANELKKKGEDIVSFGAGEPDFETPSHIRDAAKNAIDRGMTRYTAVSGTVELKEAIVHKFKRDNGLDYDKSQVIVGTGGKQVIYNYFLATLNAGDEVIIPAPYWVSYADIVRLAEGVPVIVNTTPEANFQITSEQLKKVITPKTKCLILNSPSNPTGAGYSKKDIEALGEVVLSTGIQVMSDDIYEKIVYDGFVFSNLAMLSPELKKQTFVINGVSKTYSMTGWRIGYGAGDLNIVKNMETIQSQSTSNPSSISQAAAQAAIAGDQSCVEEMRKAFQVRRDLIVSLLNAIPGVKCNNPQGAFYVFPYLTDVYKTTGFIKLKQGFSETSLSKIFCSTLLEKYKVAAVPGIAFGEDQALRLSYAMGENDIRRGVERIAEMIRDLN

SEQ ID NO: 7411 - protein, 358 aa, Zea mays
  misc_feature (12)..(12): Xaa can be any naturally occurring amino acid
  misc_feature (14)..(15): Xaa can be any naturally occurring amino acid
  misc_feature (20)..(20): Xaa can be any naturally occurring amino acid
  misc_feature (24)..(24): Xaa can be any naturally occurring amino acid
  misc_feature (32)..(32): Xaa can be any naturally occurring amino acid
  misc_feature (45)..(45): Xaa can be any naturally occurring amino acid
  misc_feature (51)..(52): Xaa can be any naturally occurring amino acid
  misc_feature (58)..(58): Xaa can be any naturally occurring amino acid
  misc_feature (67)..(68): Xaa can be any naturally occurring amino acid
  misc_feature (71)..(72): Xaa can be any naturally occurring amino acid
  misc_feature (77)..(77): Xaa can be any naturally occurring amino acid
  misc_feature (83)..(83): Xaa can be any naturally occurring amino acid
  misc_feature (86)..(86): Xaa can be any naturally occurring amino acid
  misc_feature (95)..(95): Xaa can be any naturally occurring amino acid
  misc_feature (113)..(113): Xaa can be any naturally occurring amino acid
  misc_feature (115)..(115): Xaa can be any naturally occurring amino acid
  misc_feature (125)..(126): Xaa can be any naturally occurring amino acid
  misc_feature (136)..(137): Xaa can be any naturally occurring amino acid
  misc_feature (147)..(148): Xaa can be any naturally occurring amino acid
  misc_feature (158)..(159): Xaa can be any naturally occurring amino acid
  misc_feature (166)..(166): Xaa can be any naturally occurring amino acid
  misc_feature (175)..(176): Xaa can be any naturally occurring amino acid
  misc_feature (190)..(190): Xaa can be any naturally occurring amino acid
  misc_feature (199)..(199): Xaa can be any naturally occurring amino acid
  unsure (1)..(358): unsure at all Xaa locations
GSPITEIEDISXAXXSTVTXDARXGISTGVSXADRAKTILTLASXDSKPSXXRRPGHXFPLKYRNGXXLKXXGHTEXSVDLVXLAXLRPVSVLSXVMDPRDGSMAGVTVLQQXAXEHDKPIVSIXXLIRYRRKPGXXLVELISVSRXXTKWGLFRAYXXQSRLDGXEHIAVVKGXXGDGEEVLVRVHSEXLTGDILGSXRCDCGNQLELAMKLIQKAGRGVLVYLRGHEGRGIGLGQKLRAYNLQDQGHDTVEANVELGLAVDAREYGIGAQILRDIGVRTMRLMTNNPAKFIGLKGYGLAVVGRVPVISPITEENQKYLETKRTKMGHVYGSDLPGSLPEFANPQDTPTEQEDDNQN

SEQ ID NO: 7412 - protein, 539 aa, Mesoplasma florum L1
MRNEVIYQIFPLTFSDGKKKGKGNIKGIINKLDYLKSLGITRIWISPFTKSPFKDSGYDVSDYCGINEEFGTMEEVEILISEAKKRDLTIVLDIVFNHTSDQHEWFKKALAGDEKYMNYYIFKDPVDGKEPTNWKSKMGGLSWEFVPNLNKYYLHLFTKEQPDLNWENPEVRNELINILKFWKDKGISGFRLDVCNLYSKPTLFENDEIGDGRRFYTDGVKVEEYFNLMHNEVFGTDNEIFTVGEVSSTTKEKSAKYAKVENKELDSVFTFLHLKVDYENNDKWTNVKPDLNLFWKLQKEWQEYYQLENSTLALFMNNHDQPRAVSRFGNVDKYWYESATSIFAFTSLMRGVPFIYQGEEIGMTNLTFNNLNEFKDVESIGNANDLLKIKSEEEVLDILRIKSRDNARSVMQWNDEFNAGFSEKENIDLFVNKNYKTINVKNQLNDDKSVLNFYKKVINLRLNEEVFNDGTISFFENQDYAYCRKLKDKEIIILTNWTTENKLIKLKLDSNNWKIILNNYEDFSFDSLKPYQVIAIERK

SEQ ID NO: 7413 - protein, 128 aa, Prunus avium
RKPSNCNGSQFKRLPPQLISKLKISWPNVESSNDTKFWEGEWNKHGTCSEQTINQLQYFERCYEMWKSHNITEILKNASIVPHPTQTWTYSDIVAPIKAATKRTPVLRCKPDPAQNKNGLLSQQCTST

SEQ ID NO: 7414 - protein, 532 aa, Mesoplasma florum L1
MNVKKPVILAILDGWGIEEAGVGNAVANADQKFVKEMMGMYPWVKAHASGEWVGLPEGQMGNSEVGHIHLGAGRINMESLAKLNHEVKVDGFLTNEVLVDTFKYVKEHNSALHLMGLFSDGGVHSHMNHMISMYKAAVKFGLTNIKFDLITDGRDTAPKVAEQYINQLLQVIKDNNNIGEIASISGRYFAMDRDKRFERSAAAYITMTERKVDQPKFTDPIEYVKAAYENGLDDEMIVPAYNASVVDSELKANDAMIFTNFRPDRAIQMASIMTNNNYPAWNDEAFKDVEFIGDKIRFVSTMKYADSVTSQFIAYPPTPLTNTLGEYISSLGLKQLRIAETEKIAHVTFFFDGGNDYFKNGLAKPEEISLPHASIDLISSPKVATYDLKPEMSAVEITDKLLEEVKKDEFDLIVLNFANCDMVGHTGNNDATVKGVKVLDEQLKRIHDEFVLKHNGVMVITADHGNAEIMIDETGGPNKKHTTSLVPIIVTDKTIELSDFDPAIAKVAPTILDIMGLEIPKEMTQPSMIIKK

SEQ ID NO: 7415 - protein, 429 aa, Xanthomonas campestris pv. vesicatoria str. 85-10
MNHSRSHALFAQAQTLLPGGVNSPVRAFKSVGGEPFFVARADGPYLFDVDDNRYIDYVGSWGPMIAGHNHPAVREAVERAIGNGLSFGAPCAAEVTMAQTITRLVPSCEMVRMVNSGTEATLSAVRLARGATGRNRIIKFEGCYHGHGDSFLVKAGSGMLTLGVPTSPGVPAGLSELTATLSFNDFEGATALFDEIGAEVAAVIIEPVVGNANCIPPQAGYLQHLRTLCTRHGALLIFDEVMTGFRVALGGAQAHYGVTPDLTTFGKIIGGGMPVGAYGGRRDLMEQVAPAGPIYQAGTLSGNPVAMAAGLAMLELVQEPGFHTRLSEATSMLCEGLEDAARAAGIAVTTNQVGGMFGLFFTDDIVESYAQATACDITSFNRFFHAMLQRGVYLAPSAYEAGFMSSAHDQAVIEATLAAAREAFADVAR

SEQ ID NO: 7416 - protein, 379 aa, Triticum aestivum
HYRTSLYKKAGWYRSGIPGISSTHASARTIPVKKTGMYNMYFIHCDPALAGLEIDGKTIWKNPTGYLPGRMAPLKNFFGLMSFAFVILGIYWFYQYMKFWREVLPLQNCITLGHAVGMLEMALWYFEYAEFNETGVRAKAITFWAVTFGTIKRTVARLIILIVSMGYGVVRPTLGGLTSKVVMLGGTFFVATEILELVENLGTVNDLSGKARLFLVYPVAILDASFIVWIFISLAKTLSQLQARRLMAKLDIYRKFTIALAITVLVSIGWIGYEIYFKSTDVFNERWQYAWIIPAFRHALSGSLLCVISYLWAPSQSSMRFTNDASEKFDREDSLSLIRPRPIVSNNGWSIASSTDVKMTKNTDSVTSFDEDDEENKRE

SEQ ID NO: 7417 - protein, 308 aa, Ustilago hordei
MPGYTLAVIGCGTMGVAILSGVLDSQRSQQAQAAASMASSVSSLHDSSAGDDLTELPNRYIATVNRVESVRRLNKTFAQYPDIEIHAGKNVQAARDADVILLGCKPQMVQDIIAEEGMKEALDGKLVISICAGLRISQITEWVTPKTKVVRAMPNTPCKIREGMTILTPLSPNLPNAELDRSILLSIFSAVGKSRFLDEKHFDACTALAGSGPAFACVFLEAMADGGVMMGLPRTEALELAAQTMQGAARMVMQSGMHPAAIKDSVTTPGGCTIAGLLNLEDGKVRSTVARTIQAAAEHASGLGQTKK

SEQ ID NO: 7418 - protein, 547 aa, Oryza sativa
MPSMRVTTDTWPRRAAQEPLLLLLLRSSLMKSASLQALNPNRAMAAMGRSVRVVLDSSVLLDPSGVTAEEEEVVVALRPGAEALLRRLRYSNLRVAICHPEGLPTNESGFLEKTAKLYSFGYMPLTSPSGSNLLNELMLEWSGTNFCFYVTSGVHEGLLSELQNHNWEVIAMGNEDVIKNSGVIHISMLQELLITLATSIKKEIGNSSAFVVGYVMKQSREEDFAKRGAFPIYPSKNDLIFVPLSFELPLASQLQEVDLVLHKITDEIINIDPNSSISFPKGISFSPGMSEIIRFVEEHCDFCVIDPFKNIYPLLDRIQIQEILIRLEGLSAEGRPKLRAPCFLKIESFCGSELQKQLAEAKLSFPLIVKPQVACGVADAHNMALIFKIEEFSNLSVPLPAILQEYIDHGSKIFKFYAIGDKIFHAIKNSMPNASHLKSSSGGKPLTFNSLKTLPVATKEQLLQNEVQDSKLLDINLVEEAAKLLKELLGLTIFGFDVVVQESSGDHVIVDLNYLPSFKEVPDNVAMPAFWDAIKQSYESRKQMTQT

SEQ ID NO: 7419 - protein, 275 aa, Mesoplasma florum L1
MLLSFLFHWFSYCYIIKNVQKNKRRNIMRQKVIFGNWKMNGTNAELVTFLKKVDKAAKKSDVVAGLGLPFTLLSKGIEKAKNVKVAAQNVHFAEKGAFTGEVSISMLQEVGVQYVIIGHSERREMFAETDETVNKKATALLAAGITPIICCGETLETKEAKKTVTFVNAQIKKAYKGISAEDALKTIIAYEPIWAIGTGKTATSEDAEKVCEAIRKNLTKIYDEKTAQQITIQYGGSVNPSNIAELMSQPNIDGALVGGASLKADDFIALINYKK

SEQ ID NO: 7420 - protein, 439 aa, Arabidopsis thaliana
MASDADMEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAETDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVC

SEQ ID NO: 7421 - protein, 405 aa, Porphyromonas gingivalis W83
MEEIKLNTIEEALEDFKEGKFLIVVDDEDRENEGDFIIAAEKITPDKVNFMMHHGRGVLCAPISEERAHELELEMQVPDNTSVHETPFTVTVDRLGNGCTTGVSMYDRAQTILALADPNTRPSDLGRPGHICPLRARSRGVLRRAGHTEAAVDLARLCGMQPAAALIEIINEDGTMARLPQLWEVSKRFGLKIIAIKDLIAYRLKQESIVEKGVEVDMPTEYGHFRLIPFRQKSNGLEHIALFKGTWDENEPILVRMHSSCATGDIFGSMRCDCGGQLLQAMEKIEKEGKGAIIYLNQEGRGIGLMEKMKAYKLQEQGMDTIDANLCLGHKADERDYGIGAQILRLLGIKKMRLMTNNPVKRIGLEAFGLEIVENIPLETAPNRYNEFYLRTKKERMGHELHNIK

SEQ ID NO: 7422 - protein, 314 aa, Oryza sativa
WSPCSVDGGGGCGGLDTQIEQLMQCRPLAEQEVKALCEKAKEILMEESNVQPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 7423 - protein, 294 aa, Oceanobacillus iheyensis HTE831
MTTNKYIATPSRTKDILGKYHFTFKKSLGQNFLVDVSVLQNIIRHAGITKDTAAIEIGPGIGALTEQLAIHADQVVAFEIDQRLLPILQDTLGEYSNVSVIHQDILKADVTKVIDEHFKEGQEVHVVANLPYYITTPILMKLIRDRLPVTSLTVMIQKEVADRMSGEPNSKSYGSLSLAVQYYSEAKVVMNVPKQVFMPQPNVDSSILQLTMRKQPPVEVTDEDFFFEIIQASFAQRRKTLKNNLTRFFKGVHDKEKIDHILQEAGVEGIRRGESLTMEEFAQVANTFYQYQSK

SEQ ID NO: 7424 - protein, 417 aa, Arabidopsis thaliana
MAATAATTTSSHLLLSSSRHVASSSQPSILSPRSLFSNNGKRAPTGVRNHQYASGVRCMAVAADAAETKTAARKKSGYELQTLTGWLLRQEMKGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 7425 - protein, 362 aa, Triticum aestivum
  misc_feature (179)..(179): Xaa can be any naturally occurring amino acid
  misc_feature (225)..(225): Xaa can be any naturally occurring amino acid
  misc_feature (288)..(288): Xaa can be any naturally occurring amino acid
  misc_feature (295)..(295): Xaa can be any naturally occurring amino acid
  unsure (1)..(362): unsure at all Xaa locations
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLXVPIVEPEILVDGPHDIDRCAYVTEVVLAACYKALNDQHVLLEGTLXLSPTWVTPGSDSKKVAPEVIAEYTVRTLQRTVPAAVPAIVFLSGGQSEEEATLNLNAMNKLQXQKPWNLXFSFGRASSRAPQAWSARRKREKPGRRPGRCRASRHSHYRYAPREGSKLSQINSLLLDLPWAPYIKLV

SEQ ID NO: 7426 - protein, 283 aa, Glycine max
CFSFLQAKTLEKTQLILQQLKHQIRKGIPIIGAGAWTGISAKFEEAGGVDLIVLYNSGRFRMAGRGSLAGLLPFSDANAVVLDMANEVLPVVKVPVLAGVCATGLFRRMDYFLKQVESTGFSGLQNFPTVGLFDGNFRLNLEETGMGYSLEVEMIQKAHKMGLFTTPYAFNQYEAIEMAKVGADIIVAHMGLTTTGSIGAKTSVSLKESVVHVQAIADAAHRINPGVIVLCHGGPISGPKEAAFVLKRTKGVHGFYGASSMERLPVEQAITNTVKQYKSISIH

SEQ ID NO: 7427 - protein, 402 aa, Rickettsiella grylli
MKTQPPNINSALEDLRLGKMVILFDHENRENEGDLVLAAEKVTPRAINFMAQHARGLICLALAEEDIKRLQIPMMVENATNPFNTAFTASIEAAKGVTTGISAADRAHTIHVAIDPKSGPQDIVMPGHIFPIRARKGGVLARMGQTEGSTDLVRLAGLNSAAVICEIMNPDGSMARFPDLERFAKQHQITLLSIRDLIQYRLQTESLVKEIASIHLPTKDYGDLTIKLFESQLDKHHHLAIIKEKIKKSYHPTLVRIHSECFTGDLFGSTRCDCGWQLHESLTQISEHGGALLYLRQEGRGIGLLNKLKAYALQDQGFDTVEANQKLGFGSDDRNYWIGAQILQRLKILKIKLLTNNPQKIIDLKQYGIEITERVPLIATPSPTNLTYLKTKQSKLGHLLNL

SEQ ID NO: 7428 - protein, 117 aa, Prunus avium
TSPVIAGGSLFETRKLSPDLQSKLKRSWPNVETDNDTKLWEHEWNKHGTCSEGTLNQTQYFQRSHSMWRSYNITDILRKAQIVPDATQTWKYSDILSPIKTATRRTPLLRCKRILST

SEQ ID NO: 7429 - protein, 306 aa, Ralstonia solanacearum
MSARNGFTEADVPDQSGKGFIVTGANTGLGLETSRVLAARGARVLLACRDRSKAEAAMAHIRQTHPGADLAFLPLDLADLASVRAAAGQAMTAPRIDALINNAGVMMPPLMRTTQGFELQLGVNHLGGFALTALLLPKLAQTPGSRVVVTSSLAHRGASIDWDDLSAATRYNRVKRYGASKLANALFFFELDRRLRASGSPVTAVGCHPGAAVTDLVRYMGALQLLQPLVRRFLNTAAMGAWPTLQAATGPVQPGGYYGPTGLRGIRGPSGRATRSAQAQDPLLAQRLWDVSIAMTGIDPGLPVEN

SEQ ID NO: 7430 - protein, 258 aa, Sinorhizobium meliloti 1021
MRIGFIGTGAITEAMVTGIVGSGLDVAGILVSPRNREIAARLAGRFPLVRIVKDNQQAVDAADVLFLAVRPQIAEDVIPKLKFRKGQKIVSVIAATDRSTLLGWIGEEVELTQAIPLPFVAEREGVTAIYPPNRAVAAIFAALGTAVECETREEYDLLAVGSALMATYLGILDRTTAWFAEKGLHRDKARAYIAPLFASLAQRAVRDEGTPLEELAREFSTKGGLNEQVLTDFDRGGGHGALTDALERVLLRVRGDDR

SEQ ID NO: 7431 - protein, 477 aa, Burkholderia thailandensis E264
MRVARIAAVADCAYGADGASARPFPSHVGRGQADVGFWTLAPLARGLPSEGSLQVRPMRVRAGRATRGAPPTRHGDEAMSSNRGVVYQGPGKVEVQKIDYPKMVDPSGRAIGHGVILKVVSTNICGSDQHMVRGRTTAPVGLVLGHEITGEVVEVGRDVETLRIGDLVSVPFNVACGRCAMCKEQHTGVCLNVNPSRAGGAYGYVDMGGWIGGQAEYVLVPYADFNLLKFPDRDRAMTKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAEEAPATVLNSLMEITRPAGAIGIPGLYVTDDPGAADAAAKHGSLSIRFGLGWAKSHSFHTGQTPVLKYSRNLMQAILFDRLPIAQIVNVTVISLDDAPEGYRKFDGGAPRKFVIDPHGMLKAA

SEQ ID NO: 7432 - protein, 473 aa, Synechocystis sp. PCC 6803 [sequence omitted]

SEQ ID NO: 7433 - protein, 428 aa, Vibrio cholerae
MLQATIERLQGLPIAEPIVISNEDHRFIVAEQIRRYGKKSRIILEPAGRNTAPAIALAAFTAIEQEDDPVLLVLAADHFVKNKSAFQAAISQAAQQAEAGKLATFGIVPTTPETGYGYIHRGEEVTQGTYEINSFVEKPQLNIAEQYLASGEYYWNSGCFMFKASVFLNELKQHSPEIYRQCELAMQGLSHDYDFIRVGVEEFLKCPDDSIDYAVMEHTKLGVVVSMDAGWSDVGSWSALWEVSDKDADGNVCQGDAILSGTSNCYIYAPNKLVAAVGLKDIVVVETKDAVLVADKNQVQEVKKIVEHLKAENRAEYREHRERYRPWGKSDAIDKGERYKVNRITVEPGKKQSLQMHYHRAEHWVVVSGTAKVTCEGNVKVITENQSLYIPIGTNHMIENPGKIPLELIEIQSGSYLNEDDVVRFEDK

SEQ ID NO: 7434 - protein, 437 aa, Nostoc punctiforme PCC 73102
MKTNQIPPGSFGLPVLGETLSFVFDRDFAKKRYHQYGPIFKTHLLGRPTVVMAGPEALEFVLSSHIENFSWREGWPDNFKTLLGESLFLQDGEEHRRNRRLMMPALHGPALASYFSTMEDITRSYLQKWEKKQEFTWFQEFKQLTFDIASQLFLGTRPGPECVRLSQLFTTLTNGLLAINPLPLPFTTFGKAIAARNEILEHLTQVVRERQQNPTQDTISLLIKAKDEDGNSLSEKEIIAQAVLLLFAGHETTTSMLTWLCTELACHPEVLEKARVEQLQLASQGDLDLEQLGKMPYLEQVLWEVERLHQPVGGGFRGVIKDFELNGYHVPTGWQLYYSIGVTHQIEEIYSEPELFDPDRFSPQRQEHKKYPFSLVGFGGGPRICIGIAFAKMEMKIVAAHLLRSYHWEILPNQSLEVVAVPTNRPKDGLRVRFQPR

SEQ ID NO: 7435 - protein, 293 aa, Nostoc punctiforme PCC 73102
MAITQNYRLNVIQWYPGHIAKAEKKLKEQLKRVDVVFEVRDARIPLATHHPQIGEWVEGKTRVLILNRVDMITPQMRSLWIDWFKRQGEVPYFTNAQHGKGIAEVARAAQAAGVELNQRRSDRGMLPRPVRAVVIGFPNVGKSALINRLLGRRVVESAARPGVTRQLRWVRISEHLELLDAPGVIPLRLEDQDAALKLAICDDIGEASYDNQLVAAALVDLFNYLEAVTTDLLPKKPLQSRYQLDSTSDTGDTYLHALAEHRYKGDVERAARQLLTDFRKGLLGEMSLELPPN

SEQ ID NO: 7436 - protein, 294 aa, Debaryomyces hansenii CBS767
MAVTLKNNTDTVTLNNGDKIPAVGLGTWQATEKDAAYKSVKAALQNGYRHIDTAAIYGNEEEVGRGIKDSGVPREEIYVTTKLWNADHKKAEEALNTSLKKLGLDYIDLYLIHWPYSVQPDTKQPYSDWDYLDTYKELQKLKATGNVKAIGVSNFTVKQLERLLADKDITIKPAVNQIEAHPLLTQPELTEYLKKNDIVIEAYSPLGSSNSPLFKNETVVAIAEKYQVEPAQVLVSWAIQRDTVVLPKSVTESRIISNLKTFKLSDEDFNTLNNLSQKDGVVRTCNPEFNDFDD

SEQ ID NO: 7437 - protein, 107 aa, Glycine max
  misc_feature (92)..(92): Xaa can be any naturally occurring amino acid
  unsure (1)..(107): unsure at all Xaa locations
MASSMISSPAVITVDRACAGMVAPFTGLKSMAGFPTRKTSNDITSIAINRGKVHCMHVLPPIGNKMFETLSYLPYLDDAQLAKEVEYLLMKXWIPCLEFELEHRFAY

SEQ ID NO: 7438 - protein, 277 aa, Yersinia pseudotuberculosis IP 32953
MTMQPLIKLHDGRLMPQLGLGVWQASIQETELAVSKALEVGYRSIDTAAIYKNEEGVGKALKAAAVARDELFITTKLWNDDQHNPQQALETSLQKLQLDYIDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 7439 - protein, 80 aa, Brassica napus
MPPKQQPKADLAKKQKQVEDKTFGLKNKNKSKNVQKYVQSLKQSVQPKPDASKAAAKKKKEEEKAREQELNELFKVAISQ

SEQ ID NO: 7440 - protein, 479 aa, Pseudomonas aeruginosa UCBPP-PA14
MLIPVVLSGGAGTRLWPVSREGQPKPFMRLPDGQTLLGKTYRRAAGLLAGHGEIVTVTNREHYFQSKDQFQAARLGRHRGHFILEPTGRNTAPAIAVAALALQAEHGDAAVLVVMPADHLIRNEEAFREAVGHAARLAVAGHLVTFGVVPDAAETGFGYIELGDRLDEQGAAKVRRFVEKPDEETARRYVESGGFLWNSGMFCFTASTLVDELAQHAPALLEQARACLAASAAVKMADGIQHELAGEAFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 7441 - protein, 633 aa, Cytophaga hutchinsonii ATCC 33406
METIEKVPYFVIDFDSTFTQVEALDELATISLAGNPNQQQIIQQIIDLTNLGMEGKGSFSENLVKRLQLVKANRSHLAPLIDLLRSKVSKSVKRNKHFFRDYADQIYIVSSGFKEFILPIVTEFGIKEEHVMANTFTFDNDGNIIGCDANNPLSQDKGKIKLMEKLGLTGDVHVIGDGYTDYEIRGAGLASKFYAFTENVSRAAVTAKADSIAPSFDEILFQEKLPMTISYPKNRIKVLLLENIHTDAFKLFSEEGYTVEVIASALEEDELIEKIKDVSIIGIRSKTTITAKVLEHAPKLIAIGAFCIGTNQIDLKAAQMKGVAVFNAPFSNTRSVVELAIGEIIMLYRRTLEKSMQMHAGKWDKSAKNSFEIRGKKLGLVGYGNIGSQLSVIAESLGMVVYYYDIVERLSLGNAKKCSSLKELLNTVDVVSLHVDGRASNKGMFGAKEFNEMRQGSIFLNLARGPVTDLKALSENLKSGKILGAGLDVYEYEPKNNDEEFINDVRGLPNVILTPHIGGSTEEAQSNIGNFVPNRITDYINNGTTLHSVNFPNIQLPELQEGHRFMHLHENQPGILAKINNLFAKHNINILAQYLKTNEQVGYVITDIAKIYDKEVLDELKEIPGTIRFRTLY

SEQ ID NO: 7442 - protein, 248 aa, Glycine max
CFDLILLQNGTTEEVKKIVTTLNEAKVPGEDVVEVVVSPPFVFLPVVKSLLRPDFHVSAQNCWVRKGGAYTGEVSAEMLVNLGIPWVIIGHSERRQLLNESNEFVGDKVAYALQQGLKVIACIGETLEQREAGTTTAVVSEQTKAIAAKISNWDNVVLAYEPVWAIGTGKVATPAQAQEVHADLRKWVHDNVSAEVAASVRIIYGGSVNGGNCKELAAQPDVDGFLVGGASLKPEFVDIINAATVKKN

SEQ ID NO: 7443 - protein, 523 aa, Escherichia coli CFT073
MTLEYEVVAMSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTTVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVEGGKLSDIAPTMLSLMGMEIPQEMTGKPLFIVE

SEQ ID NO: 7444 - protein, 390 aa, Desulfovibrio desulfuricans G20
MKISDRLMQVKPSATLAVNAKALELKAQGREIISLSVGEPDVPPPAHIGAAAKKAIDENFTRYTAVPGIPELRDAVAGYFRRFYGVDAAAEHTIVTNGGKQALYNLFQALLNPGDEVLIPAPYWVSYPAMVQLAGGTPVPVASGPETGFKTCVEELQRHMTPRTRVLLLNSPSNPTGACYTRHEIDTIAAWAIENGLFIISDEIYDQLVYAPASPAGLAPWWQSNPEQVCVVNGLAKSFSMTGWRVGYVLAHPDLIKALGKIQGQSTSNVCSIAQKAALAALTGPFDALDTLRESYARRRDIALDIISGWKNVVCPRPDGAFYLFPDVHRLYTDATPDSATLCTRLMESAGVALVPGAAFGDDRCVRISYAVSEQTLRDALSKISNVLFS

SEQ ID NO: 7445 - protein, 458 aa, Geobacillus kaustophilus HTA426
MKLVLLSGGSGKRLWPLSNDARSKQFLKVLETQNGELQSMVQRVWEQLGNVGLADSAVIATSKSQVDMIQSQLGQDVPIIIEPMRRDTFPAIALASVYLYSVEGIRLDEVVAVLPVDPYVEDRFFHRVKDLEETVLASGADLALIGVEPTYPSAKYGYIVPASKSSDSGYLRVSHFTEKPTEEKAAELIKQGALWNCGVFAFKLDYIISLLQEKGFPIQYDELLKQYDKLPKISFDYEVVEKTEHIVVLPYDGYWKDLGTWNTLTEEMATNQIGKGVISADCENTHLINELDIPVTVLGISNAVVAVSPDGILVADKAKSPKIKELVNDFDQRPMYEERRWGWYRVLDYTKFEDGREVLTKRIGVTAGKNLSYQMHHHRSEVWTIIKGEGEFALNGEIRRVKPGDVLEIPVGAKHGIKAITDLEFIEVQTGTQLIEEDIVRIYMTWEEVEANCFSASK

SEQ ID NO: 7446 - protein, 456 aa, Glycine max
MDPCPFVRLTVGNLALKIPVASKPALSVVHPSSSPCFCKIKLKNFPLQSAVVPFIPPESHFPDSQVHPIAATFHLSKSDIDKLAGKSIFAGKLCLKISIYTGRRGTTCGVSSGRLLGRVSVPLDLTGTVAKTTVFHNGWIRIGKDAKGSSAQFHLNVKAEPDPRFVFQFDGEPECSPQVFQIQGNISQPVFTCKFSFRNNGDRNHRSRSLQSEPGGSRSWLSSFGSERERPGKERKGWSITVHDLSGSPVAAASMVTPFVASPGSDRVSCSNPGSWLILRPSDGTWKPWGRLEAWRERGGSDGLGYRFELIPDTNGGMSAAGIVLAESTLSNNKGGKFVIDLSCRNGNVSGNGGSNGRATPGSATSPACSPRSSGDYGYGLWPYCMYRGFVMSASVEGEGRCSKPTVEVSVPHVNCTEDAAAFVALAAAVDLSVDACRLFSQRLRKELCQQLDLIG

SEQ ID NO: 7447 - protein, 406 aa, Azoarcus sp. EbN1
MVRKSAKLANVCYDIRGPVLIKAKQMEDEGHKIIKLNIGNLAAFGFDAPEEIQLDMIRNLPNSAGYSESKGIFAARKAVMHYTQQKHIKGVTLEDIYIGNGVSELIVMAMNALLNIGDEVLVPAPDYPLWTAAVSLSGGTPVHYICDEANEWLPDLDDMRARITPNTRAIVVINPNNPTGALYPDHILQGIVDIAREHGLIVYADEVYDKVLYDGATHRSMGSFSEDVLTILFNGLSKNYRSCGYRAGWMVVCGDKRHAQDYIEGLNMLASMRLCANVPGQYAIQTALGGYQSIDDLVAEGGRMRRQRDLAHELISAIPGVSCVKPKATLYMFPKLDPKLYPIEDDQAFIAELLEEERVLLVQGSGFNWPHPDHFRLVFLPHEDDLRDAIGRIARFLEQYRKRHAA

SEQ ID NO: 7448 - protein, 548 aa, Daucus carota subsp. sativus
MPYHSISSLSLLPIPIRQNLSKHHPPFHQPPHSLPLSIKSSLDNKPPKSNQGSWVSPDWLTSLTKSITLSKDDSNIPIASAKLEDVSELLGGALFLPLFKWMNMYGPIYRLAAGPRDFVVVSDPAIAKHVLRNYGKYAKGLVAEVSEFLFGSGFAIAEGPLWTARRRAVVPSLHKKYLSVMVDRVFCKCAERLVEKLEISALNGSAVNMEEQFSQLTLDVIGLSVFNYNFDSLNADSPVIEAVYTALKEAEARSTDILPYWKIEALCKIIPRQVKAEKAVTVIRTTVEELIEKCKKIVDTEGERISEEEYVNEADPSILRFLLASREEVSSTQLRDDLLSMLVAGHETTGSVLTWTSYLLSKNPSSLVKAQAEVDRVLEGRPPTYDDIKNLKYLTRCINESMRLYPHPPVLIRRAEVADELPGSYKVNPGQDIMISVYNIHHSSKVWDRAEEFIPERFDLDGPVPNESNTDYRFIPFSGGPRKCVGDQFALLEAIVSLAIFLQHLSFELIPDQVINMTTGATIHTTNGLYMKVSKRQIKSAAVSSISR

SEQ ID NO: 7449 - protein, 251 aa, Porphyromonas gingivalis W83
MRKNIVAGNWKMNKTLQEGLALAKELDAALKGRTINCDVIIGTPFIHLASIAAAIDTTRIGVAAENCADKESGAYTGEVSAAMVASTGARYVIIGHSERRAYYHETSPILMEKVKLALSNGLTPIFCVGEVLEEREAGKHFEVVARQVEEALFTLDQTDFAKLILAYEPVWAIGTGKTATADQAQEMHAHIRKSIAAKYGKEVANGCSILYGGSCNAANAKELFSRADVDGGLIGGASLSVDKFLPIIEAF

SEQ ID NO: 7450 - protein, 732 aa, Arabidopsis thaliana
MKVQEGLFVVAVFYLAYTQLVKGQPRKECQTRCGNVAVEYPFGTSPGCYYPGDESFNLTCNEQEKLFFGNMPVINMSLSGQLRVRLVRSRVCYDSQGKQTDYIARRTTLGNFTLSELNRFTVVGCNSYAFLRTSGVEKYSTGCISICDSATTKNGSCSGEGCCQIPVPRGYSFVRVKPHSFHNHPTVHLFNPCTYAFLVEDGMFDFHALEDLNNLRNVTTFPVVLDWSIGDKTCKQVEYRGVCGGNSTCFDSTGGTGYNCKCLEGFEGNPYLPNGCQDINECISSRHNCSEHSTCENTKGSFNCNCPSGYRKDSLNSCTRKVRPEYFRWTQIFLGTTIGFSVIMLGISCLQQKIKHRKNTELRQKFFEQNGGGMLIQRVSGAGPSNVDVKIFTEKGMKEATNGYHESRILGQGGQGTVYKGILPDNSIVAIKKARLGNRSQVEQFINEVLVLSQINHRNVVKVLGCCLETEVPLLVYEFINSGTLFDHLHGSLYDSSLTWEHRLRIATEVAGSLAYLHSSASIPIIHRDIKTANILLDKNLTAKAADFGASRLIPMDKEQLTTIVQGTLGYLDPEYYNTGLLNEKSDVYSFGVVLMELLSGQKALCFERPHCPKNLVSCFASATKNNRFHEIIDGQVMNEDNQREIQEAARIAAECTRLMGEERPRMKEVAAELEALRVKTTKYKWSDQYRETGEIEHLLGVQILSAQGETSSSIGYDSIRNVTTLDIEAGR

SEQ ID NO: 7451 - protein, 195 aa, Glycine max
  misc_feature (188)..(188): Xaa can be any naturally occurring amino acid
  unsure (1)..(195): unsure at all Xaa locations
VHVKKSSECLGGVIGVGGSGGTSLLSSPFASLPIGVGGRAMENLVREGFIQLPIDWACFIYIKRTEVADYIVGGVMACESSRFDAVIENKVPLVLSVGALDMVSFGAKDTIPLKFQQRNIYEHNKQVSLMRTTVDENRKFADFIANKLKNSSSMICVCLTEKCVSALDAPGKAFYDPEASGTLLREYXTYSTNDD

SEQ ID NO: 7452 - protein, 270 aa, Methanococcoides burtonii DSM 6242
MVRKILQKYGIRGGCHDQHFLIDERSLDSIVDQAELSEKDVVLEIGGGIGNLTERLLEKAGKVYVIELDPALVHVLKDRFSDNEKLEIIPGDVLKLDLPKFNKVVANLPYSISSPITFKLFKHEFELGILMYQYEFAQRMVAKANTENYSRLSVNTHYFADADIIMKIPPSAFSPPPEVWSAVVKVVPRPSSFHTEDPQFFLDLVTAVFLQRRKKLRNAIVKGNHLLNVPNIKQIVAELPEEFMSKRAENLEPHELAEIANFIFKMRSTS

SEQ ID NO: 7453 - protein, 556 aa, Synechococcus sp. WH 7805
MPKQQRWWNGAVIYQLIVRSYADGNGDGVGDLQGLSSRLPYLRWLGVEAIWLTPVYPSPLQDGGYDITDFKAIHPDLGDLAAFHRFLTAAHGHGLKVVMDLVLNHTSALHPWFQRARWAPQGTPEREVYVWSDDPHRYADAPVLFRHFESSNWEWDDVAGQYYLHRFLRHQPDLNYANPLVQDEMLEVVDFWIERGVDGFRLDAVPFLCEEENSRCEGLPETHAFLKRLRERVDSHGRDVLLLAEAIQPVQEAAPYLADDELHGAFNFVLTAHLFAAIASGSTEHLRQCLQDAQDAVCGCRWALPLRNHDELWLGDGHLIPEEVIQIIRAGLHQGQGHWLNWGINRRLAPLLNGDPGSNRVLHGLLYSLPGMPCLYYGDELGMGDWPGLRDRDPNRTPMAWTPARNGGFSSAPDPLLVLPPITAPGYDYRVVNVEVQKQLPGSLLNWHRRMLTCRRLLPALRHGDFELLPSVHPSVISYVRCDGSMTVLVAANLSAAGASLQLDLSRWEGERTREVMWGCEYPPASAGWFVYLPAHGFNWWLLGEVEEQNEALQDS

SEQ ID NO: 7454 - protein, 205 aa, Listeria monocytogenes str. 4b H7858
MVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHVQTILRRQSSGEIYVTNNGNYILDIVNQTFRDAEMWQEKLAQIPGIVEHGLFLHYVDIIVCAKANGEIELIKK

SEQ ID NO: 7455 - protein, 139 aa, Brassica napus
MTNFSRSKSTGTTKFPDVKTTRPGPDIYENIHHDDYDYEEEHSTTSTDYYDVSTPLSSHGSRSGPGSGQYTILDIFAAVLKKSLVMSCTMERGDDDVAASMDIGWPTEVKHVSHVTFDRFSGFLGLPSELEPEVPPQAP

SEQ ID NO: 7456 - protein, 341 aa, Escherichia coli CFT073
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMTELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 7457 - protein, 319 aa, Glycine max
  misc_feature (316)..(316): Xaa can be any naturally occurring amino acid
  unsure (1)..(319): unsure at all Xaa locations
MATINLSSATTSLFQSKHRTKRIPRLPTIARITNHIEGTHLNSPNGSPILGNANNSLEVPSNNYISLHSSDVRRKTKIVCTIGPSTSSRDMIWNLAQAGMNVARLNMSHGDHASHLQTIDLVKEYNSQFQDKVVAIMLDTKGPEVRSGDVAQPILLKEGQEFCFTTMRGVSTHDTVSVNYDGFVNDVEFGDVLLVDGGMMSLAVKSKTKDLVKCEVIDGGELKSRRHLNVRGKSATLPSITDKDWEDIKFGVDNQVDFFAVSFVKDARVVHELKHYLKSHNADIHVMVKIESADSIPNLHSILSASDGAMVARGDXGAE

SEQ ID NO: 7458 - protein, 601 aa, Haemophilus somnus 129PT
MVAEGANPLVSVVTLLAAAVVAVPLFKRLGLGSVLGYLAAGLVIGPFGFGLFTDPEGIIHIAELGVVMFLFIIGLEMKPSHIWGLRNHIFLLGAFQITLCTSALTYIATLFGFDWKVAFVAASGFVLTSTAIVMQELSERNDLTSPRGQRIISILLFEDLLIVPLLAFVAFLSPDKVTSTDPLWHKIAISGGAFAVLVAAGLWLLNPLFKILAKTKTREVMTAAALLVVLGSALLMEEGGLSMAMGAFVAGVLLSESSFRHQLEADIEPFRGLLLGLFFLGVGMSLDLSVVAENWFLIIFGVLVFMLVKGFIIYLIALITKTGNANSIDRAFIMAQGGEFAFVLFSSAASQNVISKEMQANMTAIVVLSMILTPLFIIAQKKYIIPRLKPTQPERKADHIDEQHPTILIGLGRFGQVVNRMLVMTGHHPTIIDKDANLIAGMKKLGIKCYYGDAARPELLHAAGVENAELLIVAIDNSEQTLQIVEQARKMNPQIKIIARAHDRIHVYNLYGAGANIQIRETFDSALRTSKQALLSLGMNEDIVAEIGDVYFRKDCHSVKLMAEVYDPKLSRFENKELIQIALDVDQEMMAEIQQIMKKEH

SEQ ID NO: 7459 - protein, 447 aa, Fagopyrum esculentum
MPTSLLFLLFLLLQAASAAAATFPLSISPSALDKWESINLAALSSLSRARHLKRPPTLTGKVTLPAYPRSYGGYSVIFSLGTPPQKVSLVLDTGSSLVWTPCTIPTATYTCQNCTFSGVDPTKIPIYARNKSSTVQSLPCRSPKCNWVFGSDLNCSTTKRCPYYGLEYGLGSTTGQLVSDVLGLSKLNRIPDFLFGCSLVSNRQPEGIAGFGRGLASIPAQLGLTKFSYCLVSHRFDDTPQSGDLVLHRGRRHADAAANGVAYAPFTKSPALSPYSEYYYISLSKILVGGKDVPIPPRYLVPSKEGDGGMIVDSGSTFTFMERIIFDPVARELEKHMTKYKRAKEIEDSSGLGPCYNITGQSEVDVPKLTFSFKGGANMDLPLTDYFSLVTDGVVCMTVLTDPDEPGSTTGPAIILGNYQQQNFYIEYDLKKQRFGFKPQQCDRSKN

SEQ ID NO: 7460 - protein, 427 aa, Sulfolobus tokodaii
MDKRRCTFLSENLWKKALELFAGGVNSPVRAAVKPYPFYVEKSEGAFLYTIDGQRLIDYVLGYGPLILGHAHPYVKKKIIEQIEKGWLYGTPSKKEIELAEKIRSHIPSAEKIRFVNSGTEATMLAIRLARGYTKREKILKFDGNYHGAHDYALINAGSAVSEFNVIISSGIPTSIINTVIVCKYNDLDCVEKHLRTEEIAGVIVEPVMGNMGVILPEQDFLNGLRELTKTYNSVLIFDEVITGFRLGLSGAQGYFKVIPDLTTLGKIIGGGLPIGAVTGKKEIMSNLTPEGKVFNAGTFNANPLTMAAGIATIEVLETTNAYDIANKASKEIAEELDNSLSKKNFKYTINRIQSMFQFFIGISKVTNADDARLANKDLYVKIHEKLLKLGVFIPPSQFETIFTSSSHSDEIVNLTIEAIHKVVSEI

SEQ ID NO: 7461 - protein, 473 aa, Bacillus anthracis str. 'Ames Ancestor'
MMNQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 7462 - protein, 354 aa, Synechocystis sp. PCC 6803
MTGSFFCYLFPRSFSMLKIGINGFGRIGRLVARIAMANPQVTLVGINDLVPASNLAYLFKYDSTHGSYGGTVVAKEEGIVIDDQFIPCFSQRDPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 7463 - protein, 184 aa, Zea mays
SRLFGAVDGVFCMFQGTIANVAVLKQQYGLSKGANEVSIIIEAYRTLRDRGPYPADQVVRDISGKFAFVLYDCSTKSVFMAADTDGNVPFYWGVDTDGRLVVSDDAELVKSACGKSCAPFPKGFFFTTSGGLRSYEHPMHEVKPVPKVDSKGEVCGTTYTVDASARKETTIPRVGSAADWSSQY

SEQ ID NO: 7464 - protein, 594 aa, Thermosynechococcus elongatus BP-1
MSNQPLQRRTKIVATIGPAVSHPDKLRAIIQAGATTLRLNFSHGTHDDHQRSIRLIRQISYELGQPVGILQDLQGPKIRLGRFEHGSISLKRGDRFTLTSRPILGNQHISSITYPPLAQEVPAGATILLDDGRVEMLVEEVDKEAGELHCQVIVGGTLSNAKGVNFPGVYLSIKALTEKDREDLMFGLNQGVDWVALSFVRNPQDVLEIKELIANAGKQVPVIAKIEKHEAIEQMDAILSLCDGVMVARGDLGVELPAEDVPILQKRLIAAANRLGIPVITATQMLDSMVKSPRPTRAEISDVANAILDGTDAVMLSNETAMGEYPVEAVKMMATIAARIDNQPQLRQPPGAESTAVRSIPSAISQAVGQVAAQLHAKAIITQTKTGATARNVSKFRPQIPILAATPHIEVARRLQLVWGVEPLLTLDHPSMRESFQAAINAAQERGFLEEGDLVVMTAGTLQGVSGSTDMIKVELVTSVMGRGCGIGHGSVSGPARVVRQGMPVRTFNRGEILVAERTSAELVEVIRKAAGIITEEDSLTSHAAVLGLRLGIPVIVGVKNATRLIREGTILTMDVERGVVYSGARNGGERSPE

SEQ ID NO: 7465 - protein, 1031 aa, x Tritordeum sp.
MERARRLASRALLRRLLAASSSATSPAPSRGVSTLAPKPAAGSRPRARPAHQYTPGCPVSVSALQPSDTFPRRHNSATPAEQAVMASECGFNTLDALIDATVPAAIRAPPMQFTGKFDAGFTESQMLEHMAHLASMNKTYKSFIGMGYYNTHIPAVILRNLMENPAWYTQYTPYQAEIAQGRLESLLNYQTMVADLTGLPMSNASLLDEATAAAEAMAMCLGIVKSKKKTFLIASNCHPQTIDICQTRATGFDINVVVSAAKDFDYSSGDVCGVLVQYPGTEGEVLDYAEFVKDAHAHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASAAMCGMKIVAVGTDAKGNINIEELRKAAEANKDNLSALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTDPLGSISAAPWGSALILPISYTYIAMMGSQGLTEASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAEVENGKADAHNNVLKGAPHPPQLLMGDAWTKPYSREYAAFPAAWLRGAKFWPTTCRVDNVYGDRNLICTLQQASQVAEEAAAATA

SEQ ID NO: 7466 - protein, 175 aa, Triticum aestivum
MAPTVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 7467 - protein, 434 aa, Synechococcus elongatus PCC 7942
MDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDANGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 7468 - protein, 773 aa, Cryptococcus neoformans var. neoformans B-3501A
MNTHLAARLQHLASSYPPHTALFYARIWHTLAPTTDSNHDSLHALALAFLQAAEPYSAIHLVRDHTGLDNLDLDLEIRFERTDKVCGGCAMIVARCCEKLGRYSEGQAVLARALKRGANISRFGCNVDEYPVLTLDRFSIACTLIECCNGISTPGQPVTQRKALDEDPWMWEAFTNLCDVGRLKSFDVSLFQPIRELTKHSQGAPPPIESLFPAGAGLSLSRHASRSSRPPLSPNIHRQKSPIEPAPGVLRLHQAQAGAGNSGGLFTPDVEGIGGKTGLGMMGNPSSWDSSSIIGDTTFAVPEQPTKRPFPSFMSTATSFLPSSLRGGTSTPAGSDSPPKLPTMKRPRGKDPVKRPMETPQSQMSSGLPLAKELRPNGAKYEDSDAPRRSSRLKTTTSKPAPKIPRDPHATRSRSVTSSNSNNEVPSPPSLTSQDAILQREADEYLKDIVKKCARVYKSLSRYQCQQAIKEVDALPGELKTSPWAMEILGRAFYEIANYAMARRAFTFLQQQEPYRIQSMEQLSTLLWHLTDLPALSHLSQSLISISRSSPQAWIAVGNCFSLQKDHDEAMRCFRRATQVDEGCAYAWTLCGYEAVEMEEYERAMAFYRTAIRTDARHYNAWYGMGLVYLKTDRPRYAEHHFRRAVEINPTNPVLLCCVGMALEKSDDVVQALHFYERASKYAPTSAMVQFKRIRALVALQRYDEAISALVPLTHSAPDEANVFFLLGKCLLKKERRQEATVAFTNARELEPKLEGVINAVLAANGEEGEDEE

SEQ ID NO: 7469 - protein, 317 aa, Triticum aestivum
  misc_feature (154)..(154): Xaa can be any naturally occurring amino acid
  misc_feature (233)..(233): Xaa can be any naturally occurring amino acid
  misc_feature (246)..(246): Xaa can be any naturally occurring amino acid
  unsure (1)..(317): unsure at all Xaa locations
MEGSISGPSEKRVAVVTGGNRGMGLEICRQLAGHGLAVVLTARDDKRGAEAAETLREEGLSDVAFHQLEISEPASAARLAAFVKKKFGKLDILVNNAGVLGVTTDVGDPATLQETLAGKDGMERAEWLRQRTTQTTQDAEDCLRINYHGNKTVXRKPLLPLLPIILRRAESVNVTSARGAAQVFHRATSSGRELDDVANLKTKRLDEMSDQLFQEQTGKGNGALKHPRWPPDXGVYAAYMASKALXCAYTRVIAREEGAALRVNCVHPGYVLTGMNDYTGVLTAAEGAAAAVAVALAEKGGVTGAYFDRTELGASFV

SEQ ID NO: 7470 - protein, 284 aa, Plasmid pNG2
MSAYGQGRHEHGQNFLTNHKIINSIIDLVKQTSGPIIEIGPGSGALTHPMAHLGRAITAVEVDAKLAAKITQETSSAAVEVVHDDFLNFRLPATPCVIVGNIPFHLTTAILRKLLHAPAWTDAVLLMQWEVARRRAGVGATTMMTAQWSPWFTFHLGSRVPRSAFRPQPNVDGGILVIRRVGDPKIPIEQRKAFQAMVHTVFTARGRGIGEILRRQGCFHHVQKHNHGCAREESTPRPYLPDCYTNDWIDLFQVTGSSLPHHRPISPSGSSQRPPQRKNRSRRR

SEQ ID NO: 7471 - protein, 456 aa, Methanococcoides burtonii DSM 6242
MWPLSREYYPKQFLKLGKSSLFQDTFLRCLKLSECSDIFVVTNETQKFFVLGQIKELGYDLPVENVLIEPVGKNTLPAIFFGMHEINERFGKSIVGIFSSDHVLDADSMETIADASNLASDYLVTFGVVPSSPHTGYGYIHPGNDIGFGNEVLEFKEKPDGEIAKMYVKQGYLWNSGMFLFDTDIFFEEVRKYEPSMFDAFCGDEGVIRNIVSIYSSLPSISIDYGIMERSNKVAVVKLEHKWSDLGNFDAIYGESDKDDHSNAVYDCDSNFISSNGNLVYSKPDKIVSLIDINDMVVVDTPDALLVCPRKSSQKVKDVVNSLSVEGDERISLHQTVYRPWGTYTILESTERHKIKNITVMPQKKLSYQLHHHRSEHWVVVEGIACVQIEGKHFYLRQGESTFIRPGDKHRLLNPGKLPLEIIEVQLGESVDEDDIVRFDDEYGRVNDSSSVEDRI

SEQ ID NO: 7472 - protein, 76 aa, Escherichia coli
MKDNTVPLKLIALLANGEFHSGEQLGETLGMSRAAINKHIQTLRDWGVDVFTVPGKGYSLAEPIQLLNAEQILGQL

SEQ ID NO: 7473 - protein, 321 aa, Medicago sativa subsp. x varia
MDDTVLDDIIKKLVSAKNGRTTKQVHLTEADIRQLCTSAKEIFLSQPNLLELEAPIKICGDVHGQFSDLLRLFEYGGYPPEANYLFLGDYVDRGKQSIETICLLLAYKIKYKENFFLLRGNHECASINRIYGFYDECKRRYNVRLWKTFTDCFNCLPVAALVDEKILCMHGGLSPELKNLDQIRNIARPIDVPDHGLLCDLLWADPDKDLEGWGENDRGVSFTFGADKVVEFLEHHDLDLICRAHQVVEDGYEFFAKRKLVTVFSAPNYCGEFDNAGAMMSVDDSLTCSFQILKSSDKKGKVGFGNNSSRPGTPPHKGGKN

SEQ ID NO: 7474 - protein, 438 aa, Mycobacterium sp. JLS
MGAHHTATEQSARLFADACAVIPGGVNSPVRAFNAVGGTPRFITSANGYWLTDADDNRYVDLVCSWGPMILGHAHPAVVEAVQRVAADGLSFGAPTPSETELASEIISRVAPVERLRMVNSGTEATMSAIRLARGFTGRPKIVKFSGCYHGHSDALLADAGSGVATLGLPSSPGVTGAATADTIVLPYNDVDAVDEIFEQVGDQIAAVITEASPGNMGAVPPEPGFNAALRRITEEHGALLILDEVMTGFRVSRSGWYGLDPVDGDLFTFGKVMSGGLPAAAFGGRAEVMERLAPLGPVYQAGTLSGNPVAMAAGLATLRTADDAVYAALDKNADRLAGLLTDALTDAGVTHRVQRGGNMLSVFFTAEPVGDFATARASETWRFPPFFHALLDAGVYPPPSAFEAWFVSAALDDEAFDRIAAALPGAARAAAEASRPA

SEQ ID NO: 7475 - protein, 660 aa, Thermococcus sp. B1001
MYKIFGFKDNDYLGKVGITEFSIPKSGSYAYLLGNFNAFNEGSFRMREKGDRWYIKVELPEGIWYYTFSVDGNLILDFENNEKTVYRRLSYKFEKTVNVAKIFSGEKFYHYPSLVYAYSLGDSTYIRFRAMKGVAKRVFLISDQKYEMRKKAQDELFEYFEAVLPRKEGLEYYFEIHEADEIIDYGDFKVDFNEQKERFKPPAWVFERVFYQIMPDRFANGNPENDPHNCIEFKTITHHGGDLEGIIEKLDYIEELGVNALYLTPIFESMTYHGYDIVDYYHVARKFGGDEAFEKLMQKLKKRDIKLILDGVFHHTSFFHPYFQDVVKNGKNSKYKDFYRIISFPVVPEEFFEILNSKLPWDEKYRRLKSLKWNYESFYSVWLMPRLNHDSKGVREFIRNIMEYWIKKGADGWRLDVAHGVPPEVWEEIREKLPSNVYLVGEVMDDARLWIFNKFHGTMNYPLYEAILRFFVTREINAEQFLNWLELLSFYYGPAEYVMYNFLDNHDVDRMLSLLGDKRKYLCALVFLFTYKGVPSIYYGNEIGMKNIEAPFMERSRAPMEWNKKKWDKEILKTTKELIKLRRRSKALQKGIFKPVKFKDKLLVYKRVLNNENILVAINYSKKEKHLDLPPSFEILFQSGSFDRVNIRLKPFSSIIAKKL

SEQ ID NO: 7476 - protein, 425 aa, Synechococcus sp. WH 7805
MASRTYHDPLHRGISLDARDPAEAMVLSLVDSSPFQRLRRIRQLGPAFLTFHGAESSRFTHSLGVFSIARRAMERLKTLDPSLEQQRGVLYGAALLHDLGHAPLSHTGEEMFGTHHEQWSAQVIREHPQIRDSLENYATGTADAVADLLEHGQAERGVIKSLVSSQLDCDRLDYLLRDSYSTGARYGQLDLDRILAAITLAPDGELAIHPKGLMAVEHYLVVRNLMYRSVYNHRLNVMCNWLLERLIQEARHLGPDRIWADSTMHRWLWKTERLDLESYLANDDLRVGYHLQRWQADAPAPLASLCDRFLNRRLLKALDVSALHSSDRLELLAAAQTMSEAAGLEPTLCCGLRQHQLHGYHPYRGGLRLWDGHSLQALEQESALVSSLATPAESAWLIHPREIAAELKARVRQEISPLQAGNGWR

SEQ ID NO: 7477 - protein, 820 aa, Magnaporthe grisea 70-15
MSADPSQDPPKKKVNLADVSGADVKEESDVATAILKKKKKPNQLMVADATNDDNSIIALSNSTMEALQLFRGDTVLVRGKKRKDTVLIVLADDELDDGSARLNRVVRHNLRVKHGDVVTIHPCPDIKYAKRIAVLPIADTVEGLTGSLFDVFLAPYFREAYRPVRQGDIFLVRGGMRQVEFKVVEVDPPEYGIVAQDTVIHCEGEPIQRDEEENNLNEVGYDDIGGCRKQMAQIREMVELPLRHPQLFKSIGIKPPRGVLLYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILQIHTKNMKLGDDVDLEQIAAETHGYVGSDVAALCSEAAMQQIREKMDLIDLDEDTIDAEVLDSLGVTMENFRFALGVSNPSALREVAVVEVPNVRWEDIGGLDEVKQDLREQVQYPVDHPEKFLKFGLSPSRGVLFYGPPGTGKTMLAKAVANECAANFISVKGPELLSMWFGESESNIRDIFDKARAAAPCIVFLDELDSIAKARGGSVGDAGGASDRVVNQLLTEMDGMTSKKNVFVIGATNRPEQLDPALCRPGRLDSLIYVPLPDELGRLSILKAQLRKTPVSDDVDLQYIANKTHGFSGADLGFITQRAVKIAIKESITADINRTKALEAAGEDVPMDEDAEDPVPELTKRHFEEAMQQARKSVSDVEIRRYEAFAQQMKNAGPGAFFKFPEGEGAPAASGGETFNDGGNDDGLYD

SEQ ID NO: 7478 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 7479 - protein, 147 aa, Fritillaria agrestis
TMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 7480 - protein, 266 aa, Sinorhizobium meliloti 1021
MRHRRPTVADLLSMKGKRQLTMLRVVTLEEAEAAEKARIDLVSVPPALLGPEFREAAPSVFAFPGLEYGDHVTAEDYIRAAFQALKAGGDAVYCAASLSTVRRMREEGIPVCGHVGLIPSKATWTGGFRAVGKTAASALEVWRQTKALEEAGAFAAEIEVVPGEVAAAISARSSMLMLSMGAGTGCDAQYLFAEDVLGANRGYYPRHAKTYRNFAAEYDRLQQERIAAFSEFAFDVRSGAYPEKGHLVGIEEKELGAFLSELEGGR

SEQ ID NO: 7481 - protein, 690 aa, Glycine max
MHFCSHEFFFAVALLFFAVFGAFFCVEQSRFHLPGFFEPCPCLKFSALPEMMISTMGAPIYPNPKEHVSSCLLAVKLMFTFLFRRGLASVFHLISAENGLSRSRSQRTSIESLPDECLFEILRRLPAGQDRSVCASVSKRWLMLLSSICKTEIHSYGSTGNENQEISDEGYLSRSLEGKKATDVRLAAIAVGTASRGGLGKLTIRGCNSDRGVTNVGLKAIAHGCPSLKVCSLWDVATVGDVGLIEIASGCHQLEKLDLCKCPNISDKTLIAVAKNCPNLAELSIESCPNIGNEGLQAIGKCPNLRSISIKNCSGVGDQGVAGLLSSASFALTKVKLESLTVSDLSLAVIGHYGVAVTDLVLICLPNVSEKGFWVMGNAHGLQKLTSITINCCQGVTDVGLEPIGRGCPNVQNLKLRKSAFLSDKGLVSFARAAPSVESLQLAKSAHRITQIGLFGVFFNCGAKLKVLTLISCYGIKDLNMDLPAISPSESIWSLTIHDCPGFGNANLALLGKLCPRLQHVELSGLQGVTDAGFLPLLESSEAGLVKVNLNGCVNLSDRVVLSMVNSHGWTLEVLSLDGCKRVGDASLMAIAGSCPLLADLDVSRCAITDTGIAALARGKQINLEVLSLAGCAIGFRQERACLEKNGLFPCWIKYQALQRNQQPLCQQASGTSLACVTSSTEQEMPQQLL

SEQ ID NO: 7482 - protein, 253 aa, Staphylococcus epidermidis RP62A
MRTPIIAGNWKMNKTVQEAKDFVNELPTLPDPKEVESVICAPTIQLDALVTAVKDGKAKGLKIGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQEVADATRIQYGGSVKPNNIKEYMAQSDIDGALVGGASLKVEDFVQLLEGAK

SEQ ID NO: 7483 - protein, 578 aa, Oceanospirillum sp. MED92
MNLLNDNLHFRVKSHLESVYPLLDTEQLASELITLMRLEQVLSEPAPHQNHWDASDLIMIAYGDSIHHPDETALMTLYRFLHEQCQGMINGIHILPFFPYSSDDGFAVSDFYAVRSSAGSWEDIEKISAEFRLMADLVINHCSSESQWFKNFKMAQGEGHNYFFTENPEADLSQVVRPRTSPLLNAVQTHDGIQHVWCTFSHDQVDLDFRNPEVLKEFVKIIRFYLDKGVNIFRLDAIAFLWKEAGSSCLNLPQTHELVRLLRTLIEYAQPNAMIITETNIPSRENLSYFGNANEAHCVYNFSLPPLLLHTLITGECDYLKQWMMSMPPAQDGTAYFNFIASHDGIGLRPAEGILSDQEVSQLIDLMQSFGGHVSWRALENGQNKPYEINISLFDALQGTTQGPDQWGEERFLCAHRIMLALEGIPGIYIQSLFGSQNDYERVKMTGHYRSINRHHWQYDELKEALDDPQTHHHRIFEAMKKLISIRTYQPAFHPNATQFTLHLGSQVFGFWRQSIDRRQSIFCLNNISSEPAELLLSNLNLIGTDDWYDLLSGKRCEDLHETLILQPYQSLWLSNVY

SEQ ID NO: 7484 - protein, 204 aa, Bradyrhizobium sp. BTAi1
MPREARPLSSLISAYGHDVNHSKISYYAELFLYPIVVAALLLFDLASNGVALQPRWLLAAAGGALLWTLAEYLVHRFLYHEVAILKQLHGLHHARPSDLIGAPIWVSVVIFLSFFVLVASLADLQTASGTTSGLLTGYVLYLLVHDAVHHWPLAEQSLLQSWLRSCRLRHVRHHRGPPGNFGVVTGVWDHVFGTALAPGQTRNA

SEQ ID NO: 7485 - protein, 406 aa, Triticum aestivum
MASLSLSLRASASSAAAGSRAAAPIKASCVRSKVTCSLPSIRATSSPARSIEPVRATATQAPPATPQSSSGEKTKVGINGFGRIGRLVLRIAIDRDDIEVVAVNDPFIDAKYMAYMFKYDSTHGPFKGTITVLDESTLEINGKKVSVTSKRDPSDIPWGNFGAEYVVESSGVFTTVEKASAHLKGGAKKVVISAPSADAPMFVVGVNEKNYNPSMDVVSNASCTTNCLAPVAKVVHEEFGILEGLMTTVHATTSTQKTVDGPSMKDWRGGRGAGQNIIPSSTGAAKAVGKVLPALNGKLTGMAFRVPTPNVSVVDLTCRLEKNASYEDVKAAIKDASEGSLKGILGYTDEDVVSNDFVGDTRSSIFDANAGMGLSSSFMKLVSWYDNEWGYSNRVLDLIGHMSLVA

SEQ ID NO: 7486 - protein, 293 aa, Glycine max
MAASTTSQVYIDVIEDVMVKVRDEFVNNGGPGEEVLKELQAMWESKMMQAGAVLGPIERSSAAKATPGGPITPVHDLNVPYEGTEEYETPTADMLFPPTPLQTPIQTPLPGTGDNSTYNIPTGPSDYPSSGNDTGGNADGKGARPAPYMQSPSPWMNQRPPLDVNVAYVEGRDEADRGTSNQPPTQDFFTMPSGKRKRNDLTSQYNAGGYIPQQDGAGDATHGDFEIEVSGRGISINSHHTISKGKMSADLERSTSRIPQLDGPIPYDDDDVLSTPNIYNYGEVFSEDYNISN

SEQ ID NO: 7487 - protein, 209 aa, Zea mays
MAMATAKLSSPATSLLAGGRARRSAPARRATVIRAAAGSYSDELVSTAKSVASPGRGILAIDESNATCGKRLSSIGLDNTEPNRQAYRQLLLTTAGLGEYISGAILFEETLYQSTTDGRKFVDCLKDQNIMPGIKVDKGLVPLPGSNNESWCQGLDGLASRCAEYYKQGARFAKWRTVVSIPCGPSALAVKEAAWGLARYAAIAQDNGL

SEQ ID NO: 7488 - protein, 207 aa, Arabidopsis thaliana
LYGKAWYAVQGSRSRNSPGRPTRPWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMT

SEQ ID NO: 7489 - protein, 510 aa, Listeria monocytogenes
MEFWRRSVFYEIYMKSFQDSNGDGLGDFKGLTSRLDYLVDLGIDGIWLTPFYPSPQVDNGYDVSDYCDINPDYGDMTDFRAFMKAADARGIKVIIDLVLNHSSTEHTWFKESRSSKTNPKRDYYIWREKPNNWESFFGGSAWEKDELTGEYYYHSFAKEQADLNWANEAVRAEMEQVLAFWLNEGVAGFRLDVINNLTLVLEFPDNPVASGEMEHVYDRNQSGLEQALEDIASFCRKERDVFLVGEISSDKLPEIARYSSKKMLDVTFNFNFGSVDQLDAKSVFTTLNEMETALNEGQWPTLFFGSHDMSRFRSRLASGDIVKTQLLAFLMLTAKGVPFIYYGEEVGMPDLTFSSVKEMRDIQGTAAYYQALQTGTDEKQALEIAIEKTRDKARGPMIFPDGKPFTLGEPWIKMATLPEEEARMMWDFYQALLAFRKENDFKEMEYTFLKLDGEVLSYQRGEFIFLLHFGEEEITYPLQGNYQLVFGEAMMVENGIRMGAHTGIALRVEE

SEQ ID NO: 7490 - protein, 450 aa, Streptomyces carzinostaticus subsp. neocarzinostaticus
MNGRRPVSPPLRALPGLLRKLAVDRLGMMRDAAALDDAVLVSMGPKKLFVFNRPDYAKHVLADNAANYRKGIGLIESRKMLGDGLLTSEGELWREQRRTVQPAFRPARVAAQADAVAEETMNLRDLLMRRGADGPVDVLQEVTGFTLGVLGRTVLNTDLGGYGGIAHAFEAVQDQAMFDMVTQNMVPTWAPLATQRRFRRARRELIRTVDELVADRSARMTDGEEADDAFSLMIAAARRQTDPRTGQGRLRDELVTLLLAGHETTASTLAWTLLLLARHPHMRDLVREEARGVLADGRAPDAGDLRKLTYTTQVVQEAMRLYPPVWILPRVARQSDEVGPYSVSAGADVLICPYTLHRHPDLWERPEQFDPGRFDPARVADRPRYAYIPFGAGPRFCVGSNLGMMEAVFVTALLTRDLVLEVVPGDERTPEPMMSLRMRGGLPMTVRPVR

SEQ ID NO: 7491 - protein, 188 aa, Pichia angusta
MSSTEKRLLKEYRAVKKELTEKRSPIHDTGIVDLHPLEDGLFRWSAVIRGPDQSPFEDALWKLEIDIPTNYPLDPPKIKFVVFGEEKIRQLQRKTSSGARKVCYKMPHPNVNFKTGEICLDILQQKWSPAWTLQSALVAIVVLLANPEPLSPLNIDMANLLKCDDTTAYKDLVHYYIAKYSAYESNDV

SEQ ID NO: 7492 - protein, 471 aa, Debaryomyces hansenii CBS767
MPIDILGTAIYEGPEAIPGWEYIKTYTPAIMALAGIKYYFGGTSNTWERDYHGKVYIMTGATSGLGANLAYELASKGAQLILLVRSTEDSWLVDYIEDLRERTDNFMIYAEECDLNSLYSIRKFATKWLDNQPPRRLDGVICCAAESIPIGKARQVTVDGVEKQMGINYLAHFHLLTLLSPALKIQLPDRDVRIVMATCVSQALGDLDMKDALWLNRRYPTREPWKLYGTSKLMLTMFAKEFQRRLNSFERKDKAPCNVRVNMVNPGIMRTPSTRRFLSMGAIWGLLVYFVLFPIFWIFFKSTTQGAQSFLYALAAPVFKNLDGGNVIQECKILKPARKELSDEDLQKALYDETEKLLEALEKSSAIERKRQEKIQESKMPLADKLRAQNEESRKKADIHTKPESPEELQAKLASLKRLIGIPSDANDELPLFPSQPNSSQSESRAENLSTTKSTPKSKSKAKKSKSKKID

SEQ ID NO: 7493 - protein, 966 aa, Cytophaga hutchinsonii ATCC 33406
MKIDLTQRGSFQERHIGTSLSEKETMLKAIGVGSLDQLIDETVPANIRLANPLQLPKALSEEEFLVEFKKVVSQNEIFKTYIGLGYYNTLTPTVILRNILENPGWYTAYTPYQAEIAQGRLEALINYQTMVCELTGMEIANASLLDEATAAAEAMTLIYSLRKGTKKNATVFVVSKYTFPQTIDVLLTRSEPLGIKLEMVDPATADFTRTDIFGALVQSPDCNGNVADYTALISAAHANDTLVAFGSDLLSLTLIKSPGEMGADVVFGSSQRFGVPMGFGGPHAGFFATKEEYKRQLPGRIIGVSIDAEGKKAYRMSLQTREQHIRREKATSNICTAQVLLSVIAASYAVYHGPEGLKQIANRVHGFAAALSAIVTEFGFEQTNAAFFDTISIKAPGKGLAIKSAAEKRKINLRYEGDSVFVALDESVTVADLDQLIEVFAEAADKKVVAIDISNKYLRVEGALSGALLRTSAYMTHPVFNTYHTEHEMLRYLKHLENKDLSLTHSMISLGSCTMKLNATTEMIPVTWPEVGQIHPFVPASQVKGYHQLFNNIELWLSEITGFAGVSVQPNSGAQGEYAGLLVIRAYHESRGDTHRNIALIPTSAHGTNPASAVMAAMQVVLVKCDDAGNIDVADLKLKAEQHSKNLSCLMVTYPSTHGVFEESIIEICEVIHRHGGQVYMDGANMNAQVGLTSPGSIGADVCHLNLHKTFCIPHGGGGPGVGPIGVAAHLTPFLPGHAVVKAGGEKAISAVSAAPWGSASILPISYAYIAMMGSEGLTNATKNAILNANYIKSRLEKFYPILYTGTHGHCAHEFILDCRAFKTTIGIEVEDIAKRLMDYGFHAPTVSFPVAGTLMIEPTESESKHELDRFCDAMIAIRAEIAEIENGTADKLDNVLKHAPHTASVITADAWTRSYSRQKAAYPLPYLKTTKFWPSVSRIDSAYGDRNLFCSCIPTEEFAEAELAN

SEQ ID NO: 7494 - protein, 410 aa, Escherichia coli
  misc_feature (175)..(175): Xaa can be any naturally occurring amino acid
  misc_feature (203)..(203): Xaa can be any naturally occurring amino acid
  misc_feature (220)..(221): Xaa can be any naturally occurring amino acid
  misc_feature (229)..(229): Xaa can be any naturally occurring amino acid
  misc_feature (341)..(341): Xaa can be any naturally occurring amino acid
  misc_feature (376)..(376): Xaa can be any naturally occurring amino acid
  misc_feature (397)..(397): Xaa can be any naturally occurring amino acid
  unsure (1)..(410): unsure at all Xaa locations
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGXYVYFYDIENKLPLGNATQVQHLSDLLNXSDVVSLHVPENPSTKNXXGAKEISLXKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLXHIHENRPGVLTALNKIFAEQGVNIAAQYLQTSAQXGYVVIDIEADEDVAEKALQAXKAIPGTIRARLLY

SEQ ID NO: 7495 - protein, 476 aa, Campylobacter coli RM2228
MGKFVNNVNEFFDFCKQNEVLFVDFRFTDMIGTWHHITYNLHAISEETFEAGIPFDGSSIHGWQPIEKSDMILKPDAQSAFLDPFTADPTIIVFCDVYDIYKGQMYEKCPRSIAKKAMEHLKNSGIADTAYFGPENEFFVFDSVKIVDTTHCSKYEVDTEEGEWNDDKDFADSYNTGHRPRNKGGYFPVQPIDSLVDIRSEMVQTLEKVGLKTFVHHHEVAQGQAEIGVNFGTLVEAADNVQIYKYIVKMVAHLNGKTATFMPKPLYGDNGNGMHVHMSLWKDGVNLFYDKEGYGGLSQTAINYIGGVLKNARSVAAFTNPSSNSYKRIVPGFEAPCILTYSCQNRSASCRVPYGIGKNSARVEIRFPDSTANPYLAFVSLLMAGLDGIKNKTIPVGPMDENLFDLTLDEIREKGIEQLPHTLRGSLEALIRYNAFLKPVMSDIFIDDYQHLKFETQVWPVEARPTAYEFKTCYSC

SEQ ID NO: 7496 - protein, 567 aa, Pseudomonas aeruginosa UCBPP-PA14
MHHTPLLTTLAAGFVLAFLFGALANRLRISPLVGYLLAGVLAGPFTPGYVADQALSQEIAELGVILLMFGVGLHFSLKDLLSVKAIAIPGALVQIGVATLLGIGLAKLLGWSFGGGLVFGLSLSVASTVVLLRALEQRQLLDTKRGRIAIGWLIVEDLAMVLTLVLLPALAGTLGGKTDGGDAGLLWPLLITLGKVAAFVALMIFGGRRVVPWVLERIAASGSRELFTLAVLAIALGIAYGSAVLFGVSFALGAFFAGMILNESELSHEAAENSLPLRDAFAVLFFVSVGMLFNPMILLQEPLTVLATFLVIVFGKSVAAYLIVRAFGHPNSTALVIAASLAQIGEFSFILIGLGIGLELVPEQSRDLVLAGAILSILVNPLLFIAIDRLQQRKEQRLAEAAGGVREMPAQDLPPPILEREHAVLIGHGRVGGLVSARLRAAGTPFVVVVDKRDKADELREQGYSVVLGNAASPGVLELANIAEARWLLIAIPNGFEAGQIASHARAVNPPLDIVARAHFDAEVDYLEQNGANLVIMGEREIACGMVHRLGLDRDERGADAPLPQSA

SEQ ID NO: 7497 - protein, 239 aa, Candida albicans SC5314
MAKAEFGTAKYQSKKLRAAGLQKLKFYCQLCSKQCRDSNGFKNHLSSPSHIKKVSEIHESGDSSKLIETYSTKFQDEFIKLLRINHGTKFINANKFYQEYIRERDHIHMNSTRWRSLTSFIKHLGKNGIVKVQTNDESNEEEEGFNLEIKLIDRTQTLNAYQIKSGGNSLEDNDEMNDDKLLQRQIKRGQEMEKDKDAEKSKTLEQLVPTSAPVKLTLKKKKTATTKKLVNAFDENESE

SEQ ID NO: 7498 - protein, 210 aa, Zea mays
  misc_feature (44)..(44): Xaa can be any naturally occurring amino acid
  misc_feature (55)..(55): Xaa can be any naturally occurring amino acid
  misc_feature (84)..(84): Xaa can be any naturally occurring amino acid
  misc_feature (158)..(158): Xaa can be any naturally occurring amino acid
  misc_feature (167)..(167): Xaa can be any naturally occurring amino acid
  unsure (1)..(210): unsure at all Xaa locations
ATSSNAAYIGTPGRGNPCCVEITGHHCGSALHQASYWRETYEEXTRRALRELLYXCPGALQYSKGGILFQETLYHEYQGWLALXEGLKEGERLPGIKGDKGTIEDGGSDHETTTQGHDDPGRRCAKYYDAGARFAKWRAVLKIVPRGPSQFVVDLNAXGRARYAIFXHEKGLVPSREPEILDDGPDDIDRCAYVTETVLAACYKALNEHH

SEQ ID NO: 7499 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMLKLPMFGCTDAAQVVKEAAECKKEY

SEQ ID NO: 7500 - protein, 147 aa, Fritillaria agrestis
TMLSSVATAARTAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 7501 - protein, 147 aa, Fritillaria agrestis
TMLSSVATAARAAPAQASMVAPFVGLKSTSSFPVTQKPATGLSTLPSNGGRVQCMKVWPIVGLKKFETLSYLPTLSVETLLKQIEYLIRNGWVPCLEFSLEGFVSRDNNKSPGYYDGRYWTMWKLPMFGCTDAAQVVKEAAECKKEY

SEQ ID NO: 7502 - protein, 367 aa, Isochrysis galbana
APLPVSRVAQSRLGGVRMASDEPWFEDCVSTTSIDKSAFEAAYATAMNAPAPAASTSGKQDFLEASPFWDQSNIPINTYKNKAPFTGKIISVKRIVGAAATGETCDIVMSHGGKMPYWEGQSYGVIPPGTNPKNGKPNSVRLYSIASSRYGDDMTGTTTTLCVRRATYWCPELKADDPAKKGVCSNFLCDSKPGDEVKLTGPSGKVMLIPEQDATADLIMVATGTGIAPYRSFIRRLFVEKTPYGEVYKGLAWLFLGVANKDALLYDDEWQSVLKSYPKNFRVDYALSREQTNKDGGKMYIQDKVAEYSDEIFTRMDNGAHMYFCGLKGMMPGITEMLEGVSKAKGIVWEDKLKEWKSKGQWHVEVY

SEQ ID NO: 7503 - protein, 234 aa, Methanosarcina mazei Go1
MTERNTSTDSPEKRAAGIAAAGLVSSGMVVGLGTGSTVAYTIKELGRRVKEEGLDILGVVTSYQSEMLAIDAGIRLTTLSQDPELDIAIDGADQIDSNLYTIKGGGAAHTREKIVSVSAKRFVVVADDSKTSTQLDKPVPVEVLPFAKEPAVNRIRKLGGEPRLRSAVKKDGPVITDNGNFVLDVEFGVIKDPEALALQLSAVPGVVEHGIFSNVDELYIGKKDGSVKIISRQK

SEQ ID NO: 7504 - protein, 223 aa, Gibberella zeae PH-1
MTFTKALVPLALFLAKAQADAFSSCSKDLPLSCHNTTAVENTCCFVPAGQLLQTQFWDSSPVAGPSDSWTIHGLWPDYCDGTYPQFCDKSREYTDIKSIVSKFLGNSTLSYMDKYWVSQDGNDESLWEHEFNKHGTCISTLEPSCYSNYQTGEEAADYVKKTISLFKTLPTYKWLAEAGIEPSTDKTFTASEIEDALASQHGARVTIGCQGLDPGGSVCGYRA

SEQ ID NO: 7505 - protein, 90 aa, Triticum aestivum
MSAGSERSNAAYATPAAVLADFSRGSGPSVSGGAAGTGTGSGRSQAEGGARKKPPLRLAADDTKPVLRDPISRSDPMETEQAVLRLPPFP

SEQ ID NO: 7506 - protein, 358 aa, Oryza sativa (japonica cultivar-group)
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 7507 - protein, 147 aa, Fritillaria agrestis
TMLSSVATAARAAPAQASMVAPFVGLKSTFAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 7508 - protein, 527 aa, Rubrobacter xylanophilus DSM 9941
MRVLVTEKLAERGVELLRREFEVDVLLGLSPGELLERIGEYDGLIVRSATKVTAEVIEAAGRLKAIGRAGIGVDNIDIEAATKRGILVANAPESNTVAAAEHTLGLMLAVARRIPAADASLRRGEWNRAAFKGVEVAEKTLGLVGLGHVGSIVARGALGMGMRVLAYDPYVSEERMRSMNVERAGSLEEIFEEADFVSLHVPRTPQTTGMVGEEELARMKPTAYLINVARGGIVDETALYNALKQGEIAGAALDVFAEEPTTDSPLFALPNVVVTPHLGASTAEAQDRAGVTAAEQVAAALRGEVPIHAINAPVPAGEGAEFVSQFAGLCETLGRLLYQLTDRPGSRLKIEYRGEIGAYDTRLLDVSVQKGLLSRMVHEPLNYVNTPILAKERGLKVETSKTSESSDYTNLVVVRIESNGGESVVSGTLTGPRMQPRLVEALGYTLDIVPERHMLFIRNEDVPGMIGKVGTILGEHGINIGNMAVGRGEPGSRAAMAVTVDEPVPPEVVESLLNIPGFNDARAVTLY

SEQ ID NO: 7509 - protein, 309 aa, Prochlorococcus marinus str. MIT 9211
MGTLISLLVGILLILIIWIWLKTNRAYKSKSSVSLAYDSWTNDRLLERLWGEHIHLGYYKDSSVKTDFRQAKVDFVHQLVKWSGMDHLPKGSRILDIGCGIGGSARILARDYNFDVLGITISPLQVRRAQELTPEDSTCRFEVMDALDLQLENGSFDGVWSVEAGPHIPDKQLYADEMLRVLRPGGVLAVADWNRRDIQKKKYDFLEELVLRQLLNQWAHPEFSTINAFQKNLSNSAYSAGTADTDDWTRFTIPSWNDSIIEGIKRPKVFFDLGPKSFYKGFREIPTILLMRWAFSVGLMEFGVFRTRG

SEQ ID NO: 7510 - protein, 474 aa, Brucella melitensis 16M
MREMLMRPVVLAGGKGTRLWPMSRSQRPKQFLALTGELSLFQMTLKRLSDPNRYSSPIIITNADYRFLVAEQALECGVELSDVILEPMARNTAPAIAAAALIASKDEQTLIHVVASDHNIEINDAYFQAVDTACNAARMGRLATFGITPTEPATGFGYIEAGELEESGACAIKRFVEKPKEEVAREMLAAGGFYWNSGMFLFRSDVFLDECRRYAPAVYEAAEASVATAQRDLDFVRLNSAEFEKAPDISVDYAIFEKTKLASVVPSPIHWSDLGSWDAVWKESKQDPSGNVARGPVSLHNTNNSLVLSEGVHVAVNGVDDLTIVASEDALYVGKLSEAQGVGTIVKALMKQPATAKLAEEHRTIYRPWGGYTHLLSGDRLQVKRLFIKPGKQLSLQKHHHRSEHWVVVRGVAEIVIDDKSLFLSENESTYISQGAIHRVSNPGKILLELIEVQTGAYLGEDDIVRFEDDFGRV

SEQ ID NO: 7511 - protein, 505 aa, Staphylococcus epidermidis RP62A
MAKQPTALIILDGFANRESEHGNAVKQAHKPNFDRYYEKYPTTQIEASGLDVGLPEGQMGNSEVGHMNIGAGRIVYQSLTRINKSIEDGEFFDNTVLNNAVKHVKDNGSALHVFGLLSDGGVHSHYKHLFAILELAKKQGIDKVYVHAFLDGRDVDQKSALKYIEETEDKFKELGVGQFASVSGRYYAMDRDKRWDREERAYNAIRNFEGPTFTSAKAGVEANYKNDVTDEFVEPFIVEGQNDGVNDGDAVIFYNFRPDRAAQLSEIFTNKAFDGFKVEQVDNLFYATFTKYNDNVDAEIVFEKVDLNNTIGEVAQDNGLKQLRIAETEKYPHVTYFMSGGRNEEFEGERRRLIDSPKVATYDLKPEMSAYEVKDALLEELDKGDLDLILLNFANPDMVGHSGMLEPTIKAIEAVDECLGEVVDKIIDMGGHAIITADHGNSDQVLTDDDQPMTTHTTNPVPVIVTKEGVTLRETGRLGDLAPTLLDLLNVKQPSEMTGESLIKH

SEQ ID NO: 7512 - protein, 585 aa, Oryza sativa
MSPHAVMANVPEKTWWKEAVVYQIYPASFNDSNGDGLGDIPGIVSKIPYIKSLGVNTIWLSPIFASPQHDMGYDISDYRAIHEPYGTVEDVQSLIDQLHSNDMRLLMDLVVNHTSDEHAWFKESRSSKDNAKRDWYFWRDPKYDSEGNRKEPNNWKSIFGGSAWHFDEQTGQYYLALFLPSQPDLNWACEEMRQASYDDIRFWLDRGVDGFRIDSMNLMSKHPDLPDGKIVDDEPYQSGAEFFASGPKMHDYIREMRAIFDEYDAMTVGELGFTKDEQSVSEYVAKDRHELNMVFTGDIVDMDFGPDGKYGRDDFHPRKIRNITNMWQRVMPKVNGWNSVYLDNHDSGRSLSRYASDAPEHRATAAKMLATYLLTLSGTPFMLAGQEIGTANLGKDYGTEAYIDVEGRNHYDAVLKTRGGDHSKMGDVMREIQLKARDHGRLPMQWDSSANAGFSAEGTTPWMTINKDYVDWNVASQIDVPDSVLAYWRKMLALRKEHTDLLTYGSYKPLSELDTGEWVLGYERESFETGKKAVVLLNFSDKEQRVHVESPSREEYEVLVSNQEAGIKGGYVTLMPYGAVVLVSK

SEQ ID NO: 7513 - protein, 543 aa, Vibrio fischeri ES114
MEKRWWHNSVVYQIYPRSFCDSNNDGIGDLQGIISKLDYLQGLGIDVIWLSPVYQSPMDDNGYDISDYQAIAAEFGTMEDMKRLMQQAEDRGIKVVMDLVVNHTSDEHAWFVEAKSDKNSQYRDFYIWRDTDENGEAPSDIGSIFGGSAWQWDEENQQYYFHLFSKRQPDLNWENPEVHQKVFDMMNWWIDQGIGGFRLDVIDLIGKEVDKKITGDGERLHPLLQKMNQATFGDKDLLTVGETWGATPESAQLYSDPARHELSMVFQFEHITLLWEDGDKWKPKPLDLALFKQVMTKWQVELNNKGWNSLFWNNHDLPRVVSKYGCDGQYRVESAKMLATTLHMMKGTPYIFQGEEIGMTNVAFDTLEEYKDIETLNFYRVKTESGVSHESMMKGIHANSRDNARAPMHWDNSDNAGFTQGTPWIKLNPNYPEINVAAALEDKNSIFYHYQKLIALRKQNPVIVYGDFIPLFETHSAVFAYERKDNDQHLVVLNNFSAEPQTLALPEHIANRSVECLISNLEPTTQLGSELILAPYQSLVLAL

SEQ ID NO: 7514 - protein, 503 aa, Rhodococcus sp. RHA1
MTESVTRTAPHRSEVVSESASTTRHFDSHTAPLRHTKIVCTLGPATATGDRIRELVESGMDVARLNFSHGEHADHEENYKRVRAASDATGKAVGVLADLQGPKIRLGRFAEGRTTWANGEEVRITVDEVEGTHDRVSTTYKQLAEDAKAGDRLLVDDGKVGLVVSGVDGNDVICRVTEGGPVSNNKGVSLPGMNVSVPALSEKDIADLEFALGLGVDFIALSFVRSPADVELVHAVMDRVGRRIPVIAKLEKPEAIDNLEAIVLAFDAVMVARGDLGVELPLEQVPLVQKRAIQIARENAKPVIVATQMLESMIENSRPTRAEASDVANAVLDGADAVMLSGETSVGKYVMETVRTMARIVEAVENESTQVPPLTHVPRTKRGVISYAARDIGERLDAKALVAFTQSGDTVRRLARLHTPLPLLAFTPLPEVRSQLSLTWGTETFIVDPVESTDAMVRQVDHALLGLGRYQKGELVVIVAGSPPGTVGSTNLIHVHRIGEEDH

SEQ ID NO: 7515 - protein, 238 aa, Nicotiana tabacum
VYLARLAEQAERYDEMVEAMKTVAKMDVELTVEERNLVSVGYKNVIGARRASWRILSSIEQKEESKGHDQNVKRIKTYQQRVEDELTKICIDILSVIDEHVVPSSTTGESTVFYYKMKGDYYRYLAEFKSGDDRKEAADQSLKAYEAATATASADLAPTHPIRLGLALNFSVFYYEILNSPERACHLAKQAFDEAIAELDSLSEESYKDSTLIMQLLRDNLTLWTSDLEEGGEHSKGD

SEQ ID NO: 7516 - protein, 635 aa, Medicago truncatula
MAMARDKKEDEEEVHNQNQKVGKRLKCMNMMKNEQEENQVVDEEESELPLKPELFFYPTTPTSFVVSDALESDFPIIYVNKVFEISTGYRAHEALGRNCRFLQYRDPRAQRRHPLVDPVVVSEIRRCLEEGIEFQGELLNFRKDGTPLVNRLRLTPIHDDDGVVTHIIGIQIFSEANIDLNRVSYPVFRETCIQDFDKNAKYSPKSGKLLYTPQKREEMCGILQLSDEVLAHNILSRLTPRDVASIGSVCRRIRQLTKNEHVRKMVCQNAWGKEVTGTLELMTKKLGWGRLTRELTTLEAVCWKKVTVGGGVEPSRCNFSACAAGNRLVLFGGEGVDMQPMDDTFVLNLDAKNPEWQRVSVISSPPGRWGHTLSCLNSSWLVVFGGCGRQGLLNDVFVLDLDAQQPTWKEVFGEAPPLPRSWHSSCTIEGSKLVVSGGCTDAGVLLSDTYLLDLTIDNPTWREIPTSWTPPSRLGHSLSVYGRTKILMFGGLAKSGHLRLRSGEAYTIDLEAEQPQWRQLECSAFTGLSNQNAVVPPPRLDHVAVSMPCGRVIIFGGSIAGLHSPSQLFLLDPAEEKPTWRILNVPGEPPKFAWGHSTCVVGGTRVLVLGGHTGEEWVLNELHELCLASRQDSDM

SEQ ID NO: 7517 - protein, 407 aa, Desulfovibrio desulfuricans G20
MPMCTAEEAIEEIRSGRMLILVDDEDRENEGDLTIAAEHVTPEIINFMAMHGRGLICLAMAPEWVDKLQLPLMARRNESKFGTNFTVSIEARQGVTTGISAKDRATTILTAVKDDVKPEDIVTPGHIFPLRAQKGGVMVRAGQTEGSVDLARLAGLKPAAVICEIIRDDGEMARMPDLVEFAEKHGLKIATIRDLIRYRMQPGQLSVQRVAEAKMPTKYGDFTVIAYENDHGDETHLAMVKGDIKNQDAVLVRVHSECLTGDVLGSLRCDCGDQLAAAMCTVAAEGAGVVLYMRQEGRGIGLANKIKAYALQDQGYDTVEANHKLGFKADLRDYGIGAQILVDLGVRKMRMMTNNPKKIVGIEGYGIQVVERVPIEMHACEFNENYLRTKKEKMGHMLHLSDEGQEQ

SEQ ID NO: 7518 - protein, 415 aa, Zea mays
  misc_feature (99)..(99): Xaa can be any naturally occurring amino acid
  unsure (1)..(415): unsure at all Xaa locations
MDRELLETFDAAKKAADEAAGDGNSPEAGRCLDALRRLRDIRVNTDILVSTQICLVESTACFPSLSSKTTPGRRAQETGPSFGTRSIEFLSLFWVDTGXVGKRLRPLTKHPHSGIQAVAADLFGYWKKVVLEESGKKNGGSENERSSDSSGKVEKVRPVKIEKNSASASMKLEKRDVDVRGQKPNNVKVEKTTSNGSKAQSVKVERVSKEVIRTPDSKRPASVPNGHPKLTSLVKCNDPTRDKIRELLAEAFVSVSRETSDDDRDEVKNILDEVEACDPYRVAVTVESALFERLGPSTGTHRAKYRSIMFNLRAENNTDFRRRVLIGLVAPERLPDIPPDEMASDARKQENMQIKEKALFDCERGAAPKATTDQFKCARCGQRKTTYYQLQTRSADEPMTTFVTCVNCNNHWKFC

SEQ ID NO: 7519 - protein, 120 aa, Arabidopsis thaliana
  misc_feature (10)..(10): Xaa can be any naturally occurring amino acid
  misc_feature (17)..(18): Xaa can be any naturally occurring amino acid
  misc_feature (22)..(22): Xaa can be any naturally occurring amino acid
  misc_feature (26)..(26): Xaa can be any naturally occurring amino acid
  misc_feature (31)..(31): Xaa can be any naturally occurring amino acid
  misc_feature (36)..(36): Xaa can be any naturally occurring amino acid
  misc_feature (40)..(40): Xaa can be any naturally occurring amino acid
  misc_feature (42)..(42): Xaa can be any naturally occurring amino acid
  misc_feature (46)..(46): Xaa can be any naturally occurring amino acid
  misc_feature (51)..(59): Xaa can be any naturally occurring amino acid
  misc_feature (62)..(64): Xaa can be any naturally occurring amino acid
  misc_feature (70)..(70): Xaa can be any naturally occurring amino acid
  misc_feature (76)..(77): Xaa can be any naturally occurring amino acid
  misc_feature (80)..(80): Xaa can be any naturally occurring amino acid
  misc_feature (82)..(82): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(97): Xaa can be any naturally occurring amino acid
  misc_feature (100)..(103): Xaa can be any naturally occurring amino acid
  misc_feature (106)..(106): Xaa can be any naturally occurring amino acid
  misc_feature (108)..(110): Xaa can be any naturally occurring amino acid
  misc_feature (112)..(112): Xaa can be any naturally occurring amino acid
  misc_feature (114)..(115): Xaa can be any naturally occurring amino acid
  unsure (1)..(120): unsure at all Xaa locations
MASSMLSSAXVVTSPAXXTMVXPFTXLKSSXAFPVXRKTXKXITSXASNGXXXXXXXXXPPXXXKKFETXSYLPDXXDVXLXKEVDXLXRXKXXXXXSNXXXXHGXVXXXHXNXXGKPLA

SEQ ID NO: 7520 - protein, 378 aa, Candida albicans SC5314
MSKNLPLLSIQEVSKHNHVKDCWVTLYQRKIYNVTGFLEEHPGGGEIILPYAGKDITEIMADIQSHQHSESAYEILDEGMLVGYLATEQEEKGLLRNKNNTPVEVKLVNKDDKDFDMYEFHDHLPAEEKLSIQTDFEEDSKKHRFLDLNKPLLMQLLTSNFSKEFYLDQVHRPRHYGKGSAPLFGNFLEPISLTPWWVIPLVWLPPNFYLFYVGFVNQSPITALSLWVMGLFIWTLVEYCLHRFLFHLDYFLPDHPYAFALHFLLHGIHHYLPMDGYRLVLPPTLFLVLAYPFYKLIFSIFPFYMACSGFAGGTLGYIMYDITHYVLHHTKLPKYFQTVKRLHLEHHYKNYELGFGVTSPFWDVVFGTELTNTFEKRR

SEQ ID NO: 7521 - protein, 384 aa, Mycobacterium tuberculosis H37Rv
MRAVVIDGAGSVRVNTQPDPALPGPDGVVVAVTAAGICGSDLHFYEGEYPFTEPVALGHEAVGTIVEAGPQVRTVGVGDLVMVSSVAGCGVCPGCETHDPVMCFSGPMIFGAGVLGGAQADLLAVPAADFQVLKIPEGITTEQALLLTDNLATGWAAAQRADISFGSAVAVIGLGAVGLCALRSAFIHGAATVFAVDRVKGRLQRAATWGATPIPSPAAETILAATRGRGADSVIDAVGTDASMSDALNAVRPGGTVSVVGVHDLQPFPVPALTCLLRSITLRMTMAPVQRTWPELIPLLQSGRLDVDGIFTTTLPLDEAAKGYATARARSGEELRFCLRPDSRDVLGAHETVDLYVHVRRCQSVADLQLEGAADGVDGPSMLN

SEQ ID NO: 7522 - protein, 337 aa, Synechocystis sp. PCC 6803
MTRVAINGFGRIGRNFLRCWLGRTDSQLEVVGINDTSDPRTNAHLLRYDSMLGKLDGDISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 7523 - protein, 482 aa, Arabidopsis thaliana
MENITAQLKRGISRQFSTGSIRRTLSRQFTRQSSLDPRRTNMRFSFGRQSSLDPIRRSPDSSKSDDEPHMSVPENLDSTMQLLFMASKGDVRGIEELLDEGIDVNSIDLDGRTALHIAACEGHLGVVKALLSRRANIDARDRWGSTAAADAKYYGNLDVYNLLKARGAKVPKTRKTPMTVSNPREVPEYELNPLEGAYQVAKWNGTRVSVKILDKDSYSDPERINAFRHELTLLEKVRHPNVIQFVGAVTQNIPMMIVVEYNPKGDLSVYLQKKGRLSPSKALRFALDIARGMNYLHECKPDPIIHCDLKPKNILLDRGGQLKISGFGMIRLSKISQDKAKVANHKAHIDLSSKENASFTCMKTESLDYYIAPEVYKDEIFDLRVDAHSFGVILYEITEGVPVFHPRPPEEVARMMCLEGKRPVFKTKSRSYPPDIKELIEKCWHPEAGIRPTFSEIIIRLDKIVANCSKQGWWKDTFKFPW

SEQ ID NO: 7524 - protein, 411 aa, Cytophaga hutchinsonii ATCC 33406
MINKKKVINDPVWGFINIPTDLIFEIIQHPYFQRLRRIRQLGLTEMVYPGAIHTRFHHALGAMHLMTEALKSLQSKGHTISSEEFEGAQLAILLHDIGHGPLSHALEYSLLENIKHEELSRFIMESLNVTYKGKLDLAIAIFTNTYHRPFLHQLVSSQLDMDRMDYLSRDSFFTGVSEGTIGADRLIKMLDLHNDELVVEEKGIYSIENFLTARRLMYWQVYLHKTTVSAENMVISIIKRAKFLMKNNTLSYKPPFLEVFLQTEITFEQLLQQSDLLSAFLKLDDVDLWFAIKQWSKEEDVVLSTISKMILDRKLFSVHIQPEQIGANQIETNQKRLLLTFPITTAELDYFLIQGTISNAAYLAENTQIKVKMKNKEILDVAIASDLPNIQALSKIVTKHYICCPKDVYLQ

SEQ ID NO: 7525 - protein, 337 aa, Podospora anserina
MTVKVGINGFGRIGRIVFRNAVEHPDVEIVAVNDPFIEPKYAEYMLKYDSTHGVFKGTIQVSGSDLIVNGKTVKFYTERDPSAIPWKDTGAEYIVESTGVFTTTEKASAHLKGGAKRVIISAPSADAPMYVMGVNEKTYDGKAAVISNASCTTNCLAPLAKVVNDKFGIVEGLMTTVHSYTATQKTVDGPSAKDWRGGRGAAQNIIPSSTGAAKAVGKVIPELNGKLTGMAFRVPTSNVSVVDLTCRLEKPASYETIKAALKEASEGELKGILGYTEDEIVSSDLNGNANSSIFDAKAGISLNDNFVKLVSWYDNEWGYSRRVLDLLSYVAKYDASH

SEQ ID NO: 7526 - protein, 471 aa, Pseudomonas aeruginosa PAO1
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPVSSYLALAFLVMVVVLMAFFEDTRIALYIGPPFILLLTVLYYAFNLAPKEPAGTGSVSRAAS

SEQ ID NO: 7527 - protein, 239 aa, Synechococcus sp. WH 8102
MADLQTQMKQAVADAAVEQIKDGMVLGLGSGSTAALMIKALGAKLASGELKDIVGVTTSFQGEVLAAELNIPLLSLNAVDRIDLAIDGADEVDPGFQLIKGGGACHVQEKLVAARADRFVVVVDSTKLVERLNLGFLLPVEVLPGAWRQVQQQLAALGGKAELRMAQRKAGPVVTDQGNLVLDVTMNGGISDPAALESTVNNIPGVLENGLFVDLVDEVLVGEITDGSAGVRSLEKRLS

SEQ ID NO: 7528 - protein, 141 aa, Burkholderia mallei ATCC 23344
MALERTLSIIKPDAVAKNVIGQIYSRFENAGLKIVAARMAHLSRADAEKFYAVHAERPFFKDLVDFMISGPVMIQVLEGEDAILKNRDLMGATDPKKAEKGTIRADFADSIDANAVHGSDAPETARAEVAFFFPEMNVYSR

SEQ ID NO: 7529 - protein, 484 aa, Chlamydophila pneumoniae J138
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVNAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 7530 - protein, 598 aa, Klebsiella oxytoca
MITISSLSHSAKSADSYAYNKETLHIRFRTVKGEVAKVSLWIGDPYQWEEGGLDGGNLGGSDAHGWSGGNEVHMEKEGQSESYDHWFAAFTPCKRRSRYGFILYGNNGEKLLFGERRCVDISKPPVAETELSNLSNFFCFPYINPGDVLSTPEWVKKTIWYQIFPERFCNGDPSISPENVQPWGTPPDSKNFMGGDLQGIINKLDYLQDLGVNGLYLCPIFTANASHKYDTVDYFNVDPHFGGNDRFKELVQKAHQRGMKVMLDAVFNHIGNQSPLWLDVVKNGDKSPYADWFWIKKFPVYPSGDKNEWDFRNFNYETFGNVIEMPKLNTENPACRDYLLQVARYWIEEFDIDGWRLDVANEVDHEFWRAFRRTVKSIKPDCYILGEIWHEGMPWLRGDQFDSLMNYPLMQATTDYFALQAYDKKTFIDIVTHAYLCYPRNVNEVMFNLLESHDTSRLLSLCGNDKRKARLAYLFMFSQVGSPCIYYGSEVGMNGSRAMGSEDNRKCMIWDEQKQDLEFKSFIKDLILWRKKHSEWNDPKIHWNNVDHPAVVAFSRGEVHFLLNNSDESLAINYQGRTLSLTPFGFYIIGLDHKDIIS

SEQ ID NO: 7531 - protein, 305 aa, Zea mays
MEGDTGCRSEKEVAVVTGGNRGIGLEICRQLASSGVTVVLTARDAERGAEAASTLGLPNVVFHQLDVGDPSSAARLAGFIEEKFGKLDILVNNAAITGTTSNVVDPEAFRQELAGLDVMQMIEAINKHNTEPYEQAQKCLRTNYHGIKAVTKALLPLLQSSSHGRIVNLSSSYGLLRFFSGDELKEELSSIDGLSKQRLDELSELFLKDFKDGQLEARGWPNEGGFIAYKASKALANAYSRILAKEHPSLCINCVHPGYVQTDMNFRSGHLTVEEGTRGALMLAMAPKGGVTGAFFDHTEAASFV

SEQ ID NO: 7532 - protein, 586 aa, Haloquadratum walsbyi
MRNAKIVCTLGPASDEQSTIRALVNAGMSVARLNASHGTPDHRRLVIDRIRNVDKVTDKPVAAMVDLQGPEVRTAPSSDSISIGSDSEIRFTTGDEITPEVIGLSYSIDAVDPGDTVLLDDGRIETTVRSVDSDGVIAHVDSGGELGGRKGVNVPGVNLDIDLLTESDREDLRVAAEANADFVAASFVRSAADVYMISDALDALGGDIPVVAKIERAGAVENLDEIIDAAYGIMVARGDLGVEMPLEEVPVIQKRIITQCHDTGTPVITATEMLDSMVQARRPTRAEASDVANAVLDGTDAVMLSGETAIGDNPVRVVETMDRIVRQIESSAEYGTIEQEHVPTAAENSRTEALARSARYLARDVGASAIVAASESGYTARKTAKFRPGVPVIAITPNDRVRRQLTLSWGVASTYSGSHGDIEGMMEDAVDAALDANVASSGDTIVVLSGMMTELEGTNTTNMLKVHVVAETIATGRKVVGGRTAGPLATPTDGRLDEIPHGAILALPADFDAEFDHDAAMLGGIIDARPGMTGYPAVIARELDIPMISGAPLPPQISDGTAITIHAERGIVYEGDLTRSHDQDRN

SEQ ID NO: 7533 - protein, 613 aa, Nostoc sp. PCC 7120
MSDLFKGFEQLIELVKTLEEKAEKGEIKTDFQINSRSMSSIPRTGNIPRPNNMANDIGTSRIRTQPSPNSDSGNGDSSDVVVPPDAPSGNSLKDVGGLGEVVKELKELIAIPLKRPDLLAKLGLEPTRGVLLVGPPGTGKTLTARGLAEELGVNYIALVGPEVISKYYGEAEQRLRGIFEKAAKNAPCIIFIDEIDSLAPDRSAVEGEVEKRLVAQLLSLMDGFSHSQGVIVLAATNRPDHLDPALRRPGRFDREVQFRVPDVKGRRDILQILTRAMPLEETVDLDAIAERSVGFVGADLKALCQKAAYTALRRQMPSVESAVPENMTVSQADFLQALKEIKPAVLRSVEVEVPHIAWDDIGGLDTIKQTLRESVEGALLYPELYLQTKALAPKGILLWGPPGTGKTLLAKAVASQARANFIGVNGPELLSRWVGASEQAVRELFAKARQAEPCVVFIDEIDTLAPARGSFSGDSGVSDRVVGQLLTELDGIEVGSTILVIGATNRPDALDPALLRAGRLDLQMKVDLPDLASRLAILLVHSQGRPLDGVDFNYWAEMTQDWNGADLTLLCNQAAVEAIRRFRSQGLTDPSEIKITTDDFNYAYKVLTEQRPD

SEQ ID NO: 7534 - protein, 240 aa, Arabidopsis thaliana
MKGLVSTGWKGPVKFRMPTAENLVPIRLDIQFEGQRYKDAFTWNPSDPDNEVVIFAKRTVKDLKLPYAFVTQIAQSIQSQLSDFRAYEGQDMYTGEKIIPIKLDLRVNQTLIKDQFLWDLNNFESDPEEFARTLCKDLGVEDPEVGPAVAFAIREQLYEIAIQSVASARESRLSKKGRRGSDHGSASKASGLSMDLMKLFSFKSSVVRKRKDLDVYEPVVDLLTSEEVDALEAREERHAR

SEQ ID NO: 7535 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 7536 - protein, 424 aa, Synechococcus elongatus PCC 7942
MPSRRQRIYHDPLHGAIALQFEDPLEATLIRLIDTPPFQRLRRICQLGPASLTFHGAEASRFTHSLGVMQVARRAFAPIAADWPELAVHRPALLCAALLHDLGHTAFSHTGEEIFHCQHEQWTARLITEDSPIRRVLADYDPALPEQVLAVYRKQYQPLLISRLITSQLDCDRLDYLLRDSYFTGASYGRLDLDRILSALRFDSESGELAVAEKGLAAIEHYLVVRSFMYSQVYNHPKNIVAGWMLVRIFERARQLWQEQPRSLFVDPLLQPWFEQPVTDLSLEEYLAVDDIVCLYHLQRWQDSADPLLADLCRRYRDRDLLKALNLRNLPAEQQQTLLEHSQQLIRNQGQDPTGYTGLCQTQSRGYTLYQSGIRLATDQGLLEISQRSPLIRALLEPPSQAWLIYPRVIEQPLKQQWQLVRGS

SEQ ID NO: 7537 - protein, 247 aa, Clostridium acetobutylicum ATCC 824
MENKVLAVVNGQEITESDLNATINSFPEERRRQFLNPEGRKRLLDEIVSFELVYNDAKDSGIEEQEVVKAQIENARKQILTHASLDKIFSDIVVADSEVEKYYEANKEMFKDPEKVAAKHILVQTEEDALKIREEIKEGKTFEEAAAEYSSCPSKERGGDLGAFTRGQMVPEFEEAAFSQEIGEVGAPVKTQFGYHLIKVEGKIEPAQRDFPSVKDAIKNRLLQERQSMKYSWYIDQLKNKYKVEIK

SEQ ID NO: 7538 - protein, 470 aa, Shigella flexneri 2a str. 301
MVDQVKVVADDQAPAEQSLRRNLTNRHVQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 7539 - protein, 262 aa, Fritillaria cirrhosa
MSSAESREENVYLAKLAEQAERYEEMVEFMEKVAKTVETEELTVEERNLLSVAYKNVIGARRASWRIMSSIEQKEESKGNDQNVKLIKGYRHKVEEELAKICNDILTVIDKHLIPSSGSGEATVFYYKMKGDYYRYLAEFKNEHERKEAADQSMKAYQAASNTANTDLPSTHPIRLGLALNFSVFYYEIMNSPERACHLAKQAFDEAIAELDTLSEESYKDSTLIMQLLRDNLTLWTSDLPEDGGDEGFKGEEAKAAGDDEH

SEQ ID NO: 7540 - protein, 322 aa, Mesorhizobium sp. BNC1
MSPSEPSSRWRANCVLCLLYRALSCFFTCSSAALSAGWRKPQRRRSFKMFALAASASAAGYRLEAHESVGSTNVLALERAVSGDPGKLWVVSKNQTSGRGRRGRTWETPAGNLAATLLLADRIEPGAAATLGFVAGLSLSDALRQAAPSARLGIGIDGGEGKAERTRFELKWPNDVLADGAKLAGILLESSVLGEGRFAVAIGIGVNIVSHPVDTPYPAISLQGLGADCDAERLFEALSAAWVENFALWQGPRGMSAIRDRWLENAAGLGSTVSVRADGRVVRGIFETIDEQCRFVVREDNGSRLLIAAGDVHFGAVASARD

SEQ ID NO: 7541 - protein, 210 aa, Oryza sativa
  misc_feature (134)..(134): Xaa can be any naturally occurring amino acid
  misc_feature (147)..(147): Xaa can be any naturally occurring amino acid
  misc_feature (151)..(151): Xaa can be any naturally occurring amino acid
  misc_feature (167)..(167): Xaa can be any naturally occurring amino acid
  misc_feature (187)..(187): Xaa can be any naturally occurring amino acid
  misc_feature (191)..(191): Xaa can be any naturally occurring amino acid
  unsure (1)..(210): unsure at all Xaa locations
MERELLETFEAAKKAADAAAGADDSPEADRCLDAMRRLRGLRVTTDVLVSTQVGKRLRYLTKHPHSDIQSMATDLLGYWKKVVIEEGKKNGTTENVGSTNSAARAEKAQPMKVDKSSASGSVKPEKREVNVRGXQKPESIQVERITXNNDXSKTQQVKVERASKGGXLNFLFKEPISCSNWPPKLAXLVKXMDPLGNKIRDLIGDAFFKG

SEQ ID NO: 7542 - protein, 440 aa, Colwellia psychrerythraea 34H
MSKKNKPNSNAMFTRAIDNMPLGVADSYRYWGEENTVFLSSMKGCTITDCDEQTFVDFRLAYGPIILGYRDERIDNEVISAITTVGTISGFSTGLDSDVVELVKSLCPNIDKMRFSNSGTEAVIGAVRTARGFTKRNKIVVVEGGFHGLHDEVMWKSDVDNWDVNTQQVPDIVPFGGGIPQSTREHQVSVPLNDFDAIDAVFTQYGDDIAAILIEPIMGNCGSIASTQAYMQKLRDVCDNNGSLLIMDEVKTGFRVAKGGAQALYGIFADLTTYAKAMGNGYPVAAFGGRAEVMDTISFAKDGVTHGGTYTANMVALSAAKATLTVLKETDALETIANVGQKIQALLSRVFTKFGVEHCFAGPDAMFGVHFGSKVPQNYRDWKQTNSDLYTQFALNLIENGVMLEPDSREPWFICEAHQTVDLNWLEQVAEQSMAAAINE

SEQ ID NO: 7543 - protein, 251 aa, Bacillus megaterium
MRKPIIAGNWKMNKVLSEATSFVEEVKGAVPSPESVDSVVCAPALFLDRLVEATKGTDLKIGAQNMHFEENGAFTGEVSPVALADLGVNYVILGHSERREMFAETDETVNQKTIAAFKHGLTPIVCCGETNEEYEQDQTKTVVANQVQKALAGLTDEQVKQTVIAYEPIWAIGTGKSSTAEGANEVCAYIRSVVAEQFSQDVADAVRIQYGGSVKPANIKEYMSQSDIDGALVGGASLEADSFLQLLEAGK

SEQ ID NO: 7544 - protein, 434 aa, Bacillus anthracis str. 'Ames Ancestor'
MVVKFTKSEALHKEALEHIVGGVNSPSRSFKAVGGGAPIAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 7545 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETFAVQVPAMPKLRTENPEVKEYLFDVARFWMEQGIDGWRLNVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 7546 - protein, 75 aa, Brassica napus
  misc_feature (3)..(3): Xaa can be any naturally occurring amino acid
  misc_feature (13)..(13): Xaa can be any naturally occurring amino acid
  misc_feature (23)..(23): Xaa can be any naturally occurring amino acid
  misc_feature (25)..(25): Xaa can be any naturally occurring amino acid
  misc_feature (33)..(33): Xaa can be any naturally occurring amino acid
  misc_feature (38)..(38): Xaa can be any naturally occurring amino acid
  misc_feature (43)..(43): Xaa can be any naturally occurring amino acid
  misc_feature (56)..(57): Xaa can be any naturally occurring amino acid
  misc_feature (71)..(72): Xaa can be any naturally occurring amino acid
  misc_feature (74)..(74): Xaa can be any naturally occurring amino acid
  unsure (1)..(75): unsure at all Xaa locations
MAXSMLSSAAVVXSPAQATMVAXFXGLKSSAAXPVTRXANNDXTSITSNGGRVSCXXVWPPVGKKKFETLXXLXD

SEQ ID NO: 7547 - protein, 387 aa, Gibberella zeae PH-1
MPRLPFPAFKSLVIQPLRITPTAINRSYYSTMMRAARYYGREDIRVEQVPQPSVKAGQVKVAPAFVGICGTDLHEYLGGPNFCPTTPHPITKESIPVTLGHEFSGIITEVGPDVEGFEVGQPCAIQPTLFCGHCAACHNHAENVCHSGGFIGLSGSGGGLSESVCVNATHVHPLPQDLPLEIGALVEPLSVSWHAMTAAPDINPDSRVVILGGGPIGLAMILCLKAKGVDEIIVSEVATSRQKFARELGATWVVNPIEENLNEIVLALTEGKGADVVFDCAGVPMSIKSACEVVRPKGTVVNLAIWEKEIPFNPNWITMKESSYKSVLGYTHKDFQAVIANLASGAIKPSQMITRKIKLENIVEDGIKALIHDKNNQVKVLVDMSDR

SEQ ID NO: 7548 - protein, 194 aa, Triticum aestivum
  misc_feature (170)..(170): Xaa can be any naturally occurring amino acid
  unsure (1)..(194): unsure at all Xaa locations
MAATVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVHCVSFIAFKPPGCXESGKAYTAHSRQAIYKVPLQLSQL

SEQ ID NO: 7549 - protein, 478 aa, Bradyrhizobium sp. BTAi1
MRRLRRIKILATLGPASSDSAMIRKLFEAGADIFRINMSHTPHDKLRELVATIRSVEASYGRPIGILVDLQGPKLRLGTFADGPVQLNNGQSFVLDADKTPGDATRVHLPHPEILAALQPGHALLLDDGKVRLIAEETSPTRAVTRVVIGGRMSDRKGVSLPDTDLPVSAMTPKDRADLEAALNIGIDWIALSFVQRADDVLEAKKIIRGRAAVMSKIEKPQAIERLNDIIDASDALMVARGDLGVELPLERVPGLQKLMTRLARRAGKPVVVATQMLESMIQSPVPTRAEVSDVATAVYEGADAIMLSAESAAGKYPIEAVSTMNRIGEEVERDVVYRSVIAAQRPEPESTAGDAIAEAARRIAENLDLPTIICWTSSGSTAVRVARERPKPPVVAITPNLATGRRLSVVWGVHCVVAEDARDQDDMVERAGSIAFRDGFVRAGQRVLVVAGVPLGTPGTTNMVRIAYVGPSSEALL

SEQ ID NO: 7550 - protein, 344 aa, Synechococcus elongatus PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 7551 - protein, 81 aa, Arabidopsis thaliana
  misc_feature (52)..(52): Xaa can be any naturally occurring amino acid
  unsure (1)..(81): unsure at all Xaa locations
ADELIANAVYIGTPGKGMVGADESTGTIGKRLASINVENVETNRRNLRELLXTAPGALPCLRGVILFEETLYQKRSDGELF

SEQ ID NO: 7552 - protein, 856 aa, Ustilago maydis 521
MSQTADSSPRGSNSPSPYPYQRPTGASTIDGIAASARAGPSSCTHLVDTDMHDRSESPADFAARHGAPLARPPPSPSSTSVSDDGVAQPDFADLASIDDADTQTRSVERSFDPSAVRLSRRGTLVPASPTSSNGTWSFQDAPQSTASNLPHEILLHIFQYLVLYPPDLLSCLLVCKSWCLNGVELLWYRPALFKISSLFKLVGVIRKPEQLFPYAQFVRRLNFTLLANQLEDQLFLMMSACTRLERLTLAGCSNITDATLVKVFQNTPQLVAIDLTDVANITDNTLLTLAANCPKAQGINLTGCKNISSHGVAELARNCKRLKRVKLCACENIGDEALLALTEHCPSLLEIDLIHCPKVSDKSLRQMWSRSFQMRELRLAHCNNLTDNAFPSARGTTGVPMLGTSHSQSSRSAIPAASAYTTDSAPTSRGESPSVNMPFDAVRDGVLLTRSASIPNDMAQNRLFEHLRILDLTACTSISDDAVEGIIANVPRLKNLALTKCTRLTDEALYSIAKLGKNLHYLHLGHVSNITDRAVTHLARSCTRLRYIDVACCPNLTDLSITEIANNMPKLRRIGLVKVVNLTDQAIYGLVDRYDSLERIHLSYCENVSVPAIFCVLQRLDRLTHLSLTGVPAFRRPELQAMCRAPPKDFNDHQRQAFCVYSGKGVNDLRKYLQHVYSDEQLAAEFGQLEPRAMNALGGFGEHPGAETAMSQWTAHHAHYAPATFGGGPGAAGIAYAHAQPHAPPQPGAPPLGLVGGAPAPAPIAAGLYHPTAGGIHHAGAGAGITRRRQLTTAEQMYFEQQRQLARYANARRAAQDATLLNRSASTDGANRRGKESGHAVGGKRPVCCSTCHAPR

SEQ ID NO: 7553 - protein, 399 aa, Enterococcus faecalis V583
MNVSNRAQQLTPSVTLAAAAKAKALKAKGVDVLSLTVGEPDFVTPKNIQKAAIASIEDGRASYYTPSGGIPELKQAIVSYVEREYQLRYQPKQVIVTDGAKYALYLLFQAILNVGDEVIIPVPYWVSYGEQVKLAEGKPVFVSSTQEQSFKVSVAQLEAVRTDKTKAIILNSPSNPTGVIYTEEELRQIGEWAVAHNILIIADDIYGRLVYNGHRFTPIATISEAIRQQTIIINGVSKTYAMTGWRIGFAVGDEKIIQAMTQLASQSTSNPVAVSQYAAIEALTGEQSTVEDMRQAFEKRLNHIYPKVAALPGVSLIKPEGAFYLFPNVKKTLEICGYDNVTNWVEDLLQEAHVALVTGEGFGAPEHVRMSYATDLMTLEKAIERMNDFIEKKRIQHNA

SEQ ID NO: 7554 - protein, 467 aa, Pseudomonas fluorescens Pf-5
MTTTTERKGIHLTRSLKSRHIFMLSLGGVIGTGLFMGSGVTINQGGPWGAILSYLGAGFLMYLVMVCLGELSVQMPVSGSFQAHATKYIGPATGFMIGWVYWMSWATTVGLEFTAAGMLMQRWFPGVPIWYWSALFVALLFGINALATRAFGEAEYWFAGVKVLAILSFIVVGALVIFGVIDLPSGAPAPMFDNLKGDSLFPNGLPAVFAVMMTVVYAFQGCEIMGVAAGETDQPEKSIPRAVRNVVFRVLIFYVLAVMVLAAIIPWQQAGLVESPFVQVFDMVGIPYAADLMNFVILTAILSVGNSGLYASTRILWAMSKSGMAPKALSPLSKQGVPLRALFITLCFALISLMTSFIAADTLFMVLMAVSGMAGTVTWIVIALAQYRFRRQFLREGGQLEQLKYRAPWFPLVPLLCIVLCSSLFVFLALDETQRPSLYWGSGFIALCYGAYYLMQRKRQLQPAAAV

SEQ ID NO: 7555 - protein, 434 aa, Caulobacter vibrioides
AIYPVILCGGSGTRLWPASRSDHPKQFLKLVSDRSSFQETVLRVKDIPGVAEVVVVTGEAMVGFVSEQTAEIGAWATILVEPEARDSAPAVAAAAAYVEAQDPAGVVLMLAADHHIAQPEIFQQAALTATKAAEQGYIVTFGVQPTVPATGFGYIRPGAPLLDGSVREVAAFVEKPDQATAERYLLEGYLWNSGNFAFQAATLLGEFETFEPSVAAAAKACVAGLQLEAGIGRLDREAFAQAKKISLDYAIMERTQKAAVAPAAFAWSDLGAWDAIWEASTRDGDGNAQTGDVDLHGSSNVLVRSTGPYVGVIGVNDIVVVAEPDAVLVCHRKDSQAVKTLVDGLKAKGRSIASRKSASPNGTETLVSTDGFDVELRRVPAGETLMLPVSTLQVLEGVIEMDGDVYAAGAIIALDDSVQARAIGAATLLVTKPR

SEQ ID NO: 7556 - protein, 290 aa, Streptococcus agalactiae NEM316
MRIADKTVTRAILERHGFTFKKSFGQNFLTDTNILQKIVDTAEIDKGVNVIEIGPGIGALTEFLAENAAEVMAFEIDDRLIPILADTLARFDNVQVVNQDILKADLQTQIQAFKNPDLPIKVVANLPYYITTPILMHLIEGKIPFAEFVVMMQREVADRISAMPNTKAYGSLSIAVQYYMTAKVSFIVPRTVFVPAPNVDSAILKMVRRDQPVVSVQDEDFFFRVSKVAFVHRRKTLWNNLTSHFGKSEDTKAKLEKALEIAKIKPSIRGEALSIPDFASLADALKEVGI

SEQ ID NO: 7557 - protein, 253 aa, Desulfovibrio desulfuricans G20
MYKLVLVRHGQSTWNLENRFTGWTDVDLTPLGETEAREGARLIAAAGLTFDECHTSVLKRAIRTLNIIQEELDLLWLPVHRHWRLNERHYGALQGLNKKEMSEKYGEEQVFIWRRSFDTPPPALTADDPRHPAHDRRYASLTARQMPLCESLKDTVARVLPYWHETLAPAIQAGRRLLVAAHGNSLRALVMHLDGMSPDEVTGLNIPTGLPLVYELDSNLTPLRRAYLGDAEAAEAKARAVAEQAKAGTTERP

SEQ ID NO: 7558 - protein, 247 aa, Yarrowia lipolytica CLIB122
MSRTFFVGGNFKMNGSLESIKAIVERLNASELDPKTEVVISPPFPYLLLAKESLKKPTVSVAGQNSFDKGDGAFTGEVSVAQLKDVGAKWVILGHSERRTINKESSEWIADKTKYALDNGLDVILCIGETIDEKKAGKTLDVVRSQLDPVIAKIKDWSNVVIAYEPVWAIGTGLAATAEDAQQIHHEIRAYLKDKIGAQADKVRIIYGGSVNGKNSGTFKDKSDVDGFLVGGASLKPEFVDIINSRL

SEQ ID NO: 7559 - protein, 274 aa, Glycine max
MEIFPIPAESYTLGFIGAGKMAESIARGAVRSGVLPPSRIRTAVHFNLARRGAFESFGVTVLPSNDDVVRESDVVVLSVKPQLVKDVVSKLTPLLTKNKLLVSVAAGTKLKDLQEWAGNDRFIRVMPNTPAAVGQAASVMSLGGSATEEDGNIIAQLFGSIGKIWKAEEKYFDAITGLSGSGPAYVYLAIEALADGGVAAGLPRDLSLSLASQTVLGAASMVSQTGKHPGQLKDDVTSPGGTTITGIHELENGGFRGTLMNAVVAAAKRSRELS

SEQ ID NO: 7560 - protein, 334 aa, Haemophilus influenzae 86-028NP
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVASGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKEE

SEQ ID NO: 7561 - protein, 340 aa, Oryza sativa (japonica cultivar-group)
MEPMSVDGGGGCGGLDTQIEQLMQCRPLAEQEVKALCEKAKEILMEESNVQIAHSMCTYNSAKTFSKYLHVLFHGNLPVKSPVTICGDIHGQFHDLVELFRIGGKCPDTNYLFMGDYVDRGYYSVETVTLLVALKVRHPHRITILRGNHESRQITQVYGFYDECLRKYGNANVWKIFTDLFDYFPLTALVESEIFCLHGGLSPSIENLDSVRSLDRVQEVPHEGPMCDLLWSDPDDRCGWGISPRGAGYTFGQDISEQFNHTNNLKLVARAHQLVMEGYNWAHEQKVVTIFSAPNYCYRCGNMASILEVDDCNSHTFIQFEPAPRRGEPDVTRRTPDYFL

SEQ ID NO: 7562 - protein, 141 aa, Vibrio parahaemolyticus RIMD 2210633
MALERTFSIVKPDAVERNLIGEIYNRIEKAGLRIIAAKMVHLTEEQASGFYAEHEGKEFFQPLKEFMTSGPIMVQVLEGENAIARYRELMGKTNPEEAAAGTLRADYALSMRHNSVHGSDSPESAAREIEFFFPESEICPR

SEQ ID NO: 7563 - protein, 347 aa, Wolinella succinogenes
MPLNRVREAIEAIKKGEMIIMMDDEDRENEGDLVYAAAFSTPEKVNFMVSEAKGLVCVCVTSTCSDRLGLAPMVRENNSQHETAFTVSIDARECSTGISAFERDLTIRKMVDGTSKPEDFVRPGHIFPLIAKEGGVLVRTGHTEGSVDICKLAGVAPVAVICEIIKKDGHMARRDDLMEFAKEHHLKIVYISDLIEYRMQNEMLILIKERSEVEFLGKRAERYVFQDHHRREHTLYAFGKIIDNSLVKYHTVGKDLSLLESEKKYSTLMQAIKKIQEENGLIIFMDTPQNAAPQIKDFGIGAQMLRFLGIKNFRLLTSEENREYVGLSGFGLNVTEKIVLQGGPIQL

SEQ ID NO: 7564 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 7565 - protein, 248 aa, Burkholderia sp. 383
MYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 7566 - protein, 402 aa, Pseudomonas fluorescens Pf-5
MRFSRLTQRIAGDGAAAWDIHYRALAKRERGEEVWLLSVGDPDFDTPQPIVQAAIDSLQAGHTHYADVRGKRALREAIARRHQQRSGQVVDAEQVVVLAGAQCALYSVAQCLLDPGDEVIVAEPMYVTYEAVFGACNAQVVPLPVRAEDGFRVQPEAVAARITGKTRALVLNSPHNPTGASIPRSTWEALAALCIEHDLWLICDEVYSELLYEGEHVSPASLPGMAERTATLNSLSKSHAMTGWRLGWVVAPTALAAHLENLALCMLYGSPEFIQDAAVVALEQPLPQLREMAEAYRQRRDLVCDCLADCPGARPLKPDGGMFVMVDIRATGLSAQAFSERLLDEQGVSVLAGEAFGPSAAGHIRLGLVLQADDLREACRRIALCARQCLAERDAPVTVQPV

SEQ ID NO: 7567 - protein, 276 aa, Prochlorococcus marinus str. MIT 9211
MPFSIGIIGLGRMAQAILTPLLERGDFKPDEVLGVVGQRSSVKKVLGEFSQDLSIVSSDNPVSLEVWNSPIQLLAVKPQQLNDIKEQVSQLEIVPDRPKPVLISILAGVNLKRLQSIFPAHNCVRAVPNIPVIVRSGLTGLSWGAGVTTDQRLSVEAIFKPISEVLELPEKQLDAFLALTSSGPAYVAVIAEALADGAVAAGLPRSLANDLSNMTLAGSAKLLKESNLHPGELKDMVASPAGTTITALRHLEMAGIRSALIEAVVLAAERSRELGC

SEQ ID NO: 7568 - protein, 398 aa, Burkholderia vietnamiensis G4
MSSNRGVVYLGPGKVEVQKIDYPKMVDPTGRAIGHGVILKVVSTNICGSDQHMVRGRTTAPVGLVLGHEITGEVVEVGPDVETLKIGDLVSVPFNVACGRCAMCKDTHTGVCLNVNPSRAGGAYGYVDMGGWIGGQAEYVLVPYADFNLLKFPDRDQAMAKIRDLTCLSDILPTGYHGAVSAGVKPGSTVYIAGAGPVGMAAAASARLLGAAVTIVGDMNAERLAHARAMGFETVDLSKDASLGEQIAQILGVPEIDCAVDCVGFEAHGHGSSGSAEEAPATVLNSLMEITRPAGAIGIPGLYVTDDPGAKDKAAQHGSLSIRFGLGWAKSHSFFTGQTPVLKYNRNLMQAILFDRLPIAKIVNVEVISLDQAPEGYKKFDGGAPRKFVIDPHGLLAA

SEQ ID NO: 7569 - protein, 473 aa, Prochlorococcus marinus str. MIT 9211
MSKKPREVLSQIKDEGIELIDLKFTDIHGKWQHLTVTADMVDEEAFKSGLAFDGSSIRGWKAINESDMAMVPDASTAWIDPFYRHKTLSLICSIQEPRSGEPYARCPRALAQKALSYLSSTGLADAAFFGPEIEFFLFDDVRYNSSEGNSFYSVDTIEAPWNTAREEEGGNLAYKIQYKEGYFPVSPNDTAQDIRSEMLLLMGQLGIPIEKHHHEVAGPGQHELGMKFASLINAADNVMTYKYVVRNVAKKYGKTATFMPKPVWNDNGTGMHVHQSLWKNGQPLFYGEGTYANLSQTAKWYIGGILKHAPSFLAFTNPTTNSYKRLVPGFEAPVNLVYSQGNRSAAVRIPLTGPSPKAKRLEFRSGDALANPYLAFSAMMMAGIDGIKNQIDPGDGVDVDLFELPSEQLSKISTVPSSLNDALDALKADNSYLTEGGVFDSDFIDNFIELKYEEVQQLRQRPHPHEFFMYYDA

SEQ ID NO: 7570 - protein, 389 aa, Campylobacter coli RM2228
MLTQRSQVLEESITLAITALANELKAKGEDVISFSAGEPDFDTPQTIKNAAIAAIEKGCGKYTAVAGIADVLKAIQNKLKKDNNLSYETSEIITNVGAKHSLFECIECLVEEGDEVIIPSPYWVSYPEMVKFAGGKPVFIEGLEENGFKINAEQLKKAITPKTKILMLNSPSNPVGSIYNKEELLSIAKVLEGTKIIVLSDEMYEKLRYDGFEFVAFASVSENALNRTVTINGLSKCGAMPGWRFGYMASKNKALISAVKRLQGQSTSNICSITQHAAIPAFNGECDEDIEKMRQAFEKRRDLALNMLHQIPNISVYKPEGAFYLFVNTQKIEKDSMKFCQKLLEQEKVAVVPGIGFGMDGYFRLSYATSDELIKKGIERIANFIKNYK

SEQ ID NO: 7571 - protein, 1755 aa, Gibberella zeae PH-1
MSDKTRQSSGGRSLFSRSKHKEKRLNEDLRYPADDAASFRSSRHKRESSAISFDGRPESSDGGINQMAGVITSIPYDTIGGGSRSPVPVEYLPKGEQMPVRRGEPLPHHLNQNGQDYHQYPSWDGSGQSGARSPGRQPAGFGYPNANVTMASTGRQTQYQQWGPARGSSSHSNNAPNPRYDSLMSSTARGSADNLSIQSGNSRHAHTMISRSPRTAMPSASSQSSYAASQYSNRDSHRFTKFPSGPPPGQSDPQGGFYFPKPDDDNVVEQMFLQLMQKRGWHNLPEQARRQMMAYPAQKKWTLLYQDRLTEWQGEQKRRQTARPTQYTATPDITTYSDEEGTPEWYVRRVMEDRLDTKGMGSLEVNLRTQQIGWVKRFVECQGQVALMTLLLKINRKTAQGPAQDSGRIDRGLDREYDIIKCVKALMNNKFGADDALIHQKVMVALASSLISPRLTTRKLVSEIITFLCTWGENSEGHLKVIQALDEVKVASGENGRFDAWMRLVEVTIDGRGKMGSLVGASEELRTGGIGMENLLMEYAVATLMLVNMIIDSPERDLELRIHIRAQFTACGIKRILTKMEEFQYELLDKQIERFRTNEAIDYEDMLERENSSIKDDVEGEVKDLTDPVQIADAIQQRLQGTKTQDYFISALQHLMLIRANDGEERLRMFQLVDSMLSYVAMDRRLPNMDLKQSLNFTVQSLLDKLHTDSEARQAQDEALESRQIAEAAMAERDEVKAQLELGADGLVAKLQRQLEEQARFIDAQRRQADGLKAELDSMQTMRAKEAQRYELETRELYLMLRDAQDVAASKAIKSANVTASKTAPPEDPARMQGILDRNRLMERLQMQIERQKTQYKLEGRVWGDAVGPSDRLRALREEMDDRPGTPPGGGTPPRDFTNSVLGSINRNTKIPRKPLKRRSDGEVIEEDDETEGEDGVVYEKPRIVEMKRPTIDAKQQAGLLGEIGSKVKKYDGSDSEDDTTGPSHPSMETSSPITPPGDGETPKIEVTAAGAAPPPPPPPPPPLPMPGQLSGAPPPPPPPPPPPMPGQIPGGPPPPPPPPPMPGMLGGPPPPPPPPPMPGAGGMPPPPPPPMPGGAMSGHYLSRQPAFGATPGIGLPVVRPKKKLKALHWEKVDAPETSHWAAHTPSAEAREEKYQELSKKGILDEVEKLFMAKEIKKIGMGGSSKKDDKKQIISSDLRKAYEIAFAKFSQHSVEKVVQSIIQCDSEILDNVVVMDFLQKDDLCNIPDNTSKQMAPYSKDWTGPEAKSQTRELDPTELTRQDQLYLYTAFELHHYWKSRMRALALTRSFEQEYEEINDKIRQVVTVSESLRDSVSLMNVLGLILDIGNYMNDANKQARGFKLSSLARLGMVKDDKNESTLADLVERIVRNQYPEWETFADDINGVMTVQKINIEQLQADAKRYIDNIRNIQMSLDSGNLSDPKKFHPQDRVSQVVQRIMKDARRKSEQMELYLEEMMRTYKDIMVFYGEDPADDGARRDFFAKLALFVGEWKKSRDKNVQVEETRRRNEASMKRKHTAQLKLTSNSTEAGPISPSNTGAMDSLLEKLRAAAPQARDQRDRRRRARLKDRHQVRVASGQKIPDIDEIPEAEATIKAAEAPSEDDSTVLSPGMSSPRSGGDDLADRAAALLQGMRSGDGADDENPERRETLRKARRQTAEEERRLRRRRRDRTATNQSEENAEEHKEESRPESKGGEDEAAKEQHSEAEPPTEDDVPTPKADAAGDGAVEEDHGEKA

SEQ ID NO: 7572 - protein, 377 aa, Debaryomyces hansenii CBS767
MPSAVQLAEKNHEKDSKFAKALHGESYKQTGLKALMSKARDASEVANDGYFKHWDGGVTKEDEDKRLSDYSNLTAHYYNLVTDFYEYGWGSSFHFSRYYTGEAFRQATARHEHFLAHKMQINENMKVLDVGCGVGGPAREICRFTDCSIVGLNNNDYQIERANHYARKYKLDDKLSFVKGDFMQMDFEAESFDAVYAIEATVHAPVLEGVYSEIYKVLKPGGVFGVYEWVMTDKYDDENEEHRKIAYGIEVGDGIPKMYKREVAEKALKSVGFEIEYEADLADKEDDIPWYYPLSGEWKYVQTLSDYFTIFRTSKVGRTITTEAVGLMEKLGLAPKGSKQVTNALEDAAVNLVEGGRQKLFTPMMLYVCRKPANEDI

SEQ ID NO: 7573 - protein, 1145 aa, Pinus sylvestris
MVSISSDQACTIPKLYANFFLGSDIEFVRPDGRPEFFNADRFLSYYHSMTFAVNQEGQALLPGRKLLAMELHEPFFESWDPRHENPCKWTGVICSLDHENLVTEINIQSVQIAGNVPSQFAVLGSLRSLVISAANLTGSIPAEIGGYESLEILDLSGNRLRGNIPAEISKLKNLKSLILNSNQLQGSIPAEIGNCHNLVDLVVFDNQLSGKIPAELGRLANLEVFRAGGNENIEGTLPDELSNCTNLVTLGLAETNISGKIPLSFGSLKKLQTLAIYTAFLSGTIPAELGNCSELVNLYLYENRLSGAIPRELGKLQKLEKLYLWDNELDGSIPAELGSCSSLKFVDLSTNSLSGSIPDSFGSLKNLSELEITDNNVSGSIPAALANCTELTQIQLYNNQISGQMPAELGALKKLTVLFLWQNNLEGPIPSSLGSCDNLQSLDLSHNRLTGSIPPSLFEIKNLTKLLLLSNELTGALPPEIGNCVALSRLRLGNNRLLNQIPREIGKLENLVFLDLAMNQFSGSIPAEIGGCSQLQMLDLHGNRLGGELPRALGFLHGLQVVDLSANELTGLIPANLGNLVALTKLTLNGNALSGAIPWEISRCTNLQLLDLSLNRFSGQIPPEMGKCKRLEIALNLSWNNLSGSIPAQFSGLTKLASLDLSHNLLSGNLSALAQLSESCFSQHFFQRFFRVSARYQVFSDLCLPSDLSGNAALCTSEEVCFMSSGAHFEQRVFEVKLVMILLFSVTAVMMILGIWLVTQSGEWVTGKWRIPRSGGHGRLTTFQKLNFSADDVVNALVDSNIIGKGCSGVVYKAEMGNGDVIAVKKLWTGKESECEKVRERDSFSAEVNTLGAIRHRNIVRLLGCCTNGRSKLLMYDYMPNGSLGGLLHEKRSMLDWEIRYNIVLGVRRGLSYLHHDCRPPILHRDVKANNILLGSQYEPYLADFGLAKLVDSADFNRSSTTVAGSYGYIAPEYGYTMKITQKIDVYSFGVVLLEVVTGKQPIDPTIPEGVHLVEWARDAVQSNKLADSAEVIDPRLQGRPDTQIQEMLQVLGVAFLCVNSNPDERPTMKDVAALLKEIRHDCHDYNGKADLLLKQTPAPGSTRSPNPTADARSPVGSSFGLEYSSASTTAHESYSLHSSVSNVI

SEQ ID NO: 7574 - protein, 319 aa, Fragaria x ananassa
MAKVPSVTLSSCGDDIQTMPVIGMGTSSYPRADPETAKAAILEAIRAGYRHFDTAAAYGSEKDLGEAIAEALRLQLIKSRDELFITTKLWASFAEKDLVLPSIKASLSNLQVEYIDMYIIHWPFKLGKEVRTMPVERDLVQPLDIKSVWEAMEECKKLGLARGIGVSNFTSSMLEELLSFAEIPPAVNQLEMNPAWQLKKLRDFCKAKGIHVTAYSPLGAARTKWGDDRVLGSDIIEEIAQAKGKSTAQISLRWVYEQGVSIVTKSYNKERMRQNLDIFDFCLTEEELEKMSHLPQRKGVTFASILGPHDIVLKVDEEL

SEQ ID NO: 7575 - protein, 238 aa, Triticum aestivum
MAAPPSSVSVRAGASVSAKLTPRQAARAGFGGRVSVSSGRKCGGPVRASLFSPKPAVAMDARPTKVQELHVYELNERDRESPAYLRLSAKQSQNALGDLVPFTNKVYNGSLDKRIGITAGICILIQHVPERNGDRYEAIYSIYFGDYGHITVQGPYLTYEESYLAVTGGSGVFEGVYGQVKLNQIVFPFKIFYTFYLKGIPDLPKELLCTPVPPSPTIEPTPAAKATEPHACLNNFTD

SEQ ID NO: 7576 - protein, 514 aa, Legionella pneumophila str. Paris
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWERVEPVYNLLTQGKSERQFPDAETAIHFYYKNKISDEFVPPTLIGKEHSIQDGDAVLFFNFRADRARQLTSTFLDPLFKGFERKTLPKLSCFVSMTQYDKNLFTTTAFPPVPLNNTLGEVLSSHGLSQLRIAETEKYAHVTFFFNGGCESVFTNEERIMVPSPQVATYDLQPEMSAHELTKTLIAAINSRDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHA

SEQ ID NO: 7577 - protein, 1314 aa, Debaryomyces hansenii CBS767
MSSHQRQDSIASLSSTATGNIHPQKIGPWKLGKTLGRGATGRVLLATHQSTGQKAAVKVVSKSELNDDEINKKSADEAGLPYGIEREIIIMKLLTHPNVLRLYDVWETSKALYLVLEYVEGGELFDLLVERGPLQEVEAIKYFRQIILGTAYCHALGICHRDLKPENLLLDSGLNVKLADFGMAALESNGKLLETSCGSPHYAAPEIVSGLKYHGAASDIWSCGVILFALLTGRLPFDDENIRNLLLKVQAGSFEMPCELSPEAVDLIDKMLTVDPMKRIPTERILSHPLLTKYPIPNEDLISVKSLPHPETAYKSLGSEKNIDKQILQNLSILWHDRSQGDIVDCLLKTGSNPEKTFYALLMRYRHNQEESAGSSPTRSNSQNFNNKIGNKDNNRKKRMSQVSASTSRNRPVLFQYKNGIKSSIGNGNGRLSSTSSVSNSPRKSPVRRSSNRYSFAQSPRKFGGTSDETTLHSSSVPRNIYNEIVSAQRNGQGVMPPPLPSKDNMDSKSNPIVDEVSNQDLLSSAKISPTKNKRGSVIRNSISKNRLSRRKSRTSFTPGLKRNSITTKLLSTYAKLAGETDWEFMDKQTKRTSATFATLCDKIFNQEQYDAEDEKLIDEEEKQAKEYERLMEIERKKHEAELRARKELAKQRKREKRKSLLSSRKLSILVKDDANNSEQDITVTDSDALSQPKRQSRNQAMRSISEGHGKESDDLTKEDLENLKRRSVTQPTPRRRKTPVLTRRPVSRLDPLWTAYENEEIERAQDALEAEYRDADFKTKKKINRESMVSVMDDKEVDNEPHVDDDATDEVQDEEAVKAKSRGYELPEPDMERSDLSDEYMSEIRKSRLLNSQLNINAIANGEKEVKSEKRQDKEPKTLIGDVRIPTVTRKSRCFTNSNKRLSVLSMYSTKQSYRDLNSILGDENDENNDVEGQLPQLRTSFADRLDRAGLADAEEEDDEPLDEGSIMDFDQHLANKRSSYYAGDKSRRQSRYSTTKRNSQAPTVDVPAIPKKSNKERDREDDTFVTKDDDVHRRKSAYSAKGANNNDDEDMIFENIKLPNEDRRQSASTAKSNKKKSFQPSAESMLIPNVDNIPEDAKTRKPDPRSQPYEKVRKPKVSNGELKSTGPEGQVKNPLEDTTNEPRENQKRKGSIFRKLSWGSKKTMDNSAAQLPSPADSRAPSVEEKPKSKSGFFRWFSSSSNQPGIESEIRRFKAILPKQEMSSALFALLNSWSNFGLKNLRNDTVGYNITGEISKNNAFNLKNCKFRIKVNPREFNQKSEIVCARVKGSKVTTDTLFKEIEKVLQKEGVMDI

SEQ ID NO: 7578 - protein, 173 aa, Flaveria pringlei
MASIPATVATVAQANMVAPFTGLKANAAFPVTKKVNDFSTLPSNGGRVQCMKVWPPLGKKKYETLSYLPDLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPGGF

SEQ ID NO: 7579 - protein, 178 aa, Flaveria pringlei
MASISSTVATVSRAAPAQANMVAPFTGLKSNVAFPATKKANDFSTLPSNGGRVQCMKVWPPLGKKRYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPEGF

SEQ ID NO: 7580 - protein, 160 aa, Zea mays
MDAGAKVVKKAAAGRRGGGGPKKKPVSRSVKAGLQFPVGRIGRYLKQGRYSQRVGTGAPVYLAAVLEYLAAELLELAGNAARDNKKNRIIPRHVLLAIRNDEELGKLLAGVTIAHGGVLPNINPVLLPKKTAVAAAKEGKEKKSPKKAAAAKSPKKVAAS

SEQ ID NO: 7581 - protein, 156 aa, Triticum aestivum
MPSAGPSMSAADGLLALAEEAERRRDFTTATSCLESALSPPHAASLLPLAEARARMRLAGLLLARSKGLANAKAHLERALLVLNPLPSAPPRLKLLAHSLLATVYGLLGAVPSQKHALRRGLSLLASASASGLLPSGPALLWTSNFQAQLASALVV

SEQ ID NO: 7582 - protein, 351 aa, Gordonia sp. TY-5
MKALVFHGPGQKAWEDVPDPKLSEPTDVIVKMDTTTICGTDLHILKGDVPAVTPGRILGHEGVGTITEVGDAVTTLAVGDQVILSCISSCGKCSFCKQGVYSHCLGSEGTSGIGWIFGHLIDGTQAEYVRVPYAENSVHKLPSAVSPEQGTLLSDILPTGHEIGVRHGAVKPGDVVAVIGTGPVGLAAIATAGLYGPSRVIAVDIDANRVEQARRFGATDGVVSTSSGWREEILAMTDGLGVDVAIEAVGIPDTFQMCLDIVRPAGHVANVGVHGKPVELPIQDLWISNIVMSMGLVNTNTLGTLLKLVAQRRIDPEPFISHRFGLGEIIDAYDVFSRAAETKALKVIMSA

SEQ ID NO: 7583 - protein, 343 aa, Burkholderia thailandensis E264
MKALAKLERGPGLTLTRVKKPEVGHNDVLIKIRRTAICGTDIHIWKWDDWAQKTIPVPMHVGHEYVGEIVEMGQEVRGFSIGDRVSGEGHITCGFCRNCRAGRRHLCRNTVGVGVNREGAFAEYLAIPAFNAFKIPPEISDDLAAIFDPFGNATHTALSFNLVGEDVLITGAGPIGVMAVAIAKHVGARNVVITDINDYRLDLARRMGATRAVNVSRESLRDVMADLHMTEGFDVGLEMSGVPSAFTSLLESMNHGGKVALLGIPPAQTAIDWNQVIFKGLEIKGIYGREMFETWYKMVAMLQSGLDLSPIITHRFAVDDYEKGFAAMLSGESGKVILDWAAA

SEQ ID NO: 7584 - protein, 307 aa, Gibberella zeae PH-1
MTGLRNATLTILGTGNITKPIVKNLLPAIKNGKTDLPFTKIIACVRSEASEKKLNEQFSEYSTALTVSRGDNVTAVQQGHVIILGVDPADIESVLTQDGIRDALSGKLLISVAAGWTREKIEATIYGSETTKDNWSGRSWVIRTLPNIACMVSEGLIAIEKSPSKPEVPKEHRDLAKAIFTTIGETVEVPPRLMNATTAVGGSTPAFWAIICDAFIDASVAVGVPRADAQKMIYQSMKGSAAMLQSGLQPGDLRDQGTSPEGCTIGGIMVLEEAGVRGHLGRALREAVTTARLMETTAHVNDTRPTS

SEQ ID NO: 7585 - protein, 256 aa, Yarrowia lipolytica CLIB122
MTREDNIYLARLSEQAGRYEDMVEYMKEIATGDQELSVEERNLLSVAYKNVIGAHRAWWRVVSSCEQKEEQKGKETKIIDDFRQKIEAGLQDICHDILNVLEKHLIPKLEKPSAEATEAAAKDGADPSELSESIVFYYKMKGDYYRYLAEFTTDDKRKEAAEKSLQAYQFASDEATSKLPPTHHIRLGLALNFSVFYYEILNSPERACQLAKQAFDDAIADIDSITEERSKDYALIMQLLRDNLTLWTNNDEPEQA

SEQ ID NO: 7586 - protein, 318 aa, Streptococcus agalactiae NEM316
MDKKKILVTGIVPKEGLRKLMDRFDVTYSEDRPFSRDYVLEHLSEYDGWLLMGQKGDKEMIDAGENLQIISLNAVGFDHVDTAYAKEKGIIVSNSPQAVRVPTAEMTFALILAASKRLAFYDSIVRSGEWIDPSEQRYQGLTLQGSTLGIYGMGRIGLTVANFAKAFGMTVVYNDVYRLPEDKEKELGVTYLEFDQLIKTADVITIHAPALPSTIHKFNKDVFAKMKNRSYLINAARGPIVSEEALIEALKEGEIAGAGLDVFENEPQVSEGLRSLDNVIMSPHAGTGTIEGRRTLAEEAADNIIAFFDGKPQNIVNK

SEQ ID NO: 7587 - protein, 105 aa, Brassica napus
  misc_feature (16)..(16): Xaa can be any naturally occurring amino acid
  misc_feature (92)..(92): Xaa can be any naturally occurring amino acid
  unsure (1)..(105): unsure at all Xaa locations
RLSLENPWMTWKNFGXPVLKEGLGIKRKGIKELAVLFRLGMNYVLEKLRFFTAWMDVFGMEVEPSPKIIVAFGHSVKAGKLQSQNNLFFLNXDAALKKVFGEQNL

SEQ ID NO: 7588 - protein, 340 aa, Brassica rapa subsp. pekinensis
MDHEADAYRTDLMTITRFVLNEQSKYPESRGDFTILLSNIVLGCKFVCSAVNKAGLAKLIGLAGDTNIQGEEQKKLDVLSNDVFIKALVSSGRTSVLVSEEDEEATFVESSKRGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAAEENN

SEQ ID NO: 7589 - protein, 245 aa, Bacillus cereus ATCC 14579
MIKLVLIRHGQSLWNLENRFTGWTDVDLSENGLSEAREAGAILKKNGYTFDVAYTSVLKRAIRTLWIVLHEMDLTWVPIHKSWKLNERHYGALQGLNKDETAQKYGEEQVHIWRRSVDVRPPALTEDDPRYEATDPRYKTLKKGEFPLTECLEDTEKRVLAYWHSEIAPTLKSGNKVIISSHGNTIRSLVKYLDNLSSDGVVSLNIPTSIPLVYELDENLRPIRHYYLSMDGEVPEGEIPKHISF

SEQ ID NO: 7590 - protein, 173 aa, Flaveria pringlei
MASIPATVATVAQANMVAPFTGLKSNAAFPVTKKVNDFSTLPSNGGRVQCMKVWPPLGKKRYETLSYLPNLTESQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 7591 - protein, 178 aa, Flaveria pringlei
MASISSTVATVSRAAPAQANMVAPFTGLKSNAAFPATKKANDFSTLPSNGGRVQCMKVWPPLGKKKYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 7592 - protein, 497 aa, Arabidopsis thaliana
MAMLGFYVTFIFFLVCLFTYFFLQKKPQGQPILKNWPFLRMLPGMLHQIPRIYDWTVEVLEATNLTFYFKGPWLSGTDMLFTADPRNIHHILSSNFGNYPKGPEFKKIFDVLGEGILTVDFELWEEMRKSNHALFHNQDFIELSVSSNKSKLKEGLVPFLDNAAQKNIIIELQDVFQRFMFDTSSILMTGYDPMSLSIEMLEVEFGEAADIGEEAIYYRHFKPVILWRLQNWIGIGLERKMRTALATVNRMFAKIISSRRKEEISRAKTEPYSKDALTYYMNVDTSKYKLLKPNKDKFIRDVIFSLVLAGRDTTSSVLTWFFWLLSKHPQVMAKLRHEINTKFDNEDLEKLVYLHAALSESMRLYPPLPFNHKSPAKPDVLPSGHKVDANSKIVICIYALGRMRSVWGEDALDFKPERWISDNGGLRHEPSYKFMAFNSGPRTCLGKNLALLQMKMVALEIIRNYDFKVIEGHKVEPIPSILLRMKHGLKVTVTKKI

SEQ ID NO: 7593 - protein, 173 aa, Flaveria pringlei
MASIPATVATVAQANMVAPFTGLKSNAAFPVTKKVNDFSTLPSNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 7594 - protein, 259 aa, Coccidioides immitis RS
MPQNESVKASESEFDLDHEERTRKRIARESHKQSQDAQTLRGLRAKLYHKKRHAEKIQMRKRIKAQEERDVKSAAPNEPSTTPLPQYLLDRSQATNAKALSSAIKEKRAEKAAKFSVPLPKVKGISEEEMFKVVKTGKKTSKKSWKRMITKPTFVGNDFTRRPVKYERFIRPMGLRYKKANVTHPELGVTVQLPIISVKKNPQSPMYTQLGVLTKGTIIEVNVSELGLVTAGGKVVWGKWAQITNNCENDGCVNAVLLV

SEQ ID NO: 7595 - protein, 204 aa, Schizosaccharomyces pombe
MLASIEEAVNDFRDGKFLIVLDDETRENEGDLIIAGCKVTTEQMAFLVRHSSGYVCVPMTGERLDSLEIPMMVDNNEDRMRTAYAVTLDYANGTTTGISAHDRALTTRQLANPEVTSPREFNRPGHIVPLRARDGGVLERDGHTEAAVDLCKLAGLPPVGAICELVREEDGLMSRFDDCISFGKKWGIKVITIESLKSYIKGRM

SEQ ID NO: 7596 - protein, 511 aa, Burkholderia sp. 383
MSAIPKSDPSGSSANPPKLHRALKARHLTMIAIGGSIGTGLFVASGASISQAGPGGAMVAYMAIGLMVYFLMTSLGEMAAFMPVSGSFATYGAKYVDEGFGFALGWNYWYNWAVTIAVELVAAQLVMHYWFPDVPGVWWSAAFLGVMFLLNALTVRGFGEAEYWFALIKVVTVVAFIGVGLLMIFGILKGAPSNGWGNLTIGDAPFAGGLPALMGVAMIAGFSFQGTELIGVAAGESENPRTTIPRAVRQVFWRILLFYVFAIFVIGVLIPYTDPNLLKTDVTDIGVSPFTLVFRHAGLAFAAGVMNAVILTAVLSAGNSGMYASTRMLYNLATEGRAPKIFAKLSRGGVPRNALYATTAVGALCFFTSLYGDKTVYLWLLNTSGMTGFIAWLGIAVSHYRFRKGYVKQGYSLDQLPYQSKWFPFGPLFAFVLCLVIALGQDYQAFLANRIDWAGVAATYVGIPLFLVVWLGFRFLKKSRLVRYEDMEIAPWIAAGRGAQQQPVANRETAG

SEQ ID NO: 7597 - protein, 182 aa, Fagus crenata
MASSMISSATVATVSRATPAQATMVAPFTGLKSTAAFPATRKSNNDITSLASNGGRVQCMKVWPPLGLQKFETLSYLPPLSIESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPAK

SEQ ID NO: 7598 - protein, 459 aa, Nostoc sp. PCC 7120
MLTQLPNPISVPSWWQLINWIADPIGFQKKYSKKYGNIFSMQLAGIGSFVILGEPQALQEIFTQDSRFDVGRGNTLAEPLIGRTSLMLMDGDRHRRERKLLMPPFHGERLQAYAQQICLITNQIASEWQIGQPFVARSAMQKLSLEVIIQIVFGLADGERYQQIKPLFTDWLNMTDSPLRSSMLFLKSLQKDWGTWTPWGQMKHKQRSIYDLLQAEIEEKRTKENEQRGDVLSLMMAARDENGQAMTDEELKDELLTILFAGHETTATTIAWAFYQILKNVNVQEKLQQELDRLGANPNPMEIAQLPYLTAVSQETLRMYPVLPTLFPRITKSSINIAGYQLEPDTTLMASIYLIHYREDLYPNPQQFRPERFIERQYSPSEYIPFGGGSRRCLGIALALLEIKLVIATVLSNYQLALAEDKPVNVQRRGFTLAPDGGVRVIMTGKKSLKFEQSSKIFN

SEQ ID NO: 7599 - protein, 1755 aa, Debaryomyces hansenii CBS767
MRRRPNDSSSSHPNQLDSTINEELNNSRAYNSYKKGGQSGGPNNNNTNRISTSSFFSLKKNRNQSVNDSYSDTSSFDSSSILSGGTGNLSHNNKRHNSVVSTNKSNTNIIPTSQVTNSNHSRHASTYSISTVSNPYETKTSRSVHNNALSRKPTGSSMISKPSLSLANANETSNSGVNGFVLEKPELVYEIDRMFRDLMDKRDFKSLPPQAKQEMNNYSPDKKWMLIYQDALTEYKRQERVVHNKEENATPEFYTKLLLAKTITAQQLKNLWVSLRTEPIDWVRSFIYDCQGDAILSAYLIKIQDSINQSDINDINDDIFDKEFNTLKALKCMMNQKLGAERVRTDVNLYVNAVSGSLLSPRILTRKIAAESLTFMIAYYSHNNDNDNQNAYHKILRALDNISMKPFFEFESGNDAPQSTSSKKKLVRKPPAGESYKRFELWLKSVEKIIDGKGKYMNSLVGASEELKFAYTGNSNQGNLENHLLEYCLGTMLLINTIVEYGVDFRVRIHLRAQFFSAGLDRLFAKFHELNYENLNQQCAKFIDLANSDESYLKNKEQIDENLDFNDPVELVGSLWKNIKNSEAQGFFLSAIQHLYLNQSEKKDDADELLRSLKLLDGLIQNVTMVHTTNDDSAVGIAINKLFASLSTDDMYRKAIEESRNFKQIAEEATAERDELSRQLSMGADGLITNLSNEIKEQETVLYRTRRLNEELSQELEDLKRRHLVEKQEQELEMREMLIMLNDNALLESKRNGPKTTVLIQTSNEKLVKKLQKEIHRRKAEYKLDNRQFGTQVEPSSRLRALRDQMGDIENMARELEMTDFETYVDPSLNNVELKPDPIESKELTETSEDEFEDAESTAQSIIEAPEVDIPKGPPRPCREDDLEKLDSLRKKLSSLQSESNDIMKFNNSSMFSKQKYLAMERLRELQNNFKDFNIDFSVDDEESNSFSFEHVDPSIKAKIHEELEQVEKLKKSLEMKLSSLNIKPANSSKPENTMHRLEAKYMHGKKPIAEGAIKSTHAKDYRRHRNTTTEGMDPKFLKELSSTVNKAMPIDGFDDEKPTNNEEEPKTKQAVLPPPPPPPLPPSLDPSSSGSVPPPPPPPPLPSMLGASGNNAAAPPPPPPPPPPPAFLSSGSGSPAPPPPPPPPFPTGKAPKEIERSATASPVPGPFDNYPRPKKKLKQLHWEKFDNNTSNSFWQNAQTNTIANELMTKGIFDEIELIFAAKEIKKLATKKKEDIDKLTFLSRDVAQQFGINLHSFNNLSDEEIVAKILRCDKDIITNPAILEFFGKEDIVEVTNTMARNFEPYSTDYKMDQISKPDKDPNELQKPDRIYLELIYNLQHYWKSRIRALAVMSSFEKEYDELVFKLRSIDEAVENIKNSQHLKSVFEIILTVGNYMNDSTKQAQGFKLSSLQRLSFMKDDKNSMTFLHYVEKIVRTQYPQLLNFLDDLSKCLEISKFSIETIANDCKDYAQSIKNVQSSIDIGNLSDVSKFHPHDKILKLVLPVLPKAKRKGELLLDQSGYTLKEFDQLMRYFGEDPSDSFVRNSFISKFGNFVKDFKRAQTENIKREEELRIYENRKKLYETPRKRVENNEANDDSDSNVMDSLLEKLKAAGPKGEPSSARKRALMRKHLLEGLKKSPLKASVQLSPPPSPDSQDEHALLSPTGDAFSSQINVDPVETDAAVNDEEVIEEEKDVGSRARDLLKELRGVNENNSTDRMSAALKFRQERLRRKLSNIGIANDSEPTSIAENDEIGE

SEQ ID NO: 7600 - protein, 122 aa, Brassica napus
  misc_feature (3)..(4): Xaa can be any naturally occurring amino acid
  misc_feature (6)..(6): Xaa can be any naturally occurring amino acid
  misc_feature (12)..(12): Xaa can be any naturally occurring amino acid
  misc_feature (23)..(23): Xaa can be any naturally occurring amino acid
  misc_feature (25)..(25): Xaa can be any naturally occurring amino acid
  misc_feature (32)..(32): Xaa can be any naturally occurring amino acid
  misc_feature (48)..(48): Xaa can be any naturally occurring amino acid
  misc_feature (93)..(93): Xaa can be any naturally occurring amino acid
  misc_feature (98)..(99): Xaa can be any naturally occurring amino acid
  misc_feature (101)..(101): Xaa can be any naturally occurring amino acid
  unsure (1)..(122): unsure at all Xaa locations
RVXXIXCRSSVXPTHEWPLKQKXFXLDVMYLXDKPSPDNCPQDVYDSXVDAVERVSEYEGYIFESGQGLARSVFKPMSILLSHPQQRCAQDDXDIPKXXAXKVPVVEAASVDDNQIPQAMSQ

SEQ ID NO: 7601 - protein, 395 aa, Prochlorococcus marinus str. MIT 9312
MAQLETRTEPMVVNFGPHHPSMHGVLRLVVTLDGENVIDCEPVIGYLHRGMEKIAENRTNVMYVPYVSRMDYAAGMFYEAIVVNAPERLANIPVPKRASYIRVLMLELNRIANHLLWLGPFLADVGAQTPFFYIFREREMIYDLWEAATGQRLINNNFFRIGGVACDLPYGWLEKCIDFCDWFGPKIDEYEKLITNNPIFRKRIEGLGTIERDQAINWSLSGPMLRASGVSWDLRKVDSYECYDDFDWQIASEKEGDCYARYRVRVEEMRQSLSIIRQACKMIPGGPTENLEAQRMATEDKKSEIFGIDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 7602 - protein, 99 aa, Cicer arietinum
KQVTGPFSSLGAFDTCFVKTYETLAPAITLRFTDLNLTLPMENSLIHSSSGSLACLAMAAAPSNVNSVLNVIANFQQQNLRVLFDTVNNKVGIARELCN

SEQ ID NO: 7603 - protein, 85 aa, Glycine max
  misc_feature (79)..(79): Xaa can be any naturally occurring amino acid
  unsure (1)..(85): unsure at all Xaa locations
VCISMKEEDLERLDLHLMVNSQYNDEKLRTAFTVTVDAKHGTTTGVSAHDRATTVGILASKDSQPSDFNRPGHIFPLKXQEGGVL

SEQ ID NO: 7604 - protein, 957 aa, Bradyrhizobium sp. BTAi1
MTTPLKPLDDAATSFARRHIGPSPRDVAAMLETVGAKSVAELMAQTLPGTIRQATPLTLEPALSEVEAIGHMRALAAQNQVFTSLIGQGYSGTIMPAVIQRNILENPAWYTAYTPYQPEISQGRLEALFNFQTMICDLTGLDVANASLLDEGTAAAEAMALAERSARAKTKAFFVDRNVHPQTLAVLRTRAEPLGWQLIVGDPVKDLDGAEVFGGLLQYPETTGALRDPRADIAKLHDKGALAILAADLLALTVIASPGELGADIAIGSAQRFGVPMGYGGPHAAYMAVRDALKRSLPGRIVGLSVDSRGAPAYRLALQTREQHIRREKATSNICTAQVLLAVIAAMYAVYHGPDGLKSIARTVHRRAAVLAAGLRKLGFAPASDSFFDTVLVEAGANCDEIIARAESQRINLGRDGSRLRIALDETTTADVVEAVWRAFGGELSYAAIEAEARDAVPAELKRQRPFLTHPVFHAHRSETEMLRYLRKLADRDLALDRAMIPLGSCTMKLNATTEMIPLTWPEFSSLHPFVPRAQAAGYHTMFADLQDWLCRISGYDAVSLQPNSGAQGEYAGLLAIRGYHAARGEGHRTICLIPSSAHGTNPASAHMVGMEVVVVGCDSNGNVDLADLKAKAELHSAKLAAIMITYPSTHGVFEEHIRDICDIVHAHGGQVYLDGANLNAQVGLSRPGDYGADVSHFNLHKTFCIPHGGGGPGMGPIGVKAHLAPFLPGHPATDAATPSPVGPVSAAPYGSASILTISYIYMLLMGGEGLTRATEIAILNANYVAARLDPHFPVLYRNERGRVAHECIIDPRPLKQTCGVTVDDIAKRLIDYGFHAPTMSFPVAGTLMIEPTESESKAELDRFCDAMIAIRKEIAAVEQGRFTIEASPLRHAPHTVHDIADDDWNRVYRRSEGCFPEGTSRTDKYWCPVGRVDNVYGDRNLVCSCPPIGDYAQAAE

SEQ ID NO: 7605 - protein, 312 aa, Bradyrhizobium japonicum USDA 110
MTDWTTADIPSLSGRTAVVTGATGGLGYETAMALAGAGAIVILTGRNDAKGLRAIEGICERFPDALIAYEHLDLASLSSVADFAKRFAAGNEQLDLLVNNAGVMALPKRQQTEDGFEMQLGTNYLGHYALTARLLPQLRRAKASRIVNLSSLAHRSGAINFDDLQGKRSYRPWRAYCQSKLAMLMFALELQRRSLAAGWGVTSVAAHPGYARTDLIANGPGANTLQWRVGRWLQPFISQSAAEGALPTLFAATSPAAEPGGYYGPNRFYELKGPPAPAKITPQARDFAAAAMLWDVSATLTGVSFDDIAVAA

SEQ ID NO: 7606 - protein, 254 aa, Brucella melitensis 16M
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPIWAIGTGLTPTVQDVRAAHAFMREQLIERFGAKGAHLRLLYGGSVKPSNAAELLGVADVDGALVGGASLKAADFLAICETYRNL

SEQ ID NO: 7607 - protein, 264 aa, Synechococcus sp. WH 8102
MIGLGRMAQALVEPLLSSKAFSAEQVLAVVGTVATAQRLRQGAFAGVSIQSSRSAEAARVWTAPIQLLAVKQQQIDGIAAAAPVAENQPLLVSVLAGVSLDRLQRLFPGHRVVRAVPNTPALVGEGLTALAWGEAISSEQRLKVREMFAGVSEVLELPEDKLDAFLALTSSGPAFVALMAEAMADGAVAAGLPRDLSHRLAHRTLAGTAALLDQRQLHPATLKDMVTSPGGTTIAGVRALERAGARSALMEAVIAAAERSRELA

SEQ ID NO: 7608 - protein, 301 aa, Clostridium perfringens ATCC 13124
MLRILLNDGLDKKAISNLELLGFDVDTNHYDIEDLKEKIKEVDCIVIRSATKITRELIDEAIKGGKLKLIIRGGVGLDNIDVQYAEQNGIKVRNTPNASSSSVAEIILAHMFSLARFLNQSNITMKDGLWKKKDYVGVELEGKTLGIIGMGRIGSELAKKCTALGMKIIYFDLIDIKNIDNNYRKVEFDELLRKSDFISINISGTKSIIGSEELKKVKKGVFIINTSRGKALDEDAIITSLNDGTLGGVGLDVFLEEPSKNLELINHPKVSLTPHIGASTKEAQMKIGEEVINIIKEEIYK

SEQ ID NO: 7609 - protein, 80 aa, Arabidopsis thaliana
  misc_feature (6)..(6): Xaa can be any naturally occurring amino acid
  misc_feature (8)..(8): Xaa can be any naturally occurring amino acid
  misc_feature (12)..(12): Xaa can be any naturally occurring amino acid
  misc_feature (18)..(18): Xaa can be any naturally occurring amino acid
  misc_feature (20)..(20): Xaa can be any naturally occurring amino acid
  misc_feature (31)..(32): Xaa can be any naturally occurring amino acid
  misc_feature (37)..(37): Xaa can be any naturally occurring amino acid
  misc_feature (41)..(41): Xaa can be any naturally occurring amino acid
  misc_feature (43)..(43): Xaa can be any naturally occurring amino acid
  misc_feature (51)..(51): Xaa can be any naturally occurring amino acid
  misc_feature (58)..(58): Xaa can be any naturally occurring amino acid
  misc_feature (60)..(60): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(72): Xaa can be any naturally occurring amino acid
  misc_feature (74)..(75): Xaa can be any naturally occurring amino acid
  misc_feature (78)..(78): Xaa can be any naturally occurring amino acid
  unsure (1)..(80): unsure at all Xaa locations
PYLPLXRXASPXQATMVXPXNGLKSSAAFPXXRKANXDITXIXSNGGRVNXMHVWPPXGXKKFXTLXYXXXXTXXELXKE

SEQ ID NO: 7610 - protein, 249 aa, Xylella fastidiosa Ann-1
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRAAEMVANQGKAK

SEQ ID NO: 7611 - protein, 178 aa, Glycine tomentella
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYRENHRSPGYYDGRYWTMWKLPVFGCTDASQVLKELQEAKTAYPNGFIRIIGFDNVRQVQCISFIAYKPPSF

SEQ ID NO: 7612 - protein, 286 aa, Lactobacillus acidophilus NCFM
MVETFKLNDGNNIPAIGFGTFQIPDDGSTYKDVLNALKLGYRHIDTAVAYFNEDEVGKAIRDSGIPRDQIWVTSKLWLQDYAYEDAKKAINLSLKNLGLDYIDLYLIHQPYGKVDEAWKAMVEAKKAGKIRSIGISNVTPKIWHKWEDIFKENKPAVNQVEFNPYFQQKELRKIMAENQITLEAWAPLGQGNHNLFKEPVLNRLAKKYDKNVGQIMLRFEHQEGIIVFPKSVHEARIKSNKDIFDFELTSDEMDAIRALDKGKGMHDPDAPGVEEMLSKYDVHAND

SEQ ID NO: 7613 - protein, 178 aa, Glycine tabacina
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYREHHRSPGYYDGRYWTMWKLPMFGCTDASQVLKELQEAKTAYPNAFIRIIGFDNVRQVQCISFIAYKPPSF

SEQ ID NO: 7614 - protein, 723 aa, Schizosaccharomyces pombe
MTISSGENISKQISENNSSTNPKHANSESSPLLSSDFSSSSKDYHKVGAFTDNTNAINIPEQTRGVSHTSSSPSVGTSFSSINLREVKNPLAGSDSTAPFINSTNSVLWIRVRNREARFRQAAYLQGPFTLCVSVWNDQFFDEKNSLLNFDPQVQPSTSFWVCVPYSCFSNQQPIYIEIASQAIFKDRSINFELAISQSQHSIRAMSAADIDTLHAFPALHVEHQTPENLWRLPYSSFHSKNSHLVVLTHGMHSNVGADMEYLKEKLIESSKSVKELVVVRGFTGNYCQTEKGVRWLGKRLGEWLLDITGWGSASFPRYSHISVVAHSLGGLVQTYAVGYVHAKTHGAFFQAIHPVFFVTLATPWLGVAGEHPSYIGKALSYGIIGKTGQDLSLTPLNHSIESRPFLVLMSDPSTPFFQAVSFFEKRILFANTTNDYIVPFGTSAMEVSSLGKVEEAEGSDKVMPTHMENGISPTLKENEQTVQSVGDNAKKIHASSEESGSSFSKALKSFVGLFSYSASKTTDTEIPLVKNEDENARKPTEPNCLGSDELDVSNSSNQFFCSAPKLDPTSTFSGVAQRVVNTFTNLFIPAVPTDSYFFKYHLHKVVVSDNVHDPAASFSTFDGITELNNMNNGFLSNEITIAKNWHRLAWRKVAVRLDGDAHNTMIVRRRFPNAYGWTVIKHLTEILFEQNTSTAYMNPISFDETTTAAWLSEIYEDNSISV

SEQ ID NO: 7615 - protein, 285 aa, Lactobacillus acidophilus NCFM
MNFNSLQDTYTLNNGVKIPIIGFGTWQTPDGEVAEESVLAALNCGYRHIDTASAYGNEDSVGRAIQKSGINRHELFITTKLWNSDHGYEKTKKAIDQSLLDLKLDYLDMYLIHWPNPSSMRDHWAEINAESWRAMEEAVRAGKIRAIGVSNFRKHHLDALMETAEIKPVVNQIFLNPSDLQSEVVTENKKLDLLSEAYSPLGTGGLLGNEVVKEVAANYGKSTAQVLIRWSLQHGFLPLPKSVHPEYIKANADVFDFEISPEDMAKLDNLHGVAGVANDPDKVDF

SEQ ID NO: 7616 - protein, 282 aa, Zea mays
  misc_feature (218)..(218): Xaa can be any naturally occurring amino acid
  unsure (1)..(282): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVXLLEGTLLKPNMVTPGSDAKKVAPEVIAEYTVRTLQRTVPAAVPAIVFLSGGQSEEEATLNLNAM

SEQ ID NO: 7617 - protein, 970 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSLRKLRHLHLGGNIFSGGIPPEYGHGGSFKYLALRQTSLSGYPPGGLGNLTSLREFYIGYFNSYSGGIPPELGNMTDLVRLDAANCGLSGEIPPELGNLANLDTLFLRVNGLAGGIPRELGKLASLQPKVDLSKKGLAGEDPAKVRRLQRTFTLLNLFRNKLQGDIPEAFVGDLPSLEVLQLWENNFTGGMPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSLPTGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGAPGTDHGGRSHGGLSNSFKLLIVLGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKPNNILLDSDFEAHVADFGLAKFLQDSGTSERMSAIAGSYGYIAPEYAYTLKVDETSDVYSLGAVLLEPDHRKDPTDARSRESWGWPSPSFHGPKNHDLDAIGLDTKLLQISLIWLCTLEELDDRPLNGGDVDNLSAPSVAVEF

SEQ ID NO: 7618 - protein, 809 aa, Schizosaccharomyces pombe
MSVAIKFTVKINDGSLRRQQTRHVFLSPAALNRLKLSPSQVIYLKHKGGEAVGITQSVKGNGIGPFEILISPLLAKWANLKAFQRVNISQYVHPLKEAEGIKIVASLSSNNEPIPESLIRKELLEIRYLHPGMIVMGESPMNMAKSGSKNLSSENMATEIFEINSGLSAQSGTEVGSSQSSPSVNESEPKATEDLDELSPGSYKVKEIHIRSPSNLIEAISDMSLDEPRIYKFTAASSMEIETPDLLKLPHEDRTQSAYNQGSEETQNFDGPPSAVTFSSIGGLQAQIAQIRDIVELPFQNPELFKFFNIMPPRGVLLYGPPGTGKTMVMRAVAAEANAQVFTIDGPSVVGKYLGETESRLRKIFEDARAHQPSIIFIDEIDALAPKRTEDVSEAESRAVATLLTLLDGMANAGKVVVIAATNRPNSIDEALRRPGRLEKEIEIGIPDKSARLDIIKLLLSGVPNEINDAQLEDLASRTHAYVGADLAAVVREAALRAIKRTISLQKDTSGLDIFGAVQMDDLEFALSSVRQSAMREFMMESPNVHWSDIGGQEEVKQKLKESVEWPLTHGETFSRLGVRPPKGVLLYGPPGCSKTITAKAIATETGLNFIAVKGPELFDKFVGESERAVRQVFQKARQASPSVIFFDEIDALTANRGEDNSSDRVVAALLNELDGIEALRNVLVLAATNRPDMIDPALMRPGRLDRLLYVGPPNFEARKQIVKIQAEKMKFAEDVDLDLIAEKTEGCSGAEVVALCQEAGLIAMHEDLEAKEICQAHFKTALLALRKAITRDMLEYYASFSESVTSIS

SEQ ID NO: 7619 - protein, 173 aa, Flaveria pringlei
  misc_feature (63)..(63): Xaa can be any naturally occurring amino acid
  misc_feature (172)..(172): Xaa can be any naturally occurring amino acid
  unsure (1)..(173): unsure at all Xaa locations
MASIPATVAAVAQANMVAPFTGLKANAAFPVTKKVNDFSTLPSNGGRVQCMKVWPPLGKKKYXTLSYLPNLTEAQLAKEVDYLLRNKWVPCLEFELEHGFVYRENARSPGYYDGRYWTMWKLPMFGCTDSVQVMKELQECKKEYPQAWIRIIGFDNVRQVQCISFIASKPDXF

SEQ ID NO: 7620 - protein, 513 aa, Geobacter sulfurreducens PCA
MPRPLVLMILDGWGINPDPSNNAVAIGRTPAMDRLMAEYPSVEMETSGMAVGLPDGQMGNSEVGHLNIGAGRVVYQDLTRITKSIDDGDFFTNPVLLDCMARVKAAGGRLHLGGLLSDGGVHSHNTHLYALIELARRQGVKDVFVHAFLDGRDTPPSSGAGYLAELEAEIGRIGFGRVATVMGRYWAMDRDNRWERVERAYNTIVKGEGAHRPDSAAAIEASYSAGVTDEFVEPAVIAPNGSPLGLLADGDGFICFNFRSDRAREITRALTDPAFAGFDRSPWPRLASYVCLTEYDATFPLPVAYPPESLANILGQVVSRAGLRQLRIAETEKYAHVTFFFNGGVEEPFPGEERILIPSPKEVATYDQKPEMSAPLVTDALLKRIDEGVDDVVVVNFANADMVGHTGILDAAVRAIETVDECVGRVAATVLEKGGALIITADHGNAEMMVDETGGPHTAHTNERVPLILVDDSRKGARLRPGTLADIAPTMLGLLGIPQPPEMTGKSLLVATE

SEQ ID NO: 7621 - protein, 169 aa, Arabidopsis thaliana
  misc_feature (130)..(130): Xaa can be any naturally occurring amino acid
  unsure (1)..(169): unsure at all Xaa locations
GGPGPEYRGGPHPSGRPRASFMLFSVPMVAFPVKAIMVVLLNGLKSSVAFQATRRVNTAITSITGNGGGVNCLQGWPPMGKKKLGTFFYLPDLTDSEWVKEVDYLIRTRGIPGVEFKWEHGFGSRGPGTXPGSYDGRSWPMGKLPLFGCTDSVQGLKEGERCKRESPNA

SEQ ID NO: 7622 - protein, 173 aa, Flaveria pringlei
MASIPATVATVAQANMVAPFTGLKSNAAFPVTKKVNDFSTLASNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 7623 - protein, 232 aa, Brassica napus
MTTLVIFLQLLFIIPLALGLNHPNCDLTNTQDQGSTLRIFHIDSPCSPFKSSSPLSWEARVLKTLAQDQARLQYLTSLVAGRSVVPVASGRQMLQSTTYIVKAKIGTPAQSLLLAMDTSSDVAWLPCSGCVGCPSTTAFSPAKSTTFKNVSCSAPQCKQVPNPTCGSRACSFNLTYGSSSIAANLSQDTIRLAADPINAFTFGCVNKVAGGGTVPPPQGLLGLGRGPLSLMS

SEQ ID NO: 7624 - protein, 127 aa, Triticum aestivum
VSNVIDLGTVAHAALSTVSVIIYFCCFVMGFGPIPNILCAEIFPTRVRGLCIAICALTFWIGDIIVTYSLPVMLNAIGLAGVFGIYAVVCLIAFVFVFLKVPETKGMPLEVITEFFAVGAKQAAAKA

SEQ ID NO: 7625 - protein, 631 aa, Alkaliphilus metalliredigenes QYMF
MNELNVLHDSQKSYFRNPFGAAECGEKIKLRVKIDTMKNIEQVFLSIVDHNGGKREISMYQIETDNESHVFETEINCPEIPGLLWYQFKLIIQGEVIYYCNNDEKLGGQGMLKWHEGHSFQITVYKAGVEVPSWFRRAVMYQIFPDRFYEGETGTKNQHVKKNSFFYGSWEDKPMYIREAETNRIQRWEFFGGDLQGIIEKLNYLEELGITSIYLNPVFESPSNHRYDIGNYKKIDPLLGDSNIFERFCKEAEKRGIHIILDGVFSHTGSDSLYFNKEGNYQSLGAYQSKDSPYASWYQFDHFPDQYKSWWGIDTMPDVEEMDPSYLDYIIRDEDSVIKHWMKLGVKGWRLDVADELPSAFIKVLKKVLKETDPQAVLIGEVWEDATNKISHGEKREFLFGEELDSVMNYPLREALLDFFLTRGDGVTLQARLMKLYENYPKPYFYSLMNIIGSHDVPRALTALAYGDHSSITDEKEVAVKRLKLLSLFQMTFPGIPCIYYGDEAGAEGGNDPDNRRTYPWGSENEEILAWYKKITRIRRDHEVFVEGDWYSPYGDRDVYTFVRQKDGERAFVLFNRSNAEAYDLHLNNLEQLGNGVFKNLLISDDILEVIEGKARVRLEPLEGKVFYIKR

SEQ ID NO: 7626 - protein, 827 aa, Alkaliphilus metalliredigenes QYMF
MKDKNNDSESTNREKVEAMKLEIALKLGTIFGRNLEDASKEQMYRATASVLRDRIMQQWAYSKEKVNKTDGKELYYLSMEFLMGRFFDNFIMNLMLQEDVTTACSELGIELKELQDIEPDPGLGNGGLGRLAACFLDSLATLGYVGHGNGIRFEYGLFKQKIADGYQIELPDSWLEHGNIWEVAKPEEPEIVNFGGELEKKMVDGRLIVEQKNCYRIKAIPYDMPVVGYNSGVTNTLRLWGARSTKHLNMGLFGRGQYMDAIEEKELAEVISKILYPDDNHVEGKSLRLKQQYFFVSASIQSIIRKYKKNGNDVRELPDKVVIHINDTHPGLAIPELMRILMDDEGLGWTEAWSITSKIFAYTNHTILPEALEKWKVDMFKELLPRVYEIIHEINERFCKVLWERYPEQWDKITEMAIISYHEIHMAKLCIVGSFSLNGVAKLHSEILKETVFNDFYDIYPEKFKSITNGVTHRRFLLKANPGLSKLITSSIGDEWIKDASRLKELESFAKDKGFQEALAKTRLINKEALAHDIMSQLGIKVDTSSIFDVHVKRLHEYKRQLLNVLHIMHLYNRLKENPDLEMHPRTFIFSGKAAPGYHRAKLIIKLIHSVAEKVNHDTSIQDKLKVVFLENYCVSLAEKIIPATDVSEQISTAGKEASGTGNMKFMLNGALTIGTLDGANVEMSELVGDDNIFIFGLTIDQVDEYWRQGNYHPYKLYEGNPNLKQILDQLLEGFFNQEESHLFNEIYQDLLYGDGSRGDTYYLLKDFQPYCDAHGLIDKTYGNKSAWWEKSIINIANGGYFSSDRTIEEYSEKIWHLPKHNFEQKM

SEQ ID NO: 7627 - protein, 241 aa, Prochlorococcus marinus subsp. pastoris str. CCMP1986
MRKSVIAGNWKMHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 7628 - protein, 219 aa, Brassica napus
  misc_feature (7)..(7): Xaa can be any naturally occurring amino acid
  misc_feature (14)..(14): Xaa can be any naturally occurring amino acid
  unsure (1)..(219): unsure at all Xaa locations
SYNVVMXASFRLGXTDKLYRLLDEMVKDGFSPDLHTYNILLHHLATGNKPLAALNLLNHMREVGVEPSVIHFTTLIDGLSRAGKLEACKYFMDEMVKAGCTPDVVCYTVVITGYISGGELEKAEEMFREMTVKGQLPNVFTYNSMIRGFCMAGKFKEARLLLREMESRGCNPNFVVYSTLVNNLRNAGKLLEAHEVVKDMVEKGHYVHLISKFKKYTRS

SEQ ID NO: 7629 - protein, 418 aa, Prochlorococcus marinus str. MIT 9211
MPNRTFYDPLHKGIRLDSKVPEEGMVIKLIDSAPFQRLRRIKQLGPAYLTFHGAESSRFTHSLGVFHIARRALKKLIELNPSLIDFRGLLYGSALLHDIGHGPLSHTSEEMFGMKHENWTSKLIREHPQISNALNEFKSGLGEQVASLIDGSETPCKVIKTLVSSQLDCDRLDYLMRDSYSSGAAYGQLDLERILSALTLSPDGDLAINPKGLLAVEHYLIVRNLMYRSIYNHRLNEVCNWLLEQIIRIAKELGPKRVWADNIMGKWLWRNSEIDLYDFLGNDDNRTSYHLLRWSENSQEPLNILCRNFLNRNLLKAIDIEDLKKESQLEALAIARKLSEKASKDPAIYCGLRHNKIFGYHPYKSGLRLWDGKNLKALERESSLVENLISPSETAWLIHPKEIHNELKQELTKIRDTY

SEQ ID NO: 7630 - protein, 356 aa, Yarrowia lipolytica CLIB122
MAKKETKHTPLTKLKFQDPIFGISFHPEQPRFVVGSSTGTVTAYKYSVDPQSATCGAPEVVWTTKRHKGSCRALIYSEDGSSVYSVGSDGVIKRADSQSGKVRAKNTESLPSTPSCIVRSEAYVAVGCEDGSIVAFDKTSLAEKHRAEGAHDGECVNALLELTHQNKHSFASLGSTTACVVDVRKGVKSTSDDQEDEILCGTMAAKDMGVCGMSQGQITTWTLGFNDQQNRVKLSEESIDAVIGAEDDYEVYAGGGEGIVWLANVKSGKKLDQFVHSRNDEVSFLDLDYQYRLVTASMNSLKLWPTADDEQKQAEVAAAKGAEEEQKAAPSGPPRKKHKKVKNKAHNPGVAHFGDL

SEQ ID NO: 7631 - protein, 153 aa, Triticum aestivum
  misc_feature (17)..(17): Xaa can be any naturally occurring amino acid
  misc_feature (33)..(33): Xaa can be any naturally occurring amino acid
  misc_feature (56)..(56): Xaa can be any naturally occurring amino acid
  misc_feature (58)..(58): Xaa can be any naturally occurring amino acid
  misc_feature (71)..(71): Xaa can be any naturally occurring amino acid
  misc_feature (74)..(74): Xaa can be any naturally occurring amino acid
  misc_feature (90)..(90): Xaa can be any naturally occurring amino acid
  misc_feature (98)..(98): Xaa can be any naturally occurring amino acid
  misc_feature (109)..(109): Xaa can be any naturally occurring amino acid
  misc_feature (112)..(112): Xaa can be any naturally occurring amino acid
  misc_feature (118)..(119): Xaa can be any naturally occurring amino acid
  misc_feature (126)..(126): Xaa can be any naturally occurring amino acid
  misc_feature (133)..(133): Xaa can be any naturally occurring amino acid
  misc_feature (144)..(144): Xaa can be any naturally occurring amino acid
  unsure (1)..(153): unsure at all Xaa locations
MAAPPQPAPAPPAPASXGDAFRLGFVGAGNLAXSIARGVAESGVLPAYDVRTAPHXRXERAAAFSSLGATXLAXNAQVVDDSDVIVISVXKPHIVKQXVLVELKPLLSXEKXLVSIAXXIKMKDFXDWSGQRXKLLEVMPNTPXAGGQAASGD

SEQ ID NO: 7632 - protein, 598 aa, Pantoea dispersa
MFLNGFKTVIALTMASSFYLAASPLTKPSTPIAATNIQKSADFPIWWKQAVFYQIYPRSFKDSNGDGIGDIPGIIEKLDYLKMLGVDAIWINPHYESPNTDNGYDISDYRKIMKEYGSMADFDRLVAEMNKRGMRLMIDIVINHTSDRHRWFVQSRSGKDNPYRDYYFWRDGKQGQAPNNYPSFFGGSAWQLDKQTDQYYLHYFAPQQPDLNWDNPKVRAELYDILRFWLDKGVSGLRFDTVATFSKIPGFPDLSKAQLKNFAEAYTEGPNIHKYIHEMNRQVLSKYNVATAGEIFGVPVSAMPDYFDRRREELNIAFTFDLIRLDRYPDQRWRRKPWTLSQFRQVISQTDRAAGEFGWNAFFLDNHDNPRQVSHFGDDSPQWRERSAKALATLLLTQRATPFIFQGAELGMTNYPFKNIEEFDDIEVKGFWNDYVASGKVNAAEFLQEVRMTSRDNSRTPMQWNDSVNAGFTQGKPWFHLNPNYKQINAAREVNKPDSVFSYYRQLINLRHQIPALTSGEYRDLDPQNNQVYAYTRILDNEKYLVVVNFKPEQLHYALPDNLTIASSLLENVHQPSLQENASTLTLAPWQAGIYKLN

SEQ ID NO: 7633 - protein, 362 aa, Mycobacterium sp. MCS
MSDQIPEKMQAVVCHGPRDYRLEEIAVPQRGPGEALIRVEAVGICASDLKCYHGAAKFWGDENRPAWAETMVIPGHEFVGTVVELDDDAAQRWGIAVGDRVVSEQIVPCWECRFCKRGQYHMCQPHDLYGFKRRTPGAMASYMVYPAEALVHKVSKDIKPHHAAFAEPLSCSLHAVERAQITFEDTVVVAGCGPIGLGMIAGARAKNPMHVIALDLAPDKLELAEKCGADITINIAEQDAVAIVKELTDGYGADVYLEGTGHTSAVPQGLNLLRKLGRYVEYGVFGSDVTVDWSIISDDKELDVLGAHLGPYCWPAAIKMIESGILPMDEICTHQLPLTDFQKGLDLVASGKESVKVSLIPA

SEQ ID NO: 7634 - protein, 374 aa, Zea mays
HEGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSAVDLTVRIEKGASYEDIKKAIKAASGGPPKGIMGYGKKDLVFTDFLGDTRWSIFAPKPGIVLNDPFVKFFSGNNNEGGSSNRVVAPIPPMFKPQWGFSPPPFNGRCLLGYPEKKWGGGGPWGPQVHPELGQFFHFCSPSGAPL

SEQ ID NO: 7635 - protein, 382 aa, Haloquadratum walsbyi
MNFEFASRIERVEPSATLAISNKASELEANGVDVVDLSVGEPDFPTPQNVVEAGKDAMDAGHTGYTPSNGIPELREAIAARLREGGIDAIDEEIIVTPGGKQALYEAFQVLIDDGDEVVLLDPAWVSYEAMSRLAGGSLTRVDLEPYSFQLEPGLDDLEAAVSEETELLVINSPSNPTGAVYTDAALEGVRDLAVEYDITVVSDEIYDKITYGVEQTSLASLSGMGDRTITINGFSKAYSMTGWRLGYVHAPSALIDQAAKLHSHSVSCAVNFVQRAGVEAIENTDDAVVEMRDAFRERRDMLAELFESHDVDVPIGDGAFYMMLPVDNDDQAWCSGAIEDAHVATVPGSAFGSPGHARISYAASEDRLREAVGRLAEHEYI

SEQ ID NO: 7636 - protein, 483 aa, Pseudomonas syringae pv. phaseolicola 1448A
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTADELHCTVLIGGPLSDHKGINRRGGGLTAPALTEKDKQDIKLAAEMDLDYLAVSFPRDAADMEYARQLRDESGGTAWLVAKIERAEAVANDEVLDELIRASDAVMVARGDLGVEIGDAELVGVQKRIILHARRHNKAVIVATQMMESMISSPMPTRAEVSDVANAVLDYTDAVMLSAESAAGSYPIEAVQAMARICIGAEKHPTGKTSSHRIGHSFTRCDESIALAAMYTANHFPGVKAIIALTESGYTPLIMSRIRSSVPIYAFSPHRGTQARAAMFRGVYTVPFDPAALPPGQVSQAAVDELLKRGLVEQGDWVILTKGDSYHTIGGTNGMKILHVGDPLV

SEQ ID NO: 7637 - protein, 364 aa, Oryza sativa
YRPIRIKLLWYFLLWPSSFFWCVNTDAEANLEHSTIWTAGLYLMLLLQFLENKVAVELTRSEFVEAQEALAQMINWFTRFPTILRGCENTIEMLRGQYAHSVGCFDEAAFHFLEAARLTDSRSMQSMCQVYASVSYICMGDAESTSQALELVGPAYRTMDSFVGVREKTCIHAFYGLLLMRQQNPQEARLRLAGGLRIAHQQLGNIQLVSQYLTILGTLALQLHDCGQAREILKSSLTLAKTLYDIPTQIWILSVFTELYRELKERENEMENSEYERKKEDDLQRRLSEAHSSPFHQELVEKTRIQVQQLHNFSREQQGMPGPTTAKADLDIPESVGLYAAQPSSVKRLIEPSSVRRSSRRRLS

SEQ ID NO: 7638 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 7639 - protein, 559 aa, Haloquadratum walsbyi
MSLEEPEPTQSAEKTAEQLPTTGDEIESLLSDVVIGRDDHLNAPGVIIRPDDVQKTLRRLRNKAGFDHLSCVTADERVDRYESIYHLTSYDDRTRELSVVVPTTKDDPVSESAAPVFRTADWHEREAYDLIGINYEDHPDLRRILLPQTWQGHPLSNNYDQDRPQIVTLKEWENPLAEDHREEEGDTMYINIGPHHPATHGVLHVKTVLDGEQIADIDPDIGYLHRCEEQICEAKTYRHQIMPYPDRWDYASSGLLNEWAYARAAEDLNDLEVPEYAQVIRTMGAEICRIASHMLAVGTFALDVYGDFTAIFMYAMRDREKAQNILEDLTGQRMMFNYFRLGGVVWDLPEPRDEFFETIRDFLEDLPTALEEYHDLISSNEILQVRTIDTGVLPPEEAKSYGATGPVARGSGIDYDLRRDDPYGYYDELDWDVVTEDGCDNFSRLLVRLREVEESAKIIEQCVDILEGWPEDERTIQSNVPRTLRPDDDAEIYRAVEGAKGELGIYIRGDGTEEPGRFKIRSPCFSNLQTLPEMSSGEYIPDMVASLGSLDIVLGEVDR

SEQ ID NO: 7640 - protein, 1116 aa, Arabidopsis thaliana
MGEVDFIHTINPSSRCDGGDERSSMYSFVNALRMSGGDGDNSYSTNSLLQKKVLSKAKPVLVKNTKGMMINLNFPNYIKVADLGCATGENTFLTMAEIVNTINVLCQQCNQKPPEIDCCLNDLPDNDFNTTFKFVPFFNKRVKSKRLCFVSGVPGSFYSRLFPRKSLHFVHSSYSLHWLSKVPKGLEKNSSSVYITTSSPPNAYKAYLNQFQSDFKSFLEMRSEEMVSNGRMVLTFIGRKTLDDPLHRDCCHFWTLLSTSLRDLVYEGLVSASKVDSFNIPFYDPSKEEVMEMIRNEGSFEINDLEIHGFELGLSNHDEDYMLHSQISKAGQREANCIRAVSESMLVADFGVDIMDTLFKKFAYHVSQHASCTNKTTTNMKGETYRVFCVGTADTKLDELRFLAGSVRSNIGAFSKNSSSKVEVVIVDVSAGADQKQIDNVADFAFVTREEVLSCYIGSNQEEKPVKLPDDRGEAVGVMSKCLENFLRQAFEDNSLAGAIGLGGSGGTSLISSAFRSLPIGIPKVIVSTVASGQTEPYVGTSDLVLIPSLVDVCGINSVSRVVFSNAGASFAGMVVGRLELFRSSPSDNGKCTVGITMFGVTTPCVNAVQEILTREGYETLVFHATGVGGRAMESLVKEGFIQGVMDITTTEVADHLVGGVMACDSSRFDITIEKGIPLVLSVGALDMVNFGGKDTIPSHFQTRKIHVHNEQVSLIRTTAEENKKFARFIADKLNKSTSKVRVCIPEKGLSALDAPGKPFCDPEATGALINELQGLIQTNDDRQVNIYSHHINDPEFAEALVASFLEICPKTYAQIKPSETTSTKPSTGEHDDGHVRSRLERIPYSPKEFPNAKPEKGIPIIGGGAGTGISAKFEEAGGIDLIVIYNSGRFRMAGRGSLAGLLPFADANAVVLEMANEVLPVVKAVPVLAGVCATDPFRRMDYFLKQLESIGFVGVQNFPTVGLFDGNFRQNLEETGMGYGLEVKMISEAHKMGLLTTPYAFNPKEGEEMAKAGADIIVAHMGLTTSGNIGAKTAVSVEESVVRVQAIADAARRFNPDIIVLCHGGPISGPEEAEFVLKRTQGCVHGFYGASSMERLPVEQAITNTVQKYKSISIK

SEQ ID NO: 7641 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 7642 - protein, 392 aa, Enterococcus faecalis V583
MDLTNRFNRQVNKIAVSLIRQFDEQVSGIEGILKLTLGEPDFNTPEHVKKAAKEAIDANFSHYTGMSGLLDVREAAAYFMKEKYHLTYQPATEILVTVGATEAISASLLAILEQGDKVLLPAPIYPGYEPIITLAGAEPVYLDTRDNDFVLTPEMIEAAMAEHGEQVKAIILNYPSNPTGVTYNRQELQAIADVLKKYDIFVISDEIYSELTYDESHVSIAEMLRDQTILINGLSKSHAMTGWRIGFIFAPAILTAEIIKVHQYLVTAAATVSQKAAVRALIEGMHDAEIMKEEYRKRRDFVYEQMTQLGFEVARPNGAFYIFAKIPTGYEQDSMKFCIDLAQKEAVALIPGISFGPEAEGYVRISYASDMDKLTTAMERIAHYMATQRVTH

SEQ ID NO: 7643 - protein, 260 aa, Enterococcus faecalis V583
MKIGFIGAGSMGGAMIKGLLKAEAVKKEHLYVKGGSSGTAEALQKEWGFQLVTDYALFQECKVIFIATGAKVVLPVLQELAPHFSNESLLISVATGHTIQEAQMALGNKEAKVVHAIPNTPVSVNQGVIGVALAPTIEGQTKDLAMELLATLGLVKEIREAQLETFGTVAGCSPAFVDIFMEALGDAAVLEGLPRDLSYEIVAQMIKGTATLALDTKKHPGALKDEVTSPGGSTIRGVVALEKNGFRYAVMDAVQQANHE

SEQ ID NO: 7644 - protein, 502 aa, Nicotiana tabacum
MEHSLMSTGSYFLLFSSSAFLLILLSFSVEKSHALETRETIESHFHTLQLSSLLPSSSCNPATKGKRRGASLEVVNRQGPCTLLNQKGAKAPTLTEILAHDQARVDSIQARITDQSYDLFKKKDKKSSNKKKSVKDSKANLPAQSGLPLGTGNYIVNVGLGTPKKDLSLIFDTGSDLTWTQCQPCVKSCYAQQQPIFDPSTSKTYSNISCTSAACSSLKSATGNSPGCSSSNCVYGIQYGDSSFTIGFFAKDKLTLTQNDVFDGFMFGCGQNNKGLFGKTAGLIGLGRDPLSIVQQTAQKFGKYFSYCLPTSRGSNGHLTFGNGNGVKASKAVKNGITFTPFASSQGTAYYFIDVLGISVGGKALSISPMLFQNAGTIIDSGTVITRLPSTAYGSLKSAFKQFMSKYPTAPALSLLDTCYDLSNYTSISIPKISFNFNGNANVELDPNGILITNGASQVCLAFAGNGDDDSIGIFGNIQQQTLEVVYDVAGGQLGFGYKGCS

SEQ ID NO: 7645 - protein, 284 aa, Desulfotalea psychrophila LSv54
MRIPVMRKTVVDIIAMKAAGQKISMLTAYDASMSALLDQAGIDILLVGDSLGMTVLGYDSTVPVTMADMVHHMAAVRRGAPDAFVVGDMPFGSYQTGARDAVLNAMRLLKEGGCDVVKLEGGEVVCPVVKAIVDAGIPVMGHLGLTPQTAAVLGGYKVQGRDMEAARKLFADAKRLEEAGVCGLVLECIPAGLAEVVTASIAVPTVGIGAGKGCDGQVLVINDMLGLFEKFTPKFVKHYAQLAPLVRQGVENYIGEVRAGAFPEAEHTFTSSCDYKVLLSGDDQ

SEQ ID NO: 7646 - protein, 567 aa, Pseudomonas aeruginosa PAO1
MHHTPLLTTLAAGFVLAFLFGALANRLRISPLVGYLLAGVLAGPFTPGYVADQALSQEIAELGVILLMFGVGLHFSLKDLLSVKAIAIPGALVQIGVATLLGIGLAKLLGWSFGGGLVFGLSLSVASTVVLLRALEQRQLLDTKRGRIAIGWLIVEDLAMVLTLVLLPALAGTLGGKTDGGDAGLLWPLLITLGKVAAFVALMIFGGRRVVPWVLERIAASGSRELFTLAVLAIALGIAYGSAVLFGVSFALGAFFAGMILNESELSHEAAENSLPLRDAFAVLFFVSVGMLFNPMILLQEPLTVLATFLVIVFGKSVAAYLIVRAFGHPNSTALVIAASLAQIGEFSFILIGLGIGLELVPEQSRDLVLAGAILSILVNPLLFIAIDRLQQRKEQRLAEAAGGVREMPAQDLPPPILEREHAVLIGHGRVGGLVSARLRTAGTPFVVVVDKRDKADELREQGYSVVLGNAASPGVLELANIAEARWLLIAIPNGFEAGQIASHARAVNPPLDIVARAHFDAEVDYLEQNGANLVIMGEREIACGMVHRLGLDRDERGADAPLPQSA

SEQ ID NO: 7647 - protein, 130 aa, Vibrio alginolyticus
MEAILNKNMKILIVDDFSTMRRIVKNLLRDLGFNNTQEADDGLTALPMLKKGDFDFVVTDWNMPGMQGIDLLKHIRADAELKHLPVLMITAEAKREQIIEAAQAGVNGYIVKPFTAATLKEKLDKIFERL

SEQ ID NO: 7648 - protein, 994 aa, Propionibacterium acnes KPA171202
MTDHAENRCGLEGPRPFSSRHVGSVEDDLRYIAETIGVTSPEQIIRDAIPASVLDSNEGDSSVRTPSFPPAADETTARAELVEIASGNRVTRALIGRGYYGTLTPPVIRRNILENPSWYTAYTPYQPEISQGRLEMLTIYQQLITDLTGLALANSSLLDEATAASEGMLLARRAARKVKSNRFLVHTHLFDQVRDVVLGHAEATGIEVVETDLRDPQSWRPEVEAGCFGVLAPYPDSTGALWNPSEVFDAVHKVGGITIAECDLLSLTLLAPPGELGADVAVGSSQRFGVPMGNGGPHAAYMSVRSGLERQIPGRLVGVSTDADGNPAYRLALQTREQHIRRDKATSNICTAQVLLAVVAAAYAVWHGPTGLTRIARQVTDRAHQLASALRAAGLDVADQQFFDTIRIRTKGGAKELWNRAREGGYTLDLVDGDILQISVDETVTDDELRELTQLLGGSTDEIRGPADRAWPEDLRRTSSFMTHPVFSSYHTETTMMRYLKRLADHDYGLDRGMIPLGSCTMKLNAAAEMEAMTWPAFSQMHPFAPVEDQAGSLRLIRDLEIWLAELTGYDTVSLQPNAGSQGEYTGLAAIRSYHVSRGDTERNVCLVPASAHGTNAASAASAGLRVVVVKSNDDGTIDRDDLAAKIAANEGRIAAIMITYPSTHGVYEDGVRQVCDMVHEAGGQVYIDGANFNALVGWGQFARIGGDVSHLNLHKTFAIPHGGGGPGVGPVAAKAHLAPFLPGHPLNPRNEHPLNDGGTVTHDGHAVSAAPFGSVSVLPISWAYLRLMGLKGLQFATEVAVLNANYIAHRLHDKIPILYTGQNGYVAHECILDLRPLTTETGITVDDVAKRLIDYGFHAPTMSFPVAGTLMVEPTESEDLAELDRFCDAMLAIVEEARMVQSGHWPANDNPLINAPHPAARLVADEWNHPYSRELGCYPGMRLGIQRDQERGLDVNTVTRIQAKYWPPVGRVDNTYGDRHLVCSCPPPEAFED

SEQ ID NO: 7649 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEALPKLAANAASVA

SEQ ID NO: 7650 - protein, 459 aa, Xanthomonas campestris pv. campestris str. ATCC 33913
MSDPSAPDHLQRSLSNRHLQLIAIGGAIGTGLFMGSGRTISLAGPSILFVYLIIGVMLFFVMRAMGELLLSNLDYKSFIDFSTDLLGPWAGFFCGWTYWFCWIITAIADVIAIAAYAQFWFPELAPWVPAVLCVLLLLALNLVTVKLFGEMEFWFALIKIIAICALIITGAGLVMWGFRSPSGHVASLSNLWNDGGMFPMGIGGFFAGFQIAVFAFVGIELVGTTAAETADPQRNLPKAINSIPVRILIFYVLALIAIMAVTPWRQVVADKSPFVELFVLAGVPAAASLINFVVLTSATSSANSGIFSTSRMLYGLAEERNAPRGFAKLTRAAVPARGLLFSCICLLLGAMLVYLIPDLVTAFTLVTTLSAVLFMFVWSLILCAYIAYRRKRPEQHAASAFKMPGGVLMCYVCLAFFAFIIVLLTLQPDTLHALLVSPLWFLVLAIAYWVRRNQSPTAR

SEQ ID NO: 7651 - protein, 657 aa, Ashbya gossypii ATCC 10895
MGNAPSRQLSTSKKKRSGSTSNSADDELPQFTRTDTSQSVKSSRSVRSTRSRKSQSGSVPGTPKTASSDANVIALPEGSSRKNSNSHGNIPALSRSNSQHSFTPHQHINEAQQEQRVSPDQLRAPRAASFSNGTGDLPPSMVQMEPKSPILRHFSSSNHMNTSYNENSLTDDDMDANYGVESNDDSHSHRSRRESRRRSSGSSQRRRSGSSQQHLELPFSAHNASRTSSHSSSHSRKSSLSAIGGGNSVYSTPMASPAVRKDDGMDYFCGADTVYGGSKDVLDGAILEKGQEHDHGVDSGAGDVYGHDIPQDPEEIMSTNDGTMPKKKKSIKPLDIDEMIQKLLDAGYLGKRTRNVCLKNSEIAQICHLAREIFLSQPSLLELSPPVKIVGDVHGQYADLLRLFTKCGFPPSSNYLFLGDYVDRGKQSLETILLLLCYKIKYPENFFLLRGNHECANVTRVYGFYDECKRRCNIKTWKLLIDTFNTLPLAAIVAGKIFCVHGGLSPVLNSMDEIRHVSRPTDVPDFGLINDLLWSDPTDSPNEWEDNERGVSYCYNKVAINKFLNKFGFDLVCRAHMVVEDGYEFFNDRSLVTVFSAPNYCGEFDNWGAVMSVSEGLLCSFELLDPLDSAALKQVMKKGRQERKLANKQQQNLQETN

SEQ ID NO: 7652 - protein, 473 aa, Nocardia farcinica IFM 10152
MMRRTKIVCTLGPATATEDRIRELVESGMDVARLNFSHGEHSDHAENYKKVRQASDHLGRAVGILADLQGPKIRLGRFAEGRTVWATGEEVRITVDDIDGSHDRVSTTYKQLAQDAKPGDRLLVDDGKVGLTVTRVEGNDVVCRVTEGGPVSNNKGVSLPGMDVSVPALSDKDIEDLEFALDLGVDFIALSFVRSPADVELVHDVMDKVGRRVPVIGKLEKPEAIDNLEAIVLAFDAIMVARGDLGVELPLEQVPLVQKRAIQMARENAKPVIVATQMLESMIENSRPTRAEASDVANAVLDGADAVMLSGETSVGAFPIETVRTMARIVHAVEAESSTRVPPLTHVPRTKRGVISYAARDIGERLNAKALVAFTQSGDTVRRLARLHTPLPLLAFTPLPEVRSQLALTWGTETFIVPTVDSTDAMIHQVDQALLSMGRYSKGDLVVIVAGSPPGTVGSTNLIHVHRIGEEDH

SEQ ID NO: 7653 - protein, 404 aa, Shewanella sp. MR-7
MRPIIKSNKLDTVCYDIRGPVHKEARRLEDEGHRILKLNIGNPAPFGFEAPEEIVRDVILNLPSAQGYCESKGLFSARKAIVQHYQAQGIFGVDIEDIYIGNGVSELIMMAMQGLLNTDDEILIPSPDYPLWTAAANLAGGKAVHYRCDEDADWFPDLDDIKSKISSRTRGIVLINPNNPTGAVYSKELLLQVVELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLREKKILLVHGSAFNWPEPDHLRVVFLPYKEDLTKALTEFGHFLETYKQ

SEQ ID NO: 7654 - protein, 817 aa, Vibrio fischeri ES114
MKTNNIEKFDKAAFKASVKQHLVTTFAADEKTASAKVWYLAMGKALAELTTFDLVATENDEKIKNARSVNYLSLEFLIGRLTGNNLISMGLYEEITEAMGELGYNLTDLLEEERDPALGNGGLGRLAACFMDSLAAQEYPAIGYGLHYEYGLFRQSFEDGRQKEAPDAWCGVEGYPWEVARPDFAQQVGFYGHVETYTEKGQEKRRWVPGMSVEGMPWDLPIVGYQSDTVYPLRLWECRAKAPFSLASFNNGDYFEAQHALIDAGNVTKVLYPNDNHEKGKTLRLMQQYFHCACSIADILRRHDAAGHKIEDLSKYETIQLNDTHPTIGIPELMRVLIDVRGLSWDTAWEICSNTFAYTNHTLLPEALETWSESLISRLLPRHMEIIYQINYLFLEGVKLKWPGDVDKLRKLSIIEEGTHRMVRMANLCVVSSYAVNGVAALHSELVKRDLFPEFNEYFPGKLTNVTNGVTPRRWLKFCNPGLSNLISGKIGNEWPAHLDQLSDIAVFADDEKFQKEFMAVKKQNKQRLANWVQENMGIELNTDAIFDVQIKRLHEYKRQHLDLLNILSLYHRILNEPGFDMHPRVFFFAAKAAPGYHLAKEIIFAINKVAEKVNNDPRVSDLLKVVFIPDYRVSMAEIIIPAADVSEQISTAGKEASGTGNMKMALNGALTVGTMDGANVEIREEVGDENIFIFGLEVDEVEALKASGYSPYKYYEADSLLQASLDLLAGDEFTPGKVGLLSAIRDNLLYGGDPYLVLADFADYVRAQNDIDAAYRDQKQWAKMAILNTALVGKFSSDRSIRDYVNNIWKLESVNR

SEQ ID NO: 7655 - protein, 290 aa, Prochlorococcus marinus str. MIT 9312
MDIPKIQWYPGHIAKAEKKLSEIINKVDLVIEVRDARIPLSTGHPHLNKWINNKKHILVINRSDMISHNTINSWNNWFNAKDQYPLWCDAKRGIGIKEICKSAKDSRSSIDDRRLSRGMRIRPIRALTLGFPNVGKSALINRIAKKRVVDSARKAGVTRNLRWIKLDSGIDLLDAPGVIPPNLEDQKSALNLALCDDIGEAAYEIESVAIEFIKIISTLNKDKNANISVKKISNRYGVDITKGFKSPSAWIDEAASKHTSGDKRRMSHKLLEDYRNQMLGKIALEVPLWN

SEQ ID NO: 7656 - protein, 740 aa, Oryza sativa
MAQPRRNEEDVLVGFTVDEILRRTEGQMDARMLDSNIGMISMVVHYFVLLPLVDTSLLTYALKASRGSFNRISSLPDVHLHDIVSHLPAKDSPLTKPITERNHAQPPAKTLAHLPPTPPSSFLLLPSSALPSLLPSAAAAAASNREEEKMVKKSKKSKSKRVTLRQKHKVLRKVKEHHRKKRKEAKKEGKSHRKKVEKDPGIPNEWPFKEQELKALEARRAQALQELELKKEARKERARKRKLGLLEDEDIANLASAASAQGSEFAEKDAAKENASLDVVKSQDHSERAFYKELVKVIEASDVILEVLDARDPLGTRCIDMEKMVRKADPSKRIVLLLNKIDLVPKESVEKWLTYLREEMPTVAFKCNTQEQRTKLGWKSSKIDKSSNIPQSSDCLGAENLIKLLKNYSRSHELKLAITVGIVGLPNVGKSSLINSLKRSRVVNVGSTPGVTRSMQEVQLDKKVKLLDCPGVVMLKSSNSGVSVALRNCKRVEKMEDPISPVKEILDLCPHEKLLSLYRVPTFTSVDDFLQKVATLRGKLKKGGIVDVEAAARIVLHDWNEGKIPYFTVPPKRDAVDDSDAVIISETGKEFNIDEIYKAESSYIGGLKSLEEFRHIEIPSNAPPQIDEEMLEDGKKQNEPAQENHDESMSDANEREGAKTASASTQNDKLYTAEGILDPRKRKAEKKRRKANKFSVLTDMDADYDFKVDYQMKDALAEEGNDGGDEEPKEADPMTGVDDA

SEQ ID NO: 7657 - protein, 384 aa, Gibberella zeae PH-1
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 7658 - protein, 161 aa, Nicotiana glauca
DTSRRLNNCDLSYNFKKIADEYKKEALEIRWPNLTTTKAISKKDQVFWEKEYYKHGTCCSDLFNKDAYFDLAISLKDKFDLLNILGRNGITPGTTHLTSRKIQNAIKSVTQGVPNLTCSDDFQGTTELLQIGICFNRKIAVMHCPNPKSCSPKGPNGITFP

SEQ ID NO: 7659 - protein, 160 aa, Nicotiana glauca
DKHVMLNDCAKSYTDITDARKGKELDKRWPDLTYAEEDAIKKQSFWRYEYNKHGTCCSERYKQEAYFDLAVNLKDKFDLLQILKSEGIIPGKTYRVDKIEEAIRSATQEYPNLTCIGDSSKTMELKEIGICFNREATKVMNCHRRKTCKPLNKKEISIPL

SEQ ID NO: 7660 - protein, 469 aa, Salmonella enterica subsp. enterica serovar Typhi
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPPEEAKEIPQVAGSLEEALNALDLDREFLKAGGVFTDEAIDAYIALRREEDDRVRMTPHPVEFELYYSV

SEQ ID NO: 7661 - protein, 161 aa, Nicotiana glauca
NQSAMLNDCDTEDKYTDIGDPRKRKQLEYYWPDLTAKVGDILKHQGFWGYEFNKHGTCSMDLYNQDEYFDLAIKLKDKFDVLTILKNHGIIPGKTCTVKNVEDAIEAVTTKVPNLNCIGHSSRTMELLEIGICFNREATEVIACRRRWKSHPNGNQKITLP

SEQ ID NO: 7662 - protein, 514 aa, Salmonella typhi
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQEHTAHTNLPVPLIYVGEKNVKAVEGGKLSDIAPTMLSLMGMEIPQEMTGKPLFIVE

SEQ ID NO: 7663 - protein, 354 aa, Zea mays
MTKSSGALDLARSTGGSLSKDQVKSAVDQYVKYHDLHGGEQESRKSNYADLANKYYDLVTGFYEYGWGDSFHFAGGYPGETSREAIKRHQHFMALQLGLKKGMKVLDVGCGIGGPLIEIARFSSTSITGLTNNDYHVSRGKEHIFSAGLSEQCCSLKGDFMNMPIADNTFDAAYAIQATCYAPEAQGVYSEVYRVLKPGQYFALDEWCLTDRFDPKNTKHLTTKAEIELGDGLPDIRTTRQCVQAMKDAGFEVVFAKDLAQDFPCPWYQTMDPNYFSWTNFQCTRPGRIITRAIVNTLEFLRIAPAGSVGAYNVLTSASDGLLKGGREGIFTASFFVLGRKPLKETEIVNGGNL

SEQ ID NO: 7664 - protein, 533 aa, Aquifex aeolicus VF5
MYKVLITDPIAPEGIELLQKDPEVEVYNEPDISYEELLEIIKDFDAIITRSRTPVTKELLERAEKLKVVGRAGVGVDNVDIEEATKRGILVVNTPGANTIGATELTMMHMLTIMRNGHKAHESMLNYKWDRKKFMGEELYGRILGIIGLGNIGSQVAIRAKAFGMKVMAYDPYIPREKAEKLGVKLVDNLHDMLREIDVLTIHAPLTHETKNMIDEKEFEIMKDGVYIVNCARGGIINEKALIKYMESGKIKGVALDVYSKEPPPPEFIDELKRLADKVNISLSPHIGANTYESQRNVAVIVAQQVLKALKGQTVEYAVNAPFPDLSVLTLIKPYLDLAEKLGKFLVQWTEEGIREVHIEVRGDIAEYFQPISSAVLKGILEEVVDFPVNIINAFYVAKDRGIKVEELSSEETPDFKHYIKVVVKADGKEKVVAGTVLEGQIPRITEIDRYKVDIEPEGILLVFENKDVPGVIGKIGSILGEANINIAGFRLGREKKGGIAIGILNLDEPASEEVLSRIKEIPEILFVKHIVL

SEQ ID NO: 7665 - protein, 244 aa, Triticum aestivum
  misc_feature (133)..(133): Xaa can be any naturally occurring amino acid
  misc_feature (156)..(156): Xaa can be any naturally occurring amino acid
  unsure (1)..(244): unsure at all Xaa locations
MATRQLASRPAMLGLRATRAARLPCPYPSPCSAAQAASLSGLARRAPLLAVASPAPSSPAALSLLASARPVSAAWGSAMRPAGEHPTPGTRVLCTAASSAPREGKEVLVQHLLVGEKDARLLVDLEKSIASRXRDLIDLAVKHSLCPSKENGGMLXGWVRREQMVPKFEETAFIAPLNKLDRVKTKFGWAFTAGGSLRGNKGLLENIHPKKLHEQMQIPIFWEKDPLYGCSGNPIKWKKHFPFQ

SEQ ID NO: 7666 - protein, 376 aa, Parvularcula bermudensis HTCC2503
MAVTQKARDLQAAGRDVLTLSMGELDFETPAPVKEAAIAAIAAGETRYTAVDGTPALKAAITEKYRRDHDFLLSPEEIVATTGGKFLIYAALRATLEPGDEVIIPSPYWVSYPGIVRMCGAVPVILATQAGQGFLPDPQTLKATMTPKTRWILLNFPNNPSGATLPLEHAAALAEVIEAHPRALVLSDDIYELIRFDASPPGPLFAKMKGMRERTLTVNGVSKSHAMTGWRLGFGAGPAPLMAAIRRVAGQTTSNPCSISQAAAVAALGMEPSFLTDWRTALRTRRDLVVRTLNRIEGISCLSPSGAFYVFPDINGVVKRKGLADDTAFCTALLDEEALALVPGSAFGAPGFVRLSFAAADSVLEEAMGRLKRFCA

SEQ ID NO: 7667 - protein, 482 aa, Aquifex aeolicus VF5
MELIFEKSKKGRKGYKLPELDVEEVNIKEYLPEEYLREELDFPEVSELDVVRHYTNLSHLNYAVDTTMVPLGSCTMKYNPRINEELVNKKEFLNVHPLTPEEYIQPLLKLVYELKELLKELGGFAEVSLQPAAGAHGELLGLLLIHAYHQDRGNKEKKVVLIPDSAHGTNPASAAICGFDIKVVKSDKKGELDFEDFIKKLDERVAALMITNPNTLGIFERKIKEIAEELHKRDALLYMDGANFNALVGRFKPGEWGVDVMHFNLHKTFSTPHGGGGPGAGPVGVSERLKPYLPVPQIEYDGKKYYLNWNIEKSVGKILAFHGHFLVWLKALAYILTYGKDIKKVSEYAVLNARYLKHLLKGVFKDPYPESPCMHEFVLSATNLTKYGVRASDVAKRILDYGFYAPTMYFPLIVREALMIEPTETENPDTLKKFALILRKIVKEAKEKPEILKKAPHRTPVRRIKEAEANRNLILKFKDIKE

SEQ ID NO: 7668 - protein, 349 aa, Burkholderia thailandensis E264
MKALVYHGPGRKSLDERPMPELAAPTDVIVRVTRTTICGTDLHILKGDVPSCEPGRIIGHEGVGVVHRAGAAVSTLKEGDRVLISCISSCGQCEYCRRGMYSHCTTGGWILGNRIDGTQAEYVRIPHAQTSLYRIAPGADEEALVMLSDILPTGFECGVLNGRVQPGGTVAIVGAGPIGLAALLTAQFYSPAQIVMIDPDPNRLAVAQRFGATACIDNGQVDAVAEVKALTGGGVDCAIEAVGIPASFELCQQIIAPGGVIANVGVHGVKADLHLETLWDRNITITTRLVDTSSTPMLLKTVGAGRLDPRRLITHRFPLADIEQAYETFGHAANTRALKVIVEVSDISE

SEQ ID NO: 7669 - protein, 500 aa, Streptococcus pyogenes MGAS8232
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGTGGTNTMRVRTVK

SEQ ID NO: 7670 - protein, 632 aa, Erwinia rhapontici
  misc_feature (236)..(236): Xaa can be any naturally occurring amino acid
  misc_feature (449)..(449): Xaa can be any naturally occurring amino acid
  unsure (1)..(632): unsure at all Xaa locations
MSSQELKAAVAIFLATTFSATSYQACSAGPDTAPSLTVQQSNALPTWWKQAVFYQVYPRSFKDTNGDGIGDLNGIIENLDYLKKLGIDAIWINPHYDSPNTDNGYDIRDYRKIMKEYGTMEDFDRLISEMKKRNMRLMIDIVINHTSDQHAWFVQSKSGKNNPYRDYYFWRDGKDGHAPNNYPSFFGGSAWEKDDKSGQYYLHYFAKQQPDLNWDNPKVRQDLYDMLRFWLDKGVXGLRFDTVATYSKIPNFPDLSQQQLKNFAEEYTKGPKIHDYVNEMNREVLSHYDIATAGEIFGVPLDKSIKFFDRRRNELNIAFTFDLIRLDRDADERWRRKDWTLSQFRKIVDKVDQTAGEYGWNAFFLDNHDNPRAVSHFGDDRPQWREHAAKALATLTLTQRATPFIYQGSELGMTNYPFKKIDDFDDVEVKGFWQDYVETGKVKAEEFLXNVRQTSRDNSRTPFQWDASKNAGFTSGTPWLKINPNYKEINSADQINNPNSVFNYYRKLINIRHDIPALTYGSYIDLAPDNNSVYAYTRTFGAEKYLVVINFKEEVMHYTLPGDLSINKVITENNSHTIVNKNDVEDPRGATSVCSPFQAQKRPGDPGYSAAHSIRFLPRFFASYRGDIHAFK

SEQ ID NO: 7671 - protein, 585 aa, Pseudomonas aeruginosa PAO1
MHAVDFIQDLAVIMLVAGVVTILFHRLRQPVVLGYIVAGFIIGPHTPPFGLIHDEDTIKTLAELGVIFLMFCLGLEFSLRKLFQVGATAFIAAFLEIVLMIWIGFEIGRFFEWSTMDSLFLGAILAISSTTIIVKALGDLKMKNERFAQLIFGVLIVEDILGIGIIALLSGIAVSGSVETGEVFSTVGKLSLFMIVALVVGILLVPRLLAYVAKFESNEMLLVTVLGLCFGFCLLVVKLEYSMVLGAFLIGAIMAESRQLVQIERLIEPVRDMFSAIFFVAIGLLIDPKILVEYAWPIALITVAVVLGKMFSCGMGAFIAGNDGRTSLRVGMGLSQIGEFSFIIAALGMTLKVTSDFLYPVAVAVSAITTLLTPYLIRAADPLSQHLANAMPQRMARIFGHYGDWLRSIQPQGDRAVLAAMIRRILLQVGVNLALVIAIFLAGGYFADTLSAWMSQWVAYDGLHKALIWGGALLVSLAFLIAAYRKLKALSMLLAELGVKPEKAGRHTARVRRVISEIIPLLSLAGMMVLLAALSSSILPPGELLVVVVLVAGLVIAVLWRWLIRVHSRMQIALMETLDQEKGSH

SEQ ID NO: 7672 - protein, 277 aa, Leifsonia xyli subsp. xyli str. CTCB07
MPSVPSEAPASPSPKRVRTRHFQAAKEEGSRFTGLTSYDTLTAQIFDEAGIDFLLVGDSAANTVLGYDTTLPMTVDELIPLTRAVARAAKRAFVVADLPFGSYETGPQEALRTAVRFMKETGAHAVKLEGGERSAEQIRRIVDAGVPVMGHIGFTPQSEHGLGGHLVQGRGQGAEQVVDDAHAVEEAGAFAVVLEMVPADVAQRVTQELRIPTIGVGAGPHVDGQLLVWTDWAGFTTGRVPRFAKQYADLKDVLTEAARMYRDEVGSGVFPGPEHSF

SEQ ID NO: 7673 - protein, 392 aa, Oryza sativa
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 7674 - protein, 445 aa, Leifsonia xyli subsp. xyli str. CTCB07
MDKQRDFVLRTIEERGIKFVRLWFTDVVGTLKSVAIAPAEVEGAFYEGLGFDGSAIEGLTRAYESDLLAHPDPTTFQILPWRGEIDPTARMFCDITTPDGQPAVSDPRNVLKRTLEKAADRGFTFYTHPEIEFYLLTSSRFGENGPEPVDSAGYFDNVPGGTAHDFRRRSVRMLEDLGISVEFSHHEAGPGQNEIDLRYADALTTADNIMTFRTVVKEVAIEQGVYATFMPKPLSGHPGSGMHTHMSLFEGDTNAFFEAGAQYQLSKVGRQFIAGLLKHAPEITAVTNQFVNSYKRLWGGDEAPSFVCWGHNNRSALVRVPLYKPNKGQSSRVEYRAIDSAANPYLAFSLMLAAGLAGIEGGYELPPEAEDNVWALSDAERRALGYSQLPASLDHAIALMEGSELVAETLGEQVFNYALLNKRREWAQYRAQVTPFELRSNLEIL

SEQ ID NO: 7675 - protein, 109 aa, Acidobacteria bacterium Ellin345
MSKSLEYEIQPEEVKPLLGTEGVVLVDVREPWERDTAKIEDTLFIPMGDIPARIQELDPDDHVIVVCHHGVRSLSVAAWLRQQGYEKAQSMAGGIDRWSRFIDPKVPLY

SEQ ID NO: 7676 - protein, 480 aa, Pseudomonas syringae pv. syringae B728a
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVRKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEEGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 7677 - protein, 389 aa, Xanthomonas axonopodis pv. citri str. 306
MRALCWNGVNDLRVETVPDPALVNPRDVILKVGLTTTCGSDLHFIDGYLPTMREGDVIGHEFMGTVVEIGTAVKNVRVGQRVVVPSFISCGGCWHCERKEFSLCDNTNPNWEMQEPLLGHPTAGIYGYTHAFGGYAGSHATYIRVPHADVGCFEVPDGVSDEDALFLSDAGPTGFMGADFCDIQSGDTVAVWGCGGVGLMAQQSARILGAERVIGIDRLPERLAMARDVLGVEVIDYSAVDSVVDVLREMTGGRGPDACIDAVGMEAHGTGIGHTYDRVKQALHLHTDRGQALREAILACRKGGILSVLGVYGVMDKFPLGAVMNKGLTVRTAQQHGQRYVPKLLDLAQAGRLKSGFLLTHKMPLEDAVRGYDMFKHKHDGCVRAGFVP

SEQ ID NO: 7678 - protein, 474 aa, Leifsonia xyli subsp. xyli str. CTCB07
MFRDSSEVLKYIKETDVKFLDIRFTDLPGVQQHFNIPAATVDEEFFSVGQLFDGSSIRGFASIHESDMQLIPDVSTAYIDPFRHERTLIMVFDIYNPRNGDIYAKDPRQVAKKAEKYLATAGIADTAFFAPEAEFYIFDDVRYEVKQNAIFYAVDSSEGAWNSGREEEGGNLANKTPYKGGYFPVSPVDQHADLRDDIVLKLVEAGLEVERSHHEVGTAGQGEINYKFDTMVSAADDILKFKYIVKNTANEWGKTATFMPKPLFGDNGSGMHTHQSLWNDGKPLFYDEAGYGALSNIARWYIGGLLKHAPAVLAFTNPTVNSFHRLVPGFEAPVNLVYSAGNRSASIRIPITGSNPKAKRIEFRAPDASGNPYLAFAAQLMAGIDGIKNRIEPHEPVDKDLYELPPEEARNIPQVPASLGEALDALEADHDFLTAGGVFTPELIETWIEYKREKEIKPLAQRPHPFEYELYYGV

SEQ ID NO: 7679 - protein, 254 aa, Bacillus anthracis str. A2012
MQSMRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 7680 - protein, 339 aa, Synechococcus elongatus PCC 7942
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVLITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 7681 - protein, 271 aa, Wolinella succinogenes
MRKSLISSVAAILLLSGLSLSAKTLASVDGDEITDKDISVMLRAMPGVSYDQLPEDMQKKVLEQAIERKLLAKQAKSEGIQNSKEFKDALEDAKEDLTLEVWMRQQMNNAKVSEGDMRKFYDENKEKFVQPELVKAKHILVQNEKEAKEVIAEIGKAGAKASEKFSELAKSKSIDPAGQNGGELGWFSKDQMVPEFANAAFALQKGSYSKTPVKTQFGYHVIYAEDKKAQAVLPYEDVKPQIEQNLKIQKFRDSVSSTAKKLREKAQVTFK

SEQ ID NO: 7682 - protein, 157 aa, Brugmansia versicolor
NESTTLNYCDRSVTYDKFTDDQKKDDLDERWPDLTTDPVVCKDKQSFWSYEYRKHGSCCSDIYNRDQYFDLAMALKDRFDLLKSFRKHRFIPGSSYTIQKINSTILAVTRGVPNISCSKVMELEQIGICFDRTAKSVIHCPHPKTCNPTRNNGIMFP

SEQ ID NO: 7683 - protein, 496 aa, Acidovorax sp. JS42
MEMKTSPLSLLKDPSLLKTDALLGGQWFAGGARFAVHDPATGLKLADVANLGAKEAELAIAAANEAWPAWKAKTAKERSTILRQWFDLLMQHQDDLGRLMTAEQGKPLPEAKGEVAYGASFVEWFAEEAKRVNGETLPQFDNNRRLLVLKQPIGVCAAITPWNFPLAMITRKVAPALAAGCPVVIKPAELTPLTALAAAELALRAGIPAGVLSVLTADAENSIAIGKVLCASDVVRHLSFTGSTEVGRILMAQCAPTVKKLSLELGGNAPFIVFDDADLDSAVEGAFASKYRNAGQTCVCTNRFYVQAGVYDAFVAKFAARVKTAKVGNGFEDGVNQGPLIEPAAVDKVQRHLDDAIAKGASVVTGGKHLAELGAGQFFEPTVLANATAGMLCAREETFGPLAPVFRFETEQEAIAAANATEFGLASYFYSRDVGRIFRVGEALEYGMVGVNVGILATEHVPFGGVKQSGLGREGSHYGMDDYVEIKYLCVGDIQK

SEQ ID NO: 7684 - protein, 173 aa, Glycine max
FCLGLLVFFSKVSLATPKSHHSAFVGKYADELIKTAKYIATPGKGILAADESTGTIGKRFSSINVENIESNRQALRELLFTSPGALPCLSGVILFEETLYQKTSDGKPFVEFLQENGVIPGIKVDKGVVDLAGTNGETTTQGLDSLGARCQEYYKAGARFAKWRAVLKIGATE

SEQ ID NO: 7685 - protein, 155 aa, Brugmansia versicolor
NYRTMLNFCTSDDYDEITDENQKNRLYVRWPDLILDEADCKKNQGFWKKEYEKHGTCCIDTYNQVQYFDLATNLKDRFDLLKSFRNHGVIPGTSHTVQKINNTVKAITRGFPNLVCTKGMELKEIGICFDPAKNVINCPHPTTCKPTRSNRIVFP

SEQ ID NO: 7686 - protein, 510 aa, Clostridium acetobutylicum
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATYDLKPEMSAYEVTDELLKRLDEDKYDMVILNFANPDMVGHTGILEAAKKAVETVDECLGKIVDKVLKLDGSVFITADHGNSEQMIDYSNGKPMTAHTVNPVPFVYVSNHTEAKKLNEGVLADIAPTMLQEMGLEKPEEMTGKSLFE

SEQ ID NO: 7687 - protein, 328 aa, Zea mays
MAAAVPNGHTAAAGDDDAPPAASSSLVFLGTGCSSAVPNARCLIQPPDPPCPVCSQSLSVPPELNPNYRCNTSLLIDYCQDERAHKYIIIDVGKTFREQVLRWFVRHKIPCVDSILLTHEHADAILGLDDVRVVQPFSPTNDIDPTPIYLSQFAMDSICQKFPYLVKKKLKEGEEVRRVAQLEWKIIESDIQKPFTTSGLEFVPLPVIHGEDYICLGFLFGRKSKVAYISDVSRFPPSTEYAISKSGGGQLDLLILDCLYRTGSHNVHLCWDQTLDAVRRICPKRALLIGMTHEMDHHKDNQTLEEWSRREGIDVQLARDGLRVYIDL

SEQ ID NO: 7688 - protein, 264 aa, Candida albicans SC5314
MPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 7689 - protein, 187 aa, Triticum aestivum
  misc_feature (80)..(80): Xaa can be any naturally occurring amino acid
  misc_feature (86)..(86): Xaa can be any naturally occurring amino acid
  misc_feature (101)..(101): Xaa can be any naturally occurring amino acid
  misc_feature (128)..(128): Xaa can be any naturally occurring amino acid
  misc_feature (132)..(132): Xaa can be any naturally occurring amino acid
  misc_feature (139)..(139): Xaa can be any naturally occurring amino acid
  misc_feature (143)..(143): Xaa can be any naturally occurring amino acid
  misc_feature (150)..(150): Xaa can be any naturally occurring amino acid
  misc_feature (156)..(156): Xaa can be any naturally occurring amino acid
  misc_feature (160)..(160): Xaa can be any naturally occurring amino acid
  misc_feature (163)..(163): Xaa can be any naturally occurring amino acid
  misc_feature (167)..(167): Xaa can be any naturally occurring amino acid
  misc_feature (171)..(171): Xaa can be any naturally occurring amino acid
  misc_feature (174)..(174): Xaa can be any naturally occurring amino acid
  unsure (1)..(187): unsure at all Xaa locations
MAPTVMASSATSVAPFQGLKSTAGLPVSRRSNGASLGSVSNGGRIRCMQVWPIEGIKKFETLSYLPPLSTEALLKQVDYXIRSKWXVPCLQFNKVGFILPXSTTHPLGYYDGRYWTMWKLLCSGCNDXTQVXNKVEEVXKDYXYPYVRIXRFNNMXQVHXSTXRLKXTGCXDPXKAKHKGILNAFNL

SEQ ID NO: 7690 - protein, 344 aa, Thanatephorus cucumeris
MTVKIGINGFGRIGRIVLRNAIEHGDVDVVAVNDPFIDLEYMVYMFKYDSTHGRFKGEVKADKDNKQLVINGKNIAVHSERNPGDINWDASGAEYVVESTGVFTTIEKASEHFKKSPSLKKVIISAPSADAPMHVVGVNLDAYDPKGPKVISNASCTTNCLAPLAKVIHDKFGIVEGLMTTVHATTATQKTVDGPSAKDWRGGRGASANIIPSSTGAAKAVGKVIPSLNGKLTGLAFRVPTSNVSFVDLVARLEKPATYDEIKAAIKEASEGPYKGIFGYTEDDVVSTDFVGDQHSSIFDSKAGISLNKKFVKLVSWYDNEWGYSRRVVDLIAYVAKKDKEAGC

SEQ ID NO: 7691 - protein, 838 aa, Geobacter metallireducens GS-15
MTDEAFPSESGSPELDTMMLIIKSFLEHLEYTLGKDKYSATRHDIFNALAYAVRDRMVERWLDTQQAYYNEDPKRIYYVSMEFLMGKTLENSLVNLGLLAEFREAMNSLGYDLDEFIEREQDAGLGNGGLGRLAACFLDSMATMGVPGYGYGIRYEYGIFRQNIIDGSQVEIPDNWLRYRNPWEMDRQEHLHPVKFYGRVVERKDTEGNTLFDWIDTEDVMAMAYDTPIPGYGTNTVNTMRLWTAKSTREFDLSFFNEGNYIRAVEKKMLTENISKVLYPADNVPEGKELRFKQEYFLACATVHDVIYRFHKQHEDLRRLPEKAAIQLNDTHPALCIPEMMRVLIDHHRLDWETAWNITTRTFAYTNHTILPEALEKWPVWFFEHILPRHIQIIYEINDRFLTAVRTRFPGDTGKLERMSLIEEHWERKVRMANLAVVGSHSVNGVAALHTEIIKEHVFKDFFEMYPERFNNKTNGITQRRWLKCANPDQARLIGDTIGNGWTTDLYKLTQLRPLVDDPAFMAQWQQVKRTNKDKLAEYILKHNCIQVNADSLFDCQVKRIHEYKRQLLNVLHVITLYNRIKANPDGDFVPRTIIFSGKAAPAYAIAKLIIRLINAVGDVINNDSQVGDRLKVVFLANYSVSLAEKIFPAADLSEQISTAGTEASGTGNMKFALNGALTIGTLDGANIEIMEEVGRDNIFIFGMNADEVEDLRRRGYNPRDYYSRNPELKKVLDMIAEGYFFPANRDLFRPIVDSLLNQGDHYMLLADYASYVACQEEVSRLYLDREQWARKAILNCAGMGKFSSDRTIAEYAREIWDVEPFEVHPVLEYRQHDVIPD

SEQ ID NO: 7692 - protein, 343 aa, Thanatephorus cucumeris
MTVKIGINGFGRIGRIVLRNAIEHGEVDVVAVNDPFIDLDYMVYMFKYDSTHGRFKGEVKVDKEKKQLVINGKNIDVHSERNPGDINWDASGAEYVVESTGVFTTIEKASEHFKKSPSLKKVVISAPSADAPMHVVGVNLDAYDPKGPKISNASCTTNCLAPLAKIIHDEFGIVEGLMTTVHATTATQKTVDGPSAKDWRGGRGAAANIIPSSTGAAKAVGKVIPSLNGKLTGLAFRVPTADVSVVDLVVRLEKSATYDEIKATIKKASEGEYKGIMGYTEDDVVSTDFVGDEHSSIFDAKAGISLNKNFVKLVSWYDNEWGYSRRVVDLIAYVAKKDKEAGC

SEQ ID NO: 7693 - protein, 337 aa, Thanatephorus cucumeris
MAVKIGINGFGRIGRIVLRNAILHGDIDVVAVNDPFIALDYMVYMFKYDSTHGRFKGQVEAKDGKLIIEGKPVAVHSERDPSTINWGDAEYVVESTGVFTTVEKASAHFKASPNLKKVVISAPSADAPMYVVGVNLDAYDPKGPKISNASCTTTCLGPLDKVINDEFGIVEGLMTTVHATTATQKTVDGPSAKDWRGGRGAAANIIPSSTGAAKAVGKVIPSLNGKLTGLAFRVPTSDVSVVDLVVRLEKSASYDEIKAALKKASEGEYKGIIGYTEDDVVSTDFVGDEHSSIFDAKAGISLNKNFVKLVSWYDNEWGYSRRVVDLIAHIAKKDAEA

SEQ ID NO: 7694 - protein, 472 aa, Erythrobacter sp. NAP1
MASAKDVVKQIKDGDIEWVDLRFTDPKGKWQHLTMAASVMDEDALDDGLMFDGSSIEGWKAINESDMILKPDMDAVYPDPFSETPMLSIFCDIVEPSDGQLYARDPRSTAKRAEAYLASTGIGDTVYVGPEPEFFMFDDVRFEDGYAGSGYRIDDIELPTNTGTDYTELGGGNMGHRPRAKGGYFPVAPVDSAMDIRGEMVSTMMEMGLNMDKHHHEVAAAQHELGITFSTLTKTADQVQVYKYVVQQVAHAYGKTATFMPKPIKDDNGSGMHTHMSIWNDGKPTFAGNEYAGLSETCLHYIGGVIKHAKAINAFTNATTNSYKRLVPGFEAPVLLAYSARNRSASCRIPYGAGEKAKRVEFRFPDAICNPYLAFSALLMAGLDGIENKIHPGDAMDKNLYDLPPAELAEVPTVCGSLREALEALEEDHEFLLKGDVFSMDQIEAYAELKWEEQLRLETTPSPVEFDMYYSS

SEQ ID NO: 7695 - protein, 805 aa, Arabidopsis thaliana
MGMVLFACLLLLIIFPTCGYAAINTSSPLSIRQTLSSPGGFYELGFFSPNNTRNQYVGIWFKKIVPRVVVWVANRDTPVTSSAANLTISSNGSLILLDGKEDVIWSTGKAFSSNKCHAQLLDTGNFVVIDDVSGNKLWQSFEHLGNTMLPQSSLMYDTSNGKKRVLTTWKSNSDPSPGEFSLEITPQIPTQGLIRRGSVPYWRCGPWAKTRFSGISGIDASYVSPFSVVQDTAAGTGSFSYSTLRNYNLSYVTLTPEGQMKILWDDGNDWKLHLSLPENPCDLYGRCGPYGLCVRSDPPKCECLKGFVPKSDEEWGKGNWTSGCVRRTKLSCQAKSSMKTQGKDTDIFYRMTDVKTPDLHQFASFLNAEQCYQGCLGNCSCTAFAYISGIGCLVWNGELADTVQFLSSGEILFIRLASSELAGSSRRKIIVGTTVSLSIFLILVFAAIMLWRYRAKQNDAWKNGFERQDVSGVNFFEMHTIRTATNNFSPSNKLGQGGFGPVYKGKLVDGKEIGVKRLASSSGQGTEEFMNEITLISKLQHRNLVRLLGYCIDGEEKLLIYEFMVNKSLDIFIFDPCLKFELDWPKRFNIIQGIARGLLYLHRDSRLRVIHRNLKVSNILLDDRMNPKISDFGLARMFQGTQYQDNTRRVVGTLGYMSPEYAWAGLFSEKSDIYSFGVLMLEIISGKRISRFIYGDESKGLLAYTWDSWCETGGSNLLDRDLTDTCQAFEVARCVQIGLLCVQHEAVDRPNTLQVLSMLTSATDLPVPKQPIFAVHTLNDMPMLQANSQDFLSVNEMTESMIQGR

SEQ ID NO: 7696 - protein, 413 aa, Prochlorococcus marinus str. MIT 9313
MSLRTYHDPLHRGITLNASDAAEAMVMQLIDAAPFQRLRRIRQLGPAFLTFHGAESSRFTHSLGVFHLARLALERLLQFDSGLEEHRGLLYGAALLHDLGHAPLSHTGEEIFGLDHETWSARLVREHPAVRAPLEAYAPGTADGVANLLERGSSPHSVIKALVSSQLDCDRLDYLLRDSYSTGTHYGQLDLERILSALTLAPDGAMAIHPKGLMAVEHYLVVRNLMYRSVYNHRLNVVCNWLLEQVVSTARQFGAAHVWADKIMATWLWSLNQLDLDTFLANDDLRTGYHLLRWQDEGPAPLAELCKRFLNRHLLKALAVQHLSHSNQLEVLTLARQLAERQGFDPALCCGLRHQQQRGYHPYKGGLRLWDGRQLRALEQASPLVASLITPADSSWLIYPREIHGELQAALAT

SEQ ID NO: 7697 - protein, 332 aa, Glycine max
  misc_feature (226)..(226): Xaa can be any naturally occurring amino acid
  unsure (1)..(332): unsure at all Xaa locations
MASFNLSYSSSPALSRPRASKQFKLFNDVPFVRMNSKFPSSDNAIGRIKAKLISGGGDLLSYPNGNGIVIGKNLVGDESVQIEVQPNGTLADDTGLTSNVFSMDNNEFDSDSPSAGFASIPEAIEDIRQGKMVVVVDDEDRENEGDLIMAAQLATPDAMAFIVKHGTGIVCVSMKEEDLDRLELPLMVNSKDNDEKLCTAFTVTVDAKHGTTTGVSAHDRATTVLXLASRDSTPGDFNRPGHIFPLKYREGGVLKRAGHTEASADLAVLAGLDPVAVLCEIVDDDGSMARLPKLRQFAERENLKIVSIADLIRYAVTIHGPCNKIHCMHIYV

SEQ ID NO: 7698 - protein, 372 aa, Rhodospirillum rubrum ATCC 11170
MIVSRAAIAWEAGKPLSVEEVEVAPPRQGEVLVRIIATGVCHTDAYTLSGSDPEGVFPAILGHEGGGIVEEIGPGVTSVAVGDHVIPLYTPECGTCKFCRSGKTNLCQAIRATQGQGLMPDGTSRFSIKGREIRHYMGTSTFSEYTVLPEIALAKVNKAAPLEKICLLGCGVTTGMGAVLNTAKVEPGATVAIFGLGGIGLSAIIGCVMAGAGRIIGVDINPDKFEIARQLGATDVINSRDYDRPIQEVLIDMTDGGVDYSFECIGNVGVMRSALECCHKGWGQSVIIGVAGAGQEISTRPFQLVTGRVWRGSAFGGVKGRSELPALVERYLAGDFELDTFITHTMGLADINHAFELMHEGKSIRSVIHYDL

SEQ ID NO: 7699 - protein, 93 aa, Blastopirellula marina DSM 3645
MVSDFHRTMLKGGVFLYPPTAENPEGKLRILYEAFPIAFLCEQAGGKASDGTGRLLEIEPTSIHQRTPMVVGSQVEMEKFEAMVASGEISALV

SEQ ID NO: 7700 - protein, 488 aa, Nocardia farcinica IFM 10152
MNQTADVLTRGLTARHIRFIALGSAIGTGLFYGSAEAIHRAGPAVLLAYLIGGAAIYIVLRSLGEMAVSNPVSGSFGEYASKHLGPLAGFMTGWTYTFEMVIVCLADVTAFGVYMGFWFPDVPRWIWVLSIILFIGAVNLLHVKVFGEVEFWFSLVKIVAILAMIVGGVAILIFGFGMHDTDAGLTHLWAEGGFFATGIGGFLTCFAIVMFAFGGTEIIGITAGEAERPERTIPRAINTVPVRIMLFYVLTLAVIMAINPWQSIGSEGSPFVQIFQALGIGPAATVLNIVVITAALSAINSDIFGAGRMMYGMAQRGQAPAVMRQVSRNGVPWMTVVIMTVTLLVGVLLNYLIPDKVFLIIASIATFATIFVWLMILLAHYRSRRRMSAEETAALRFPVPFWPYGQLITIAFLVFVVAMIAFDADSRVALVVGAVWLALLWLAYRRWVRPTPAATDAAPVAGPGTDPADPADPALTTPTPRIEMEKNL

SEQ ID NO: 7701 - protein, 316 aa, Cenibacterium arsenoxidans
MSIQWYPGHMNAARKKAAEAMEKVDMIIEVLDARVPQASCNPMIEELRTFRQRPCLKILNKSDLADPAATQQWLDFYNKQKNVHAVALSCKKPSDVAKIPALSMKIAPHRGTALKPLRIMIMGIPNVGKSTLMNALLKKRVAKVGDEPAVTKMQQRLYLGNNIVLTDTPGMMWPKIAYPSDGLMLAASHAIGSNALIEEEVATFLADIILARYPALVAARYGMKTEGIDGVSVIEGVAVRRGLRIKGGELDLEKAAHIFLQDYRTGLLGRISLETPESRVELLTTFQPPPSLSDVADESAEDAPEENRDDAFSHRR

SEQ ID NO: 7702 - protein, 477 aa, Propionibacterium acnes KPA171202
MRRAKIVNTLGPAVTSHDAMKELMEAGMNIARLNMSHGDYSEHQERLDLVRSVSKELGLNVAALADLQGPKIRTGLFEKAEGESNGKIDLKIGDKFTITTDDIVGNQERVSTTFKGLPQDCKPGDVILIDDGKTVLQVDSVSGNDVNCHCTVAGPVGDHKGINLPGVAVSIPALTKKDEENLRWALKAGIDLVALSFVRHGSDIDRVHEIMDEEGRTVPVIAKLEKPQAIENLDEIIDVFDAVMVARGDMAVECPLEEVPLIQKQIIEKARLQAKPVIVATQMLESMIHAPRPTRAEAADVANAILDGADGVMTSAETSVGDFPGETVRTMAKIVESTEARGLDKIAKIDWDPHTTSGIMSKAAAEIAERAEAKFIVAFTKSGDTARRIARLRPSTPLIVFTSDETTTKTLAWVWGAHAVVTPVFKNAEELYRWVNAYLRDKGFVPVGDRVVVLSGSPMDIPGKTNNLRILRIKEDD

SEQ ID NO: 7703 - protein, 358 aa, Desulfovibrio gigas
MAQTILPFGPQHPVLPEPIHLKLTVEDEIVVDALPALGYVHRGLEKLCDIRDYNQMVQIVERVCGICSKIHAMCYCQGIEEMMGVQVPDRAKVLRVVWSELHRVHSHLLWLGLFADAFGFEALFYQFWKIREKVMDINEATTGNRVIVSVNEVGGVRRDLSAEQIRWIEAELKVVEKQVRELRSTILDDYTVKKRTVGKGVLTGAQALELGAVGPTLRGSGVFQDARQLKYAAFDRIDFQPIAYPNGDSWSRCAVRYDETLQSIDLVRQALARLPEGELSTKVKGKPEGEVVTRVEQPRGELLYYLKGNGTNNLDRCRIRTPTFSNIPPLVVMLPGLELADVPVVVLSIDPCISCTER

SEQ ID NO: 7704 - protein, 334 aa, Xylella fastidiosa Temecula1
MSIEQLAETAQAMVASGKGIIAIDESAGTIAKRFSSVGIENIEENRRAYRELLLTTPKLSDYISGAILFDETIRQSTKAGVPFPKYMAEHGIIPGIKVDKGAYPLAGCPGELVTEGLDGLRARLEEYYKLGARFAKWRAVINIGDDIPSGMCIDANVHALARYAALCQEQGLVPMVEPEVIMDGNHDISAAYEVTEATLRSLFNALYEQNVVLEGTILKASMVIPGTDCEEQASIDEVAESTVMCLKSTVPAILPGIVFLSGGQTDAQSTAHLNAMNQFDPLPWPLSFSYGRAMQQAALKLWSQDMKGNFAKAQQVVYERAKENGLAALGKWKG

SEQ ID NO: 7705 - protein, 488 aa, Xylella fastidiosa Temecula1
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDTTQVGVSYLGLPQDVAAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPIPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 7706 - protein, 479 aa, Agrobacterium tumefaciens str. C58
MPAKKTMLRPKKQATMAKKSPPLDLSSTRGVSSWREAAQWLRVRGIEDIECITPDLAGVARGKMMPTAKFTGDTSLALPSALYRHTISGEYPDETANFRYEPRDSDLKLVPDLSTLSVVPWESDPTAQVICDVVDAEGNFVPYTPRNVLKNVLSLYTEKGWKPVVAPEIEFYLVAMNDDPDYPLHPPKGRSGRSIVGGQSYSIAGINEFDELIDDIYHFSEKQGLEIDTLIHEEGPAQLEINLRHGDPIELADQVFLFKRTIREAALKHGIYATFMAKPMQGQPGSAMHIHQSVVEIDGGRNIFSNADGSPSKVFFSFVGGMQRYVPNALVMLAPYVNSYRRLTPDMACPVNNAWGYDNRTTAFRVPISSPQARRVENRLPSSDANPYLALAASLGCGWLGIVNNIEPTEPTADTANEGSIELPRGLLEAVALLEGEEQFDRVFGHEFVGLYAGLKRGEFETFMQVISPWEREFLLLNV

SEQ ID NO: 7707 - protein, 397 aa, Bacillus thuringiensis serovar konkukian str. 97-27
MFHRIEEALEDLKQGKVVIVCDDENRENEGDFIALAEYITPETINFMITHGRGLVCVPITEGYAERLQLEPMVSHNTDSHHTAFTVSIDHVSTTTGISAHERATTIQQLLNPASKGADFNRPGHIFPLIAKEGGVLRRAGHTEAAVDLAQLCGAEPAGVICEIINEDGTMARVPDLLQCAKQFDIKMITIEDLIAYRRHHETLVTREVEITLPTDFGTFQAIGYSNSLDTKEHIALVKGDISTGEPVLVRVHSECLTGDVFGSCRCDCGPQLHAALAQIEREGKGVLLYMRQEGRGIGLLNKLRAYKLQEEGFDTVEANEKLGFPADLRDYGIGAQILKDLGLQHLRLLTNNPRKIAGLQGYDLTVTERVPLQMPAKEENKTYLQTKVNKLGHLLNL

SEQ ID NO: 7708 - protein, 463 aa, Bacillus thuringiensis serovar konkukian str. 97-27
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQKRQKLSYKMPLYPLSSYFSLAFLVLVLGIMAYSEDTRIALIVGPIWLIGLAIVYYMKGFHKIDETPNSKIS

SEQ ID NO: 7709 - protein, 279 aa, Bacillus thuringiensis serovar konkukian str. 97-27
MSIQNISFLGAGSIAEAIIGGLLHANVVKGEQITVSNRSNETRLQELHQKYGVKGTHNKKELLTDTNILFLAMKPKDVAEALIPFKEYIHHNVLIISLLAGVSTHSIKNLLQKDVPIIRAMPNTSAAILKSATAISPSKHATKEHIQTAIALFETIGLVSVVEEEDMHAVTALSGSGPAYIYYVVEAMEEAAKEIGLKEDVAKSLILQTMIGAAEMLKASEKHPSILRKEITSPGGTTEAGIEVLQEHKFQQALISCITQAAQRSHNLGKTLEQLTKEK

SEQ ID NO: 7710 - protein, 798 aa, Aspergillus nidulans FGSC A4
MAFPDSSQQGMADAQSDAIQNNSDLLDGAADFDHDVDSSLLADHGIEGSDTIGEGKHNAKAVLAASGVSLPKSVSGQDASNMDTSPGSQNGSANGAAPGKKRSRDGAFIPPSSPGNALPVRVRETPMEKILLDEYVNREFQHSALTAWQNPSQQLLQEKRAERDYYLALRRENHTNPAALYGVGYEGFGNARTDLRNQHPQLLYPAHRRRPGNRKTRELRVSRKDMKTQSEQLEHLVPIRLDIDWEKVKIRDTFTWNLHDRVVSPDLFAEKLVEDLGLPLESCGPLVRMISQSIQEQICDFYPHVHIEEEALDPHLPYSAYKNDELRIVVKLNITIGQHTLVDQFEWDINDPHNSPEEFAARMTTDLSLSGEFTTAIAHSIREQSQLFTKSLYIVSHPFDGRPVEDPDLKASFLPSPLTSSFRPFQAAKEFTPYLYELNEAELERTEVSFQRDQRRQKRSVNRRGGPALPDLKDRQRTIRTLLVSSVIPNTAPSLEESNVFKRSGSSRRGRAAVGLREGGDDSDESDSDESSLVGSPAIGPHLAQGTARTRGMRGAATAAHAALRANLGQSATPEPHNESRVSARRRDYREESPEEPEKLIVTLKISREKFRQFLMNGYKTNSAAVNSTPATQPASQRSTPQVQTPTLNSTPVPSQSHSQARLPSAGRPGPIQHLGAVEAPNPPQPGVPGPPPPSWLVAGLNRLNQANPNDSFEAVMRYTAVDTETMQPVTHSQAQANQKLKFLYLPRIRCHDCPGKLYTPGPATTVDNFEVHLRNRQHKERVEERLAKAAAASNAAT

SEQ ID NO: 7711 - protein, 269 aa, Leifsonia xyli subsp. xyli str. CTCB07
MLGAGSMGRAILSGLTAPGVTVTGGIRATNRSAASAEGLGDLPGVTAYATEADPDANRLAVAGTEIVVVAVKPGMVPGLLREIAPSLTPGAVVVSVAAGVTTATFESLLPESVAVVRSMPNTPAVVGRAVTGISAGTRSEPDDLALVRSLFETVGEVVDVPESQLDALGTISGSGPAYVFFLVEALTAAALEKGFTPEQARTLVNGTFLGAADLLVASGEDPADLRRRVTSPGGTTERAIGVLAAADLPALFARATDAALARSRELAAT

SEQ ID NO: 7712 - protein, 105 aa, Zea mays
  misc_feature (21)..(21): Xaa can be any naturally occurring amino acid
  misc_feature (34)..(34): Xaa can be any naturally occurring amino acid
  misc_feature (52)..(52): Xaa can be any naturally occurring amino acid
  misc_feature (66)..(66): Xaa can be any naturally occurring amino acid
  misc_feature (86)..(86): Xaa can be any naturally occurring amino acid
  misc_feature (101)..(101): Xaa can be any naturally occurring amino acid
  misc_feature (103)..(103): Xaa can be any naturally occurring amino acid
  unsure (1)..(105): unsure at all Xaa locations
APRPRRGRTRGRIAWAGARQXMRGVILFEETLYXEEQDGNPFVDVLKEGGVXPGIKGGGGGIFFVXSDKETTTEGLDVLGVRVCLXYEVGGGFVMWGGGLXIXPN

SEQ ID NO: 7713 - protein, 282 aa, Campylobacter lari RM2100
MQELINDIQKAVIEISQELRYLKDFDYTSSQNATGDNQLKLDVKSDEIITRILGQNKNIKSLISEEKQEQLLINENEKYIVAYDPLDGSSLVDVNFAIGSIFAIYENEAKAKNLKAAIYAIYGVRLELVVCFEKPMLYRLNENDEFVFVKELKLNEKGKLNACGGTQKNWSSTHGAFIKALFDEGYRLRYSGAMVSDLHQILLKGGGLFSYPATSDAPNGKLRAYFEVFPFAFIFEKANGLSTNGENDSLLDLEFEKIHASTPCFLGSKYEIEKLKQAYKGL

SEQ ID NO: 7714 - protein, 404 aa, Bacteroides fragilis NCTC 9343
MEPIRLNTIEEAIADFKEGNFVIVVDDEDRENEGDFIIAAEKITPEKVNFMLTHGRGVLCAPITEERCAELELDMQVSSNTSIYETPFTVTVDLLEGCTTGVSMHDRAMTIRALADPKTKPADLGRPGHINPLRARSRGVLRRAGHTEASVDLAKLAGLYPAAALIEIINEDGTMARLPQLVEVARRFGLKIISIKDLIAYRLQMESIVDRGVEVDMPTQFGHFRLIPFRQKSNGMEHIALIKGTWDTDEPILVRVHSSCMTGDIFGSCRCECGEQLHKAMEMIEAAGKGVIVYMNQEGRGIGLMNKIAAYKLQEEGYDTVDANLHLGFDADERDYGVGAQILREIGVKKMKLMTNNPVKRIGLEAYGLEITENVGIEIKPNPYNERYLKTKKDRMGHTLHFNK

SEQ ID NO: 7715 - protein, 283 aa, Mycobacterium sp. MCS
MTSTRGEAAGIPSVSLNDGHSIPVLGLGVGELSEAEAERSVAAALEAGYRLIDTAAVYGNEAAVGRAVNASGIPREEIYVTTKLAVADQGFGTSQDAARASLERLGLDYVDLYLIHWPAGDHGKYIDSWGGLMKAKQDGVARSIGVCNFNAEHLSNIIDLSFFTPAINQIELHPLLNQAELREVNAGYGIVTEAYGPLGVGRLLDHAAVTGVAQAHGKTPAQVLLRWSIQLGNVVIARSANPDRITSNLEVFDFELTDDEMATLNGLDEGTRFRPDPETYTGP

SEQ ID NO: 7716 - protein, 397 aa, Bacteroides fragilis NCTC 9343
MNQLSDRLNSLSPSATLAMSQKSAELKAQGVDVINLSVGEPDFNTPDHIKEAAKKAVDDNFSRYSPVPGYPALRNAIVEKLKKENGLEYTAAQISCANGAKQSVCNTIMVLVNPGDEVIVPAPYWVSYPEMVKLAEGTPVIVTAGIEQDFKITPAQLEAAITPKTKALILCSPSNPTGSVYSKEELAGLAAVLAKYPQVIVVADEIYEHINYIGKHQSIAQFPEMKDRTVIVNGVSKAYAMTGWRIGFIAGPEWIVKACNKLQGQYTSGPCSVSQKAAEAAYTGSQAPVEEMRQAFERRRDLIVKLAKEVPGFEVNVPEGAFYLFPKCSSFFGKSAGDRKIENSDDLAMYLLEDAHVACVGGTSFGAPECIRMSYATSDENIVEAIRRIKEALAKLK

SEQ ID NO: 7717 - protein, 572 aa, Burkholderia sp. 383
MPHDVSLIALLAAGFGLAMVFGYFASLLKMPPLVGYLLAGIVIGPGTPGFVGDLSLAQQLAEVGVMLLMFGVGLHFSLGDLLAVRKIALPGAIVQITVATLLGGGLALTWGWSVGAALVFGLALSVASTVVLLRALEGRGLVETVNGRIAVGWLVVEDLVMVLVLVLLPPVAGLLGGTPPGDAHAAGGSVWGTLGVTMLKVAAFIALMLVVGKRVFPRILWLVARTGSRELFTLCMIAAAVGIAFGAAKLFDVSFALGAFFAGMMMRESEFSRRAADETLPLRDAFSVLFFISVGMLFDPKILLAEPLHVIEVAAIVVIGKTLAAVALVIAFRYPLNTALTVGAGLAQIGEFSFILAGLGRALGLLSAEGQSLILAVALISIAMNTLLFAMIDPALAWIRKHSAFARKLEARDDPLAALPMSTPQTHLTGQVVIVGYGKVGTRIAHALDERGIAYVVVEQNRELVEKLREDGIAAVSGDAIEPIVLVQAHIARAGMLVVTLPDVFDVRQIVEISRTLNPALEVVLCTNSGDEAALLSNEGIGTVFMGETELARGMTEHVLGRMTKPVAAAAH

SEQ ID NO: 7718 - protein, 186 aa, Triticum aestivum
  misc_feature (85)..(85): Xaa can be any naturally occurring amino acid
  misc_feature (115)..(115): Xaa can be any naturally occurring amino acid
  misc_feature (138)..(138): Xaa can be any naturally occurring amino acid
  misc_feature (170)..(170): Xaa can be any naturally occurring amino acid
  unsure (1)..(186): unsure at all Xaa locations
MAPAVMASSATTVAPFQGLKSTAGLPVSRRSSGSLGRVSNGGRIRCMQVWPIEGIKKFETLSYLPPLSTEALLKQVDYLIRSKWXVPCLEFSKVGFRLPLSTTALPGYYDGRYWXTMWKLPMFGCTDATQVLNEVEEXKKDTLILFRVIGFDNLRQVQCVSFIAFRPQVXRSPGKAKLQVETMAYV

SEQ ID NO: 7719 - protein, 813 aa, Coccidioides immitis RS
MASSDASPDCPAIAGNVPQTSSQPMAEHTGGDLLGDETDIKTSANTETTNGHSPASLAEGKQKPEGPGTTESQNETSNLDDGQEDCPGSPDPQQEEPANGTSLGQKRSRSGSIKHSSSSPPPVELPVGPRETPLDKVLLEQYLHREWLHSTLAAGRTRHQDILQEKRAERDFYLQIQHERQMNPGAIFGMGYEGFGNARTDLKSQHPQLLYPSNRRKPGGRKSRDTRISRQEMDKQADQPENLVPIRLDIDWDKVKIRDTFTWNLHDRVTPPDVFAEKLVEDFGLPLESCGPLVRQITQSIQDQLTEYHPHIFIEEEPLDPHLPYFAYKNDEMRILIKLNITIGQHTLVDQFEWDINDPYNSPELFAVQMATDLALPGEFATAIAHSIREQAQLFTRSLYIVSHPFDGRPIEDPVLKGAFQASPLQSTFRSIQQAKEFTPVLWELNEAGLERTEGSISREQRLQKRSVNRRGGPALPDLKDRLRTIRTMIVSSVIPGSAASVEESRLFKRSGTGRSRRATTGQRDGLEDSDESDSDESSGASPAMSHLTQGTARTRGMRTASAIAQSAMRSHLGRSATPETSSLHETRTSARRRDYREESSEAPEKLIVRLRISSHKLRQLMKDLKTRQKGYPGSPAPAGATTPVRNAFPTPRGSMGPPAAQPATTPKRPTPSQLNGVVDAPHPPQPGVPGPPPPPWLVRGLNNLKRSYPRDSFEGTMRYTAVDPQTSLPIPNAATTHPGQKLIYKYFPRIRCHDCPGKLYTPGPALTVDNFEVHLKNRQHKERVEERHARLAKQAGIAGGSAAEIKGELVSR

SEQ ID NO: 7720 - protein, 459 aa, Zea mays
  misc_feature (102)..(102): Xaa can be any naturally occurring amino acid
  misc_feature (118)..(118): Xaa can be any naturally occurring amino acid
  misc_feature (413)..(413): Xaa can be any naturally occurring amino acid
  misc_feature (451)..(451): Xaa can be any naturally occurring amino acid
  unsure (1)..(459): unsure at all Xaa locations
MVAGAGNPGRPVAVLALLLLAAAAPPGAWAGSAAVNGDRLRAEQIRKQASDAAASAAALAAASRRLHLDRARHLRLLSSLHRNLTNTLRALSVAADFASDPXLRQRISIPKPLHCLAXRLTAERIARPDQYADPVPPPPALEDPALFHYAIFSDNVLAASCVVRSAVANSNDPSKHVFHVVTDRMNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYAQYMNFSHPLIKAKFNPNACGWAYGMNFFDLDSWRREKCTEQYHYWQNQNENRTLWKLGTLPPGLITFYSTTKPLEKSWHVLGLGYNPSISMEEIXNAAVVHFNGNMKPWLDIGMNQFRHLWTKYVDYDDSYIXRQCNFAPP

SEQ ID NO: 7721 - protein, 400 aa, Geobacter metallireducens GS-15
MTVARIEEAIEDIKQGKMIILVDDEDRENEGDLTMAAEMITPEAINYMAKYGRGLICLTMTSERCDYLRLPLMVSDNTSSFGTAFTVSIEAKRGVTTGISAADRAHTVLTAVADATKPEDLARPGHIFPLRARNGGVLVRAGQTEGSVDLARLAGLKPAGVICEIMNDDGTMARMPQLKKFAKEHGIKICTIADLVAYRLKHESLVRRAADVELPTEAGEFRAIAFENDVDKLEHLALVKGEISGDEPILVRVHSECMTGDVFGSLRCDCGGQLHRAMEMIEAEGKGAILYMRQEGRGIGLFNKLKAYALQDQGKDTVEANLELGFKPDMRDYGIGAQILVDLGIKNIRLMTNNPRKLIGLQGYGINIVERVPIEIPATGSNAGYLKTKREKLGHLLENI

SEQ ID NO: 7722 - protein, 168 aa, Triticum aestivum
MAPTVMASSATSVAPFQGLMSTAGLPVSRRSNGASLGSVSNGGRIRCMQVWPIEGIKKFETLSYLPPFSTEALLKQVDYLIRSKWVPCLEFSKVGFIFREHNASPGYYDGRYWTMWKLVMFGCTDATQVINEVEEVKKEYPDAYVRIIGFDNMRQVQCVSFIAFKPPG

SEQ ID NO: 7723 - protein, 321 aa, Oryza sativa
MATIPEVPASELIQTMPRVGMGTAAFPFTSSEDTTAAMLRAIELGYRHFDTARIYATEGCVGEAVAEAVRRGLIASRADVFVTSKIWCSDLHAGRVVPAARETLRNLGMDYVDLLLVHWPVSLTPGNYDFPFPKEVILPSFDMEGVWRGMEECHRLGLARAIGVSNFSAKKLEQLLSLAAVRPAVNQVEVNPMWQQRTLREVCRREGVQLCGYSPLGAKGTPWGSAAVMDSGVLQEIAGAKGKTLAQICLRWLYEQGDVLLVKTYNEKRMKENLDIFNWELTDEERERISQLPQLRGLPGLEFISDHGPYKSVEDLWDGDV

SEQ ID NO: 7724 - protein, 338 aa, Yarrowia lipolytica CLIB122
MAIKVGINGFGRIGRIVLRNALKNPEVEVVAVNDPFIDTEYAAYMFKYDSTHGRFKGKVEAKDGGLIIDGKHIQVFGERDPSNIPWGKAGADYVVESTGVFTGKEAASAHLKGGAKKVIISAPSGDAPMFVVGVNLDAYKPDMTVISNASCTTNCLAPLAKVVNDKYGIIEGLMTTVHSITATQKTVDGPSHKDWRGGRTASGNIIPSSTGAAKAVGKVIPELNGKLTGMSLRVPTVDVSVVDLTVRIKNGASYEDIKATMKAASESPELKGILGYTDEDVVSTDFIGDTHSSIFDAKAGIGLNDNFVKLISWYDNEYGYSARVVDLIVAVAKKDASA

SEQ ID NO: 7725 - protein, 182 aa, Arabidopsis thaliana
  misc_feature (52)..(52): Xaa can be any naturally occurring amino acid
  misc_feature (123)..(123): Xaa can be any naturally occurring amino acid
  misc_feature (131)..(131): Xaa can be any naturally occurring amino acid
  misc_feature (152)..(152): Xaa can be any naturally occurring amino acid
  unsure (1)..(182): unsure at all Xaa locations
QWLSSMLSSATMVASPAHATMAAPFNGLKSSAAFPVTRKAINDITSITSNGXRDNCMQVWPPIVKNKIETLSYLPDLTDSKLAKEDDYLIRNKGIPCVAFQLEHRFENREPRNSPLYYDGPDXHMRKLPLXGCPHSDSPLNHEQNGNKEYPXAFIRIIEFHIHPSKSQGIGFLVYKPQDSPA

SEQ ID NO: 7726 - protein, 379 aa, Aspergillus nidulans FGSC A4
MASTVGKTITCKAAIAWAAGEPLSIEDVEVAPPKAHEVRIQVLHTGVCHTDAYTLSGKDPEGAFPVILGHEGAGIVESVGEGVTSVKPGDHVIALYTPECRECKFCKSGKTNLCGKIRATQGKGVMPDGTSRFKARGKDLLHFMGTSTFSQYTVVADISVVAVTDKIPTDRSCLLGCGITTGYGAAVVTAKVEEGSNIAVFGAGCVGLSVMQGAVKNKAGKIIAVDVNDAKEEWSRKFGATDFVNPTKLNGQTIQEKLIEMTDGGCDYTFDCTGNVGVMRAALEACHKGWGESIVIGVAAAGQEISTRPFQLVTGRVWRGCAFGGIKGRTQLPGLVDDYLDGKLKVDEFITHREPLANINTAFEQMKAGDCIRCVVDLS

SEQ ID NO: 7727 - protein, 399 aa, Ehrlichia ruminantium str. Welgevonden
MSFLSKRMECIKPSPTLEIASQAQKLKMLGRDIISLSAGEPDFDTPEHIKQAAINALNLGKTKYTAVDGIIELKKAIISRLKQDHNLIYDVSQISVGNGAKQCIYNLFMSTLNDGDEVIIPAPYWVSYPDIVKIAGGNPVIIDCSSTSKLSAELLENAITDKTKWLILNSPNNPSGLVYTYDELKDIAQVLLKYSNVHIMTDDIYSKIVYDDLKFFTIAQVEEDLYSRVFLVNGVSKAYAMTGWRIGYIAGASEVIKAISVIQSQSTTNPNSIAQFAAVEALTGDQKFLEERNKVFIERRDIMLDMINNTPLLSAEKPQGAFYVFISCKELIGRTTKSGFCITSAMDFTKYLLEDYNIAVVPGEAFGVQGFFRVSYATSTQCVSEACDRILTACNELIY

SEQ ID NO: 7728 - protein, 535 aa, Streptococcus agalactiae NEM316
MKKHWWHKATIYQIYPRSFMDSDGDGVGDIKGITSKLDYLEKLGITAIWLSPVYQSPMDDNGYDISDYQAIADIFGDMNDMDQLLQEANQRGIKIIMDLVVNHTSDEHAWFVEARENPNSPERDFYIWRDEPNDLTSIFSGSAWEYDKVSGQYYLHLFSKRQPDLNWENEALRHKIYDMMNFWIDKGIGGFRMDVIDLIGKIPDKGITGNGPKLHDYLKEMNRASFGKHDLLTVGETWGATPDIAKQYSNPDNEELSMVFQFEHVGLQHKPDAPKWDYSDGLDVPALKDIFTKWQTQLELGQGWNSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQEHQAGFTKGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 7729 - protein, 403 aa, Oryza sativa (japonica cultivar-group)
MGKNGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTYFWEQEEFDIISHQTRISLHFQAGKKQMLRHAFTYHWRLWSIPEIKDCLEEAGFKSIHVWIREMPNTQSSGNAKEYNANRDVKYEELQHFNQADAWNAYVVGVANI

SEQ ID NO: 7730 - protein, 1261 aa, Oryza sativa
MPHTTSKPGIMVGVRCSCIDSNSESSVQTFDAMTRIAVTTHHMPCANCNSQTEANLPMGNHRLLLLLLLLLAVVGSDHGGVLAADEFTYNGFGGANLTLDGMAAVAPNGLLVLSNGTNQMAGHAFHPTPIRLRGGAAGGAVQSFSAAFVFAIVSNFTVLSDNGMAFVVAPSTRLSTFNAGQYLGILNVTDNGNADNNIFAVELDTMLNPEFQDMNSNHIGVDINSMKSVQNHSAGYYDEATGAFNNLSLISRQPMQVWVDYDGATTVLNVTMAPLDVPKPSKPLISAPVNLSSVVTDTAYVGFSAATGVIYTRHYVLGWSFSQNGAAPSLHTSSLPALPRFGPKPRSKVLEIVLPIATAAFVLALVIAAFLFVRRRVRYAEVREDWEVEFGPHRFSYKELYQATKGFKNKQLLGTGGFGRVYKGVLAKSNLEIAVKRVSHDSKQGMKEFIAEVVSIGHLRHRNLVQLLGYCRRKGELLLVYDYMSNGSLDKYLYDKTKPVLDWGQRFQIIKGVASGLLYLHEDWEQVVIHRDIKASNVLLDGEMNGRLGDFGLARLYDHGVDPQTTHVVGTMGYLAPELVRTGKATPVTDVFAFGVFVLEVTCGRRPLGCIAPDDQNVLLDWVQEHERRHAALDTVDARLCGKYDADEARLALKLGLMCAHPLPDARPTMRQVTQYLDGDAPMPEVAPTMVSYAMLALMQNDGFDSFAMSFPSTVTSTASPMSADVSAVSGLSGGRIALVTGGNKGVGLETCRQLASRGLRVVLTARNEARGLEAVDGIRRSGAADSDVVFHQLDVTDAASVARLADFVRDQFGRLDILINNAGISGVDRDPVLVAKVKDQIEGMDVDQRVEWMRENSKETYDEAKSCITTNYYGAKLVTEALLPLLLLSSSGRIVNVSSGFGLLRNFNSEDLRKEFDDIDSLTEKRLEELLDLFLDDFKVNLIEAHGWPTGGSSAYKVAKAALNAYTRILAKKYPTLRINCLTPGYVKTDISMHMGVLTPEEGASNSVKNRNRGTTSSAIALPGTLRSRVAVVTGGNKGIGLEVCRQLAADGITVVLTARDETRGVEAAEKLRGMGLSCVIFHHLEVTDSSSVSRLADFLTTRFGKLEILVNNAAVSGMEHAQRVDTNEEQWLVNNEDLRKELDDVDNLTEERLDEVLDSFLKDFEAGALEAHGWPTAPFVAYKMAKVAMNAYTRILARRHPELRVNCVHPGYVKTDMTINSGFLTPEEGGRNVVTVALLPDGGPTGAYFDEGREASFLE

SEQ ID NO: 7731 - protein, 153 aa, Retama raetam
KQTTGIVGLDVVPNAREVLIGLYSKTLNEIKAVPEDEGYRKAVESFTSHRLKVCQEEQDWEDIEKKLGCGQVEELIEEAQDELKLISLMNEWKPWGVPDDYECEVIENDAPVPKHVPLHRPPPLPTEFHKTLETLQSQSGKDTPAVSSGESKA

SEQ ID NO: 7732 - protein, 528 aa, Wolinella succinogenes
MAKHKIVVCDHIHQKGLDLLAKEADIELLNASSVPKSELLPLLQDADIAITRSSTDVDSAFLEATKKIRAVVRAGVGVDNVDIDGCSRKGIVVMNVPTANTIAAVELTLAHMLSACRNFPGANDQLKNARLWKREDWYGTELKDKKLGVIGFGNIGSRVALRAKAFEMNVIAYDPYIKPSKATDLGIAYTSNFDDILACDMITIHTPKNKETINLIGKEEIAKMKDGVILINCARGNLYNEEALYEGLQSGKIRWAGLDVFNKEPATNNPLLDLPNVYVTPHIGANTLESQEKIAIQAAEAAIEAARGSNYPNALNLPIKESELPLFVKPYLELVQKMGFFATQANKAPIHSFKIIAEGEISQYIDSLSTFGLVGALNASLGDKVNYVNAPYVATERGIELKSESKSAQGGYKNKITVKLTTEKDIMTLSGTVFDENVQRIVEINGFGLDIEPKGRMILFKNTDVPGVIGMIGTTLAKHQINIADFRLGRNNHNQALAVIIVDDDVKKEVIEELRAIKACLGIENVVL

SEQ ID NO: 7733 - protein, 441 aa, Lactobacillus acidophilus NCFM
MGKENNELKRSLGFGSAISIVIGTIIGSGIFFKQASILDSAGSSSMAISAWIFGGVITLAAGLTIAEIGAQMPYTGGLYVYVENLYGRICGFLAGWMQVIVYGPAIIASVAGFMSIMITNLFGIDAKWRIPIALIIIIAIGLMNFLENKVAAAFSVITTIGKMIPIAAIIIFGLFWGHQDALGQTVSEINRSAGGFGVAVLATLFGYDGWILIANLGGEMKNPQKLLPKAIILGISTVLVIYTLITVGIFRFVPANMIHSLGENTTSYLATRAFGDIGGKLLSIGIIVSMMGTLNGKIITFPRIVYAMARRGDLPFSRILSYVTPKGKSPVVATIFIILLATIMMLFFDPDHLSDLCVFTIYCFYLLTFFGIFILRKKNSKRPFSTPLYPFVPIVAIAGGIFVLVSELFNDPAGVLLFAGIVIIGLPVLYVVKKMDKKRLK

SEQ ID NO: 7734 - protein, 358 aa, Solibacter usitatus Ellin6076
MNRHHYGLILAGGRGTRFWPRSRKRTAKQVLNVVGERSLIQATVDRLAPVIPPERIWILTNDHLRDIIIKQLPDVPARQILAEPMQRNTAPAIGLAAQILHQQDPEAVMGVFPSDHVIGKNPQYRAVIKSALKAAGQGHLMVVGIQPRWPETGYGYIEFPKSTAAGAGEALAVKRFHEKPVLAKAKRYVAAGNFYWNSGMFFWRTGVLLEQLRLHLPRTATVLASLPRFGGRRFAEQLKTAFPLCDNISIDYAVLEKAKGVHGIAAGDFGWNDVGSWNAVYELLERDQHGNAIALESIALDSHNNFVDARGKVVALVGVSDLIVVDTPDALLVASRDRAQQVGDIVKALEQRNRHDLL

SEQ ID NO: 7735 - protein, 472 aa, Pasteurella multocida subsp. multocida str. Pm70
MSDTTAIANVFKLIEEYDIKFVLLRFTDIKGKEHGVSLPVNLVDEDLFEDGKMFDGSSVEGWKAINKADMLLMPMPETAVVDPFAQIPTLSLRCSIYEPSTMQSYDRDPRSIAIRAENYMRSTGIADEALFGPEPEFFLFDDVRFDVSMNRSSYSVDDIEAAWNTNKKYEDGNNAYRPLKKGGYCAVAPIDSAHDIRSEMCLILEEMGLVIEAHHHEVATAGQNEIATRFNTLTTKADETQIYKYVVQNVAYEHGKTACFMPKPITGDNGSGMHCNMSLSKDGKNVFQGDKYAGLSETALYYIGGIIKHAKALNAFTNPSTNSYKRLVPGFEAPVLLAYSASNRSASIRIPAVTNPKAIRIEARFPDPLANPYLAFAALLMAGLDGIINKIHPGDAMDKNLYDLPPEELQNIPAVASSLEEALNALEQDYEFLTKGNVFTQAFIDAFITIKRKEVERLNMTPHPVEFEMYYA

SEQ ID NO: 7736 - protein, 452 aa, Propionibacterium acnes KPA171202
MTEPDQQLHRSLRNRHIQLIALGGAIGTGLFYGAADSIAAAGPAVIVSYLIGGVVIYLIMRALGEMSVHNPTSGAFSEYAHQWWGDLPGFISGWNYWFNYIFVSMAELSVVGIYINYWFPVVPRWVSAAVLLAIVTTVNLLHVRAYGEVEFWFAIIKVVAIIAMIVLGLWIIFFGTGSTPATGIGNLWRNGGFLPHGVTGMLAGIIVVMFSFGGTELIGITAGEAEDPQRSIPRAINRVVGRILLFYVGALIVMVAIVPWTKIDGNASPFVQIFDLVGIPGAAAILNLVVLTAAISAYNSGLYANGRMLHALAHQGDAPAFLGKVNKAGSPWAGVLLSSAVTAIAVVVVGLLPEQAFVYIMSIAMIAAIINWATIIITQMLFRRRLDPESRSELRFTMPGAPVTNWIVLAFLVLMVVVMTTMPPYRIAVAIGPIWLAVLGLGWRVSRRRQTL

SEQ ID NO: 7737 - protein, 319 aa, Yersinia pestis biovar Medievalis str. 91001
MKDIRVPLRLVSILSDGFFHSGEQLGETLGMSRAAINKHMQTIRDWGLDVFTVPGKGYSLPTSIQLLDEQKILSYLPTGHVTVLPVVDSTNQYLLDRITELKSGDACVAEYQQAGRGRRGRQWVSPFGANLYLSMYWRLEQGPAAAMGLSLVVGIVMAEVLQNLGAEKVRVKWPNDLYLNDKKLAGILVELTGKTGDAAQLVIGAGINLTMRGSETNAINQDWINLQDAGVTIDRNKLTAEILSELRLAVVKFENEGLSAFLSRWQKMDNYLNRPVKLIIGNQEIFGIARGIDQQGALLLEQDGNIKPYIGGEISLRGV

SEQ ID NO: 7738 - protein, 472 aa, Chromobacterium violaceum ATCC 12472
MAVADVVKLIQENDVKFVDLRFTDTRGKEQHVSIPAHVLLEDADAWFERGHAFDGSSIAGWKGIQASDMLLIADPATARIDPFFDEPTVFMHCDVIDPADGKGYDRDPRSIAKRAEAYLKASGHGDTAYFGPEPEFFIFDGVTWGTDMSGCFVKIKAEEAAWASAEEFEGGNMGHRPGIKGGYFPVPPVDSSQDIRSAMVLLLEELGVPVEVHHHEVATAGQNEIGTKFSTLTQRADWTQILKYVVHNVAHSYGKTATFMPKPIVGDNGSGMHVHQSIWKDGKNLFAGEGYAGLSDTALYYIGGIIKHAKALNAITNPGTNSYKRLVPHYEAPVKLAYSAKNRSASIRIPHVASPKARRIEARFPDPLANPYLCFSALLMAGLDGIQNKIHPGDAADKNLYDLPPEEDKLIPTVCASLDEALAALDKDREFLTRGGVFSNEWIDAYIELKMQEVNLTRMTTHPVEFAMYYSL

SEQ ID NO: 7739 - protein, 342 aa, Aquifex aeolicus VF5
MAIKVGINGFGRIGRSFFRASWGREEIEIVAINDLTDAKHLAHLLKYDSVHGIFKGSVEAKDDSIVVDGKEIKVFAQKDPSQIPWGDLGVDVVIEATGVFRDRENASKHLQGGAKKVIITAPAKNPDITVVLGVNEEKYNPKEHNIISNASCTTNCLAPCVKVLNEAFGVEKGYMVTVHAYTNDQRLLDLPHKDFRRARAAAINIVPTTTGAAKAIGEVIPELKGKLDGTARRVPVPDGSLIDLTVVVNKAPSSVEEVNEKFREAAQKYRESGKVYLKEILQYCEDPIVSTDIVGNPHSAIFDAPLTQVIDNLVHIAAWYDNEWGYSCRLRDLVIYLAERGL

SEQ ID NO: 7740 - protein, 199 aa, Brassica napus
PNPTCTVSKSCGFNMTYGGSTITASLTQDTLTLTNDAIPGYTFGCINKATGTSLPAQGLMGLGRGPLSLISQTQNLYKSTFSYCLPNSKSSSFSGTLRLGPKFQPVRIKTTPLLKNPRRSSLYYVNMVGIRVGNKIVDIPPSALAFNPATGAGTIFDSGTVYTRLVEPAYVAVRNEFRRRVKNANATSLGGLDTCYSGS

SEQ ID NO: 7741 - protein, 230 aa, Prochlorococcus marinus str. MIT 9211
MTCAQARDFISAYLPLIKNVPKGRELVLAPPFTAISTLSEILKGSNVSLSSQNVHWEDNGAFTAEISPKMLLEHSVSYAIVGHSEPRKYFSESDKQINLRAKSAQANGLIPIVCVGETIEQRERGEAERVIRRQVEQGLEETDKKKLIVAYEPIWAIGTGKTCEANEANRICGLIRQWANCPEILIQYGGSVKPGNIDEIMAMSDIDGVLVGGASLDPESFARISNYKVE

SEQ ID NO: 7742 - protein, 344 aa, Cryptococcus neoformans var. neoformans JEC21
MTVTVAPRRKILGIGYPRFAIPEWKELAEKYDIHYFIPDERKQVMREIKRLCDEQGPFDAAYVLFGTAAYSPFHPDLLGPLFEKPGYCGLFAQGGAGYDDVDYPWLAANGCYLSNTPNAVTEATADMGILLVLAAVRGLYEAEVSVRAGQWRKGIELTDDPTEMTIGFIGLGAIGKSMAKKTKPWNMKILYHNRKPLPKEEEETLGATFVSLDELLAQSDVISLNCPLTPETRGILSDKEFEKMKDGVYIVNTARGAVIDEPALIRALKSGKVRRAGLDVLTNEPCADSPLYSMKNVTLQPHLGAFTKGTMLRGEREVFANVKQYMEIGLPVNPVNTPAKVEKK

SEQ ID NO: 7743 - protein, 284 aa, Triticum aestivum
  misc_feature (168)..(168): Xaa can be any naturally occurring amino acid
  unsure (1)..(284): unsure at all Xaa locations
MKTVSLGAPRSSTVKFRMPTRDNLVPIRVDIEVDGQRYRDAFTWNPRDTVPPFLMFWSFRQVHRFLMFRPFLRRADPDSEVITFAKRTAKELKLPATFVPQILQSIQGQLAEFRSYEGQEMQVKEKIMPLKIDLRVTNTTIRDQFLWDIGNLESDPEEFARTLCDDLXLPIPEVPTRPAVCIREQLYEIASQTVSAMREAKMSKKRRAPEFASNSKAMNNAVDMFKYFGSKGSVIRKRKEWYLYEPVVDVVPNMEAFFCHQNQHAISKQLSNNSAPMMKMGARL

SEQ ID NO: 7744 - protein, 355 aa, Prochlorococcus marinus str. NATL2A
MALSYYAEELKKTASAIAQPGKGILAVDESTKTVGKRLASIGVENSEENRKAYRGMLFTTEGLGNFISGAILFEETLFQNHPDGEPMVKKLEKLGIIPGIKVDKGLRPLAGGHDVETFCSGLDGLVERAADYYEQGARFAKWRAVLQITDDGCPSKLSIRENAWGLARYARSVQESGLVPIIEPEILMDGSHSIEKTAAVQEEVIKEVYLACQVNGVLLEGTLLKPSMTVQGADSSTKADPQQVAEMTIRTMERCVPASVPGITFLSGGLSEEAASVYLNLMNKIDRKAKWNVSFSYGRALQHSCLKAWKGSNTADGQKALIARAQANSEASKGLYVAGSQPSSDEQLFVAGYKY

SEQ ID NO: 7745 - protein, 479 aa, Shewanella sp. MR-7
MFRRTKIVTTLGPATDRDDNLRRIIAAGANVVRLNFSHGSPEDHLKRATQAREIAKELGVHVAILGDLQGPKIRVSTFKDNKKVQLNLGQAYILDAELGKGEGDENQVGIDYKQLPDDVKIGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASEEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCTGAESHPSVKVSKHRLDARFTSVEETIALSTMYAANHLEGVKAIIALTESGATPKLMSRISSSLPILGLSRHETTLAKMALYRGVLPIYFDSTIYPADELAQKALESLTTAGYLQSGDLVLMTKGDAMETIGGTNTCKVLIVA

SEQ ID NO: 7746 - protein, 355 aa, Zea mays
MSAYCGKYADELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 7747 - protein, 459 aa, Nostoc sp. PCC 7120
MLTQLPNPISVPSWWQLINWIADPIGFQKKYSKKYGNIFSMQLAGIGSFVILGEPQALQEIFTQDSRFDVGRGNTLAEPLIGRTSLMLMDGDRHRRERKLLMPPFHGERLQAYAQQICLITNQIASEWQIGQPFVARSAMQKLSLEVIIQIVFGLADGERYQQIKPLFTDWLNMTDSPLRSSMLFLKSLQKDWGTWTPWGQMKHKQRSIYDLLQAEIEEKRTKENEQRGDVLSLMMAARDENGQAMTDEELKDELLTILFAGHETTATTIAWAFYQILKNVNVQEKLQQELDRLGANPNPMEIAQLPYLTAVSQETLRMYPVLPTLFPRITKSSINIAGYQLEPDTTLMASIYLIHYREDLYPNPQQFRPERFIERQYSPSEYIPFGGGSRRCLGYALALLEIKLVIATVLSNYQLALAEDKPVNVQRRGFTLAPDGGVRVIMTGKKSLKFEQSSKIFN

SEQ ID NO: 7748 - protein, 526 aa, Burkholderia sp. 383
MTRTLHPVPAPDLPRILPVILAGGSGTRLWPLSREQYPKQLIELTSNESPLSATARRLNGIANAVLGDKLLLVCGEQHRIMSAAQVVDRAAPARILLEPAARNTAPALTLAALDASELEDDPVLAVMPADHVIADVGAFQDTIARAARYAQEGAIVTLGVLPRRAETGYGYIRVGEPRTSRHGGQGGYSIGRFVEKPDAALAERYLQSGDYWWNSGIFVTRASVWLKAIRALAPEIHAACESAWRAGVADDPFFRIDAAAFDACPSDSIDYAVMERLADSSELGIEGIVVPLSAGWSDVGTWDAIWEIMPKDDHGNVARGPIVFEDTQDSLVRSEGRLIACVGMKDVVVIETPDAVLVANKHDVQRVKNIVERLKSDRRPQASEHRKVQRPWGHYDSIDLGERFQVKRIVVEPGKRLSLQMHYHRAEHWIVVRGTAKVTRGNETFLLSENESTYIAVGEVHRLENPGRIPLEIIEVQSGNYLGEDDIVRFDDQYGRPVVDPLPEQHAVPLAAPEPHVQVVEGDVVR

SEQ ID NO: 7749 - protein, 347 aa, Propionibacterium acnes KPA171202
MTETMLAERFHAADRSITLEDIPIPHPGPGEVLVKVAYCGICHSDLSLISGAFPAALPVVTQGHEASGTIVELGAGVIGWKEGDRVIPSAGRPCLKCRKCRRGAFTDCLDLNLMAFAYDGAWAEYHIAQASGMTKIPDNVPLDQAALLADAVSTPYAAVVRTGKVHMGNAVAVWGVGGVGTHLVQLAKLAGGVPVIAIDLNDAVLERAKRVGADHTLRSDDPELMQKIEDITHGRMIDVAFDAVGIKPTLRACVDSLDVDGKAVSVGLSAQDIDAGPFLNFNLQRKQVLGHLGYKSQDIALLAEMLSYHRLDLTESISKVIPLKDVESGIAELESHQGNPIRILVKP

SEQ ID NO: 7750 - protein, 264 aa, Arabidopsis thaliana
  misc_feature (127)..(127): Xaa can be any naturally occurring amino acid
  unsure (1)..(264): unsure at all Xaa locations
MIVYFPSELTVWQKLEEENREFFKAYYLRLMVKHQIMEYDELLEQQINHMRQMHPTAGASVRDRNGSHVPPMNQQQLLYERKEPDQSSPNLSSPYLNGGSAINTNIPSYVDFSSHSRRVDPSPNSLXLQATNMPLMQGMIKSETAYQNCAPYMYGGEAQSTVGDVTIASFSNDSSNQSLNDPLVDPDAPTFGSLGQIPQNFSLSDLTADFSQSSDILESYEGSPFLLADAENFLDSSERVEHQGDHERLRTISSGFSYENFRSN

SEQ ID NO: 7751 - protein, 483 aa, Streptococcus thermophilus LMG 18311
MIVSTYYPKIFYCDKLVLLHLLEESMENHNYENEGQFQRKMTSRHLFMLSLGGVIGTGLFLSSGYTIAQAGPLGVILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAIFVFIILGLGAMFGLVSFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 7752 - protein, 98 aa, Solanum tuberosum
MARFFSNSKILSAFVSDSVSAFLSRRGYAAASQGAVSGVAKGGVPRSNVMMQKSGEESVKTSWVPDPVTGYYRPEGQANEIDAAELRKMLLKNRSGSN

SEQ ID NO: 7753 - protein, 275 aa, Erwinia carotovora subsp. atroseptica SCRI1043
MTQPKVKLADGNIMPQLGLGVWRASSEDTVIAVNEALSIGYRAIDTAAIYKNEEAVGQALSSANLPREEVFITTKLWNGDHTDPQKALEESLRKLRLDYIDLYLIHWPLPQQNTFVDAWRGLIKLQEQGLAKSIGVSNFHIHHLQRLKEETGVLPVIDQVELHPLLQQKQLHAWNATHHIQTESWSPLAQGGEGVFDHPIIRKLAMKYGKTPAQIVIRWHLDSGLVVIPKSVTPARIKENFEVFDFRLDKDELSEITKLDCGKRLGSDPDEPRND

SEQ ID NO: 7754 - protein, 310 aa, Streptomyces coelicolor A3(2)
MTGWSTGDIPDLDGRVAVVTGANGGLGYVIARELARKGATVVLACRSEERGSAAVRRLMGEVPAAAVEPARLDLGDLASVREFAYGLPYERVDLLVNNAGVMALPHGTTVDGFETQFGVNHLGHFALTGLLLPSLLAAPGARIVTVSSVLHALARVDPRDLNSVRRYGRWTAYARSKSANLLFTHELARRLAGREGASDVRAVAAHPGYAETGLHGAGPRAEGRRLAERLARLGSRVVAQSPEAGALPVLYAATAPGVPSDSFTGPSFAMWRGTPAPSWRASWTIDDAMGERLWAASERLTGVIYEALLP

SEQ ID NO: 7755 - protein, 839 aa, Yersinia pestis biovar Medievalis str. 91001
MLALVIVGARHCRLVVAIKLGKNVMTSPFSYTSPVVSVDALKHSIAYKLMFIIGKDPTIATQHDWLNATLFAVRDRMVERWLRSNRAQLSQDVRQVYYLSMEFLLGRTLSNALLSMGIYDEIEQALDEMGLSLSELLKEENDPGLGNGGLGRLAACFLDSLATLALPGRGYGIRYEYGMFSQKIVNGQQMESPDNWLEYGNAWEFPRHNTRYKVRFGGRIQQEGSKIRWLETEEILACAYDQIIPGFDTDATNTLRLWSAQASNEINLGKFNQGDYFAAVEDKNHSENVSRVLYPDDSTYSGRELRLRQEYFLVSATVQDILNRHWAMHHTFNNLADKIAIHLNDTHPVLSIPEMMRLLIDEHKFTWMDAWDVVQQVFSYTNHTLMSEALETWPVDMIGKILPRHLQIIFDINDHFLKLVEEQYPDDKELLSRVSVIDENNGRRIRMAWLAVIASHKVNGVSALHSELMVQSLFADFARIFPNRFCNKTNGVTPRRWLGLANRPLAAVLDDSIGQTWRTDLSQLSELEKNLDYPSFLLALQKAKLENKKRLAVYIAEKLNIVVNPAALFDVQIKRIHEYKRQLLNVLHVITRYNRIIDAPDNNWVPRVVIFAGKAASAYYNAKQIIHLINDVAKVINNDPRINNLLKVVFIPNYSVSLAQLIIPAADLSEQISLAGTEASGTSNMKFALNGALTIGTLDGANVEIREHVGEENIFIFGNTTEQVEALRKSGYNPRKYYDEDPELHQVLTQIATGTFSPEEPHRYTNLFDSLVNLGDHYQLLADYRSYVDTQEQVDALYRNRDEWSRKTLLNIANMGYFSSDRTIKEYADEIWHIKPIRL

SEQ ID NO: 7756 - protein, 176 aa, Fagus sylvatica
KLELHRGGGRSRTSGSPGLQEFGTRSELSKICDGILGLLETHLIPSASSAESKVFYLKMKGDYHRYLAEFKTGAERKEAAESTLLAYKSAQDIALADLPPTHPIRLGLALNFSVFYYEILNSPDRACNLAKQAFDEAISELDTLGEESYKDSTLIMQLLRDNLTLWTSDITDDAGD

SEQ ID NO: 7757 - protein, 309 aa, Yarrowia lipolytica CLIB122
MTSIDFTMNNGKTIPAIGLGTWKSTTEEVAGAVECALTEGGYRHIDTAFNYRNEDAVGLGIKRAMEKGVKREDIFVTTKIWVTYHDRVEENLNMSLERLGLDYVDMLLIHWPVPLNPNGNDPVYPLREDGSRDIDESGSQPKTWKQMEAVLKTGKTKSIGVSNFSIPYLEELLKEAEVVPAVNQVELHPLLPQLELMEFCKKNNIIMTAFSPFGSVGGPLLKNELVLKLADKYKTSPGGILTSYHIGNGTVVIPKSVTNSRIIENGKSAVTLSQEDLKALNDLHKTEGIHRTSKPKWGVDLGFPDFDFC

SEQ ID NO: 7758 - protein, 391 aa, Pediococcus pentosaceus ATCC 25745
MEFSKRANQVSPSATLAVSTEAKKMQAAGIDVVNLSTGEPDFATPKAIIKAAMESMESGKASYYTPVGGLPELRQAVATHIKTDTGYDAKMEQVAVTVGAKMGLFETFQALLNEGDEVMIVAPFWVSYEEQVKLAGGSVIAIHPQASDLKTTPSELSRFKTASTKLLILNTPQNPSGLVYSEEETRAIAQWAVDNNVILVADEIYGKLVYNGAKFSSVMSMGNEIVNNTILIDGVSKAYAMTGWRIGYVVAAPQIIRKILALQGHMTSNPTAVAQYAALEALRGDQYPVEEMRLAFEKRLNQTFDLMQVIPGFSFDYKPEGAFYLFPDVTEAMKIKGYATSTDLAMALLKEAHVAVVAGEAFGMPGHIRLSYATSQTLLSEAVRRIQNFMN

SEQ ID NO: 7759 - protein, 269 aa, Erythrobacter sp. NAP1
MSEINQLLIIGCGNMGGAMLAGWLAAGVDPSRFAILDPGMEAAPEGVTLYRDPAEAEAAGAHDAVMLGFKPQQLGNLAPGLQKLTGEGVTIYSLLAGLTLAQLKKAFPGAAAHVRVMPNLASRINKSPIILLEDGLDGSERDAAFALFDLLGTAVWLEEEGKFDLVTALAGSGPGFVYRFIDALAEAARNLGLEDEQATSLALAMVDGASSLAAGSDISPGELADRVASPGGMTREGMNVLDADKALVKLLTDTLIATRDRGAELSAGG

SEQ ID NO: 7760 - protein, 371 aa, Aspergillus oryzae
MVPDVAPQTANPNTGSSETERDNRPMMKALVYTGPNKLEVLDRPMPVIQSPTDAILKMLHSTICGTDLHILKGDVPAIPYDRVLGHEGVGTVVSVGPAIDGLSVGDNVVIAAITACKVCASCRKGLEAHCITGGWQLGNKVDGTQAEYVRIPHATSSLYKIPEGLDLRACAAISDALPTGLECGTISAHVQPGSTVAIIGAGPVGLAVMLTARLYTPSQIVMIDLDDTRLEHAKRLGADHAVNPGKLDAMETLNTFTEGQGFDCVIEAVGIPKTFEMCQKLVAPGGSIANVGVHGHPVNLDLHKLWDRNISIKMQLLNAVSIPTLLRLYQSGHIKPSNLFTHHYPFSEVHKAYHSFQMAAQEGALKVAIDF

SEQ ID NO: 7761 - protein, 240 aa, Zea mays
MVAQGFTVDLDKPLAFQVGHLGEAYDEWVHQPIVTKEGPRFFHSDFWEFLTLTVWWAVPVIWLPVVVWCISMSVSIGCSFPEIVSLVALGIFIWTFIEYCLHRFLFHMKTKSYWGNTAHYLIHGYHHKHPMDHLRLVFPPALTAIMCFPLWNLAKLIATPSTAPALFGGGLLGYVMYDLTHYYLHHANPTIPVTKSLKKSHLNHHFRIQDKGYGVTSSLWDIVFGTLPTTKALKRAQQKY

SEQ ID NO: 7762 - protein, 111 aa, Zea mays
MGTASTSPDTMEAARLPSLSITVEKNPPEARLLQLGVKSWPKWGCPPGRFPLKFDAALTCYLVKGRVRAAVKGSRECVEFGAGDLVVFPKGLSCTWDVVVGVDKHYNFDPS

SEQ ID NO: 7763 - protein, 455 aa, Sinorhizobium meliloti
MSIDADDPEVFQSWLEQNGPIESIQAVICDLNGIMRGKRVPVEQARKVLGGGIRMPLSIVGVDVWGEDIIGSAQVFATGDRDGICGVTGRGALPVNWTSRPSALVPLWLFVENGRPFLADPRQALAAIMREYRELGLRPVVATELEFYLIDPEPDSAVPPISPYTGKRLDSDAILSIDELDDFGEFFSDVYRECARQNVPADAAIAENGIGQFEINLLHSDDPLKAADDAIFFKRIVKGVARKHGLAATFMAKPYGTRSGNGMHVHFSLLDEEGNNVFDDGSDEGSAVLKHAVAGLLRGMAETTLMFAPHFNSYRRLRPDTHAPTSISWGYENRTSAIRIPGGNPAARRIEHRVAGADANPYLVIAAILGAALVGIRNKWKPPVPVEGRAYAAEKLPKIPADWGQAVDAFEAGPIAAEIFDPVLRSMLIACKRQEIAGFAEQVTDYEFSAYLEIV

SEQ ID NO: 7764 - protein, 492 aa, Aspergillus nidulans FGSC A4
MSLASLKRKDLFQQHGLIGDKWVSSSGGGTFTVTNPATLETLATLPEMNGADTESAITAAHTAFQSFRKTTARQRATWLRKWHALCVENIDDLALILTVENGKTLAEAKGEVLYAASFLEWFAGEAERVHGEVVPASNANQRILTVKQPLGVAACLAPWNFPIAMITRKVGAALAAGCTTVWKPAGETPLSALAQAVLAREAGFPSGTINVITTLNSVAEVGAALCNSKLVRKLSFTGSTRIGKLLASQCSQNLTKLSLELGGNSPFIVFDDAKVETAVEACILAKFRNSGQTCVTANRIFVQEGIYDRFSAALVEKVKALKVGNGVEEGVIIGPLTHERAVEKAVAHIKDAQEKGASLLLGGSPCQPNNLPGYFLEPTVLGKMSTEALTTREEVFAPVVALYPFKTEEEVLAKANDCDVGLGSYVITESMPRMWRVAESLEVGMVGINMGTLSAAESPFGGVKESGYGREGGRQGIEEYMTVKSILMNVAA

SEQ ID NO: 7765 - protein, 251 aa, Medicago truncatula
MLGIFKEKLVNAPKELNSPASNSHTKAKPSHEILRDFMSCNSSNAFYMTFGNDALLAYSPSNKPSIHQRLFSGLDNIYCAFMGNLHNLSQLNKQYGLSKGGNEAMFIIEAYRTLRDRGPYPADQVLKGLEGSFAFVIYDHKDGTVFAASGSDGHIGLYWGIAADGSVVISENLELVKASCAKSFAPFPTGCLFHSEHGLLNFEHPTKKMKAMPRIDSEGVMCGANFNVDSQSRNQMMPRVGSEANWATWGS

SEQ ID NO: 7766 - protein, 501 aa, Catharanthus roseus
MALASIEKVATGLICFILLIFSLKRIGHPRDWALVGILSVWFPSLGHIYEKLAKSLAKNDKTFVLKGSFLSKQDVIFTCDPANMHHVMSTNFSNYPKGPENRNVFDVYGEMLFTADHEKWKSHRKVTNAYFHDQRFNGFSQKVNKEVIEKELFPFLDHAAEEALVFDLQDVFQRLMLDSSSILTTGQNHRSLRVGLPYDETLEAINIANYQIFVRHILPAKIWKFQKWLGIMGEKKIKKAWRILDDISVEYMNRRKKEISSTISSQEDMDVVKFSEEDHVVLKSVDASDNLLRDTVKGILLAGTDTTATVLSWFFWLILKNPRVEQKIREEIELYLKQKNGEHGLYTNPEELNELMYLHAAIYETMRLYPAAPFTSRKSIQADVFPTGHQVNPNTTIVMAYYAVGRMKSIWGEDCLEFKPERWLSDKGKLIPVQTNKFLAFGTGPRICPGKELGLNRVKAVAAAIIPKYSFKIMRNKPVMPAACATLYLKDGLIVRVNKII

SEQ ID NO: 7767 - protein, 711 aa, Gibberella zeae PH-1
MAPRGFEDEELTISLSSSHVRRPQQTQPQSQSQQQDDSHDAPQAASRPADAPLKERIKTEQRIGAYKVLRTLGEGSFGKVKLAIHNGTGQQVALKIIARKKLISRDMAGRVEREIEYLQLLRHPHIIKLFTVIKTPNEIIMVLEYAGGELFDYIVQHGRMKEPEARRFFQQMLCAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIAKGTYSIPQWMPTGAANLIKKMLVVNPVHRATIEDIRADPWFTTELPVYLQLPVEEFFNTGVDPNKAIKKNDIAPNASEKVQERLHNEVTEKISKTMGYGKSDVEEALQAAEPSAIKDAYMIVRENKMMQVNHNSEALLAEPEGSSPMLSMSSARSTISQATTTPRPYVSKVGILPSSLPAYHKDYMEREKAGSVENSPPKVLINDEPQLNRTDAEKEETARRLRPHSRSQLRIDEANTRPQGMTPINPPKKTKPVRWQFGIRSRNSPWEALLCIHKALYKLGATYIPDEDYESRTAEERAEASGDSSFVDSHDGYRGSTSSIDPKKRYNLPADPWHINVRWDTSAIKKKAGNTPSAPSTPSSPSTPDGHHAKEPFVALHLDIQIYEMEHGVYLVDFKCSGYETAHGRLLEEKDVTSPFPFLDMAAKLIMQLAEAD

SEQ ID NO: 7768 - protein, 468 aa, Neisseria meningitidis
MSIKNVVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7769 - protein, 1150 aa, Ashbya gossypii ATCC 10895
MTSETNNNNAASSNGGQLPPSGLPASWFTTPIPARSTTDRQQYSQEFRERVSRVTQRGQNYVSQLNEPGRDWPRSFVGQNTRFFQQAATPSRNTISLAGAGLESGVGIARPAGGNSNFMPANMVDADNDVDLLHDEQVMSYLPPSAEERRLFESFQAEARSVFRRSIETIGRRKSLLLQSFEADNLKLQQLQSGQVQWSGDANDPESENRYISRLSKVQRIRLRAVEMETLNMQRLRGNFQVTMQQFKIEVQRYLVAKARGEYLRNPVEYFKPQLIDWDPHKNMGIKIALMENHMDESDWDRLRLMVESDPPENTNTRPRAQAQHIHESIVRAPFTNGYNNININSRVATTAISTTTNLSFPYIFPLQELPQEILSLVLEMVGQKTDIVLLLTVCKAWAAIIVKLLYYRPHINKKPQLDLFMNTMRKPASELVFDYRPMIKRLNFSFVGDYMTDAQLLHFVGCPNLERLTLVFCKQVTTKSIAKVLKGCRFLQSVDITGVREVGNELFNVLSTDCKRIQGLYVPRADLVSCEAIEQFVENAPMLKRVKITFNKNITNNLLIKMAHSCPLLVEVDLTSTPQINNDSIVTLMTELPQLREFRLTQNMLLSDAFATQLALNVTSLPALRLVDLSACESITDKTVVKLVQLAPKLRNVYLGKCSRITDNSLIALSKLGKNLQTVHFGHCFNITDEGVKVLIQNCPRIQYVDFACCTNLTNHTLYELGDLTKLKRIGLVKCSQMTDEGLLNMIALRGRNDTLERVHLSYCTNLTIYPIYELVMACPKLSHLSLTAVPSFLRPDITQFCRPPPSEFTVNQRQIFCVFSGKGVQKLRHHLMSMTRPTDGPTTKVRKILIEFLIARGLFKPNENEEEALKRIADDINQESAALMTASSMFNAANEPFQSINFERIDELFTFLKRVPQDDSVSSEDLAELMPLVDESFCEEPFRSEWRDHDGIVAPRASNDLNSELADIVRKFHALNDRIADFEVNVSSIIRIQFQYTGSMLAEMSHIYMLLVDLNRTICDIQKRIYEINNPRDVKAITIWRMLWTPRFEEMLRKYKLDTVVLRLYLKNNVAVLTRQREVALLRARTLWDTEQSGLVQGNGAVNGNTVASDPSVVAARQLFPQFQIPVFRPTQDGPPPDQDDDEVLEES

SEQ ID NO: 7770 - protein, 1079 aa, uncultured soil bacterium
MASNNKMSPIPQPPTRPVVGNMLSLDSAAPVQDLTRLAKELGPIFWLDMMGAPIVIVSGYTLVDELSVETRLDKVVRGALRRVRAIGGDGLFTADTAEPNWSKARNILLQPFGNRAMQSYHPSMVDIAEQLVKKWERLNADDEIDVVHDMTALTLDTIGLCGFDYRFNSFYRRDYHPFVESLVRSLETIMMIRGLPLENFWMRRRRSDLATDVAFMNKMVDEIVAERRKSAEASDGKKDMLNAMMSGVDRSTGEQLDDVNIRYQINTFLIAGHETTSGLLSYAIYALLKHPDVLKKAYAEVDRVLGADIEARPSYQQVTQLTYITQILKEALRLWPPAPAYGIAPLKDETIAGGKYSLKKNTFISILVTALHHDPAVWGPNPDLFDPENFSPEAEAKRPVNAWRPFGNGQRACIGRGFAMHEAALALGMILQRFKLIDHQRYQIRLKETLTIKPDGFKIKVRPRSGHDRTVHAEAATAAVATGAALPRARPRPGHNTPLLVLYGSNLGTAEDLATRVADLAEVNGFATRLAPLDDCAGQLPDSGGVLIFCASYNGAPPDNATKFVGWLRGELPNDAFAKLRYAVFGCGNRDWAATYQSVPRLIDETLSAHGGKRVFPRGEGDARSDLDGQFESWFAALGAAAVKEFGLESRFSRSADDAPLYSVEPVAPSAVNAVAALGGTVPMTILVSRELQNKSGPDASERSTRHIEVQLPGGMTYRVGDHLSVVPCNAPALVDRVARRFGFLPADQIRLAVAEGRRAQLPVGEAVSIGQLLTDFVELQQVATRKQIQIMSEHTRCPVTKPKLVAYVGDDADSSERYRADILSRRKSVYDLLEEFPAIELPFPAYLEMLSLLAPRYYSISSSPTGDASRCSITVGVVSCPASSTGRGLYRGVCPYYLASRREGESVFATVRETKAGFRLPDDPSVPIIMIGPGTGLAPFRGFLQERAARKAGGATLGPAMLFFGCRHPEQDYLYADELKAFADEGITELFVAFSRSEGPKTYVQHLLATQKARVWDLIEQGAVIFVCGDGSKMEPDVKATLVQIYRDCTGADANGGAKWIADLGAQNRYVLDVWAGG

SEQ ID NO: 7771 - protein, 468 aa, Neisseria meningitidis
MSIKDAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTKFSTLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7772 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7773 - protein, 276 aa, Roseovarius nubinhibens ISM
MREGFMVMQSVAEGGLVLLGCGKMGSAMLEGWLANGLPPTSVWVIDPRPSDWLKSTGVTINGALPKAPAIVLIAVKPQMMGDALPEIAAMGNGETLFVSVAAGTSIAAFEAAMGAQSPIIRAMPNTPAAVGRGITAIIGNSHASAAHLDMAEELLRAVGQVVRLESESQMDAVTGVSGSGPAYVFHMIECLAQAGEAQGLAPELAMQLAKATVAGAGALAEAAEETPAQLRVNVTSPNGTTQAGLEQLMDETTGLPPLMARTVAAATDRSKELARG

SEQ ID NO: 7774 - protein, 488 aa, Bordetella pertussis Tohama I
MFSSERAYMPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 7775 - protein, 451 aa, Shewanella sp. MR-7
MNKLIAFLKERKITEVECVISDMTGIARGKIAPVDKFLDEKGMRLPESVLLQTVTGDFVDDDIYYSLLDDADIDFVCVPDENAVFMLPWTIEATAQVIHDCYDRMGNPIELSPRNVLKKVLSLYEQKGWEPVIAPEMEFYLTSRSDDHDLPLKPPIGRSGRPEAGRQSFSIDAANEYDPLFEDMYDWCELQGLDIDTLIHEDGPAQMEINFSHGNPLSLADQVFVFKRTLREAALKHNVCATFMAKPVTDEPGSAMHIHQSVINKETGKNIFTNEDGTQSPLFLSYIAGLQKFIPELLPLMAPNANSFRRFLPGTSAPVNLEWGVENRTCGLRIPESSPQNRRIENRIPGADANCYLAIAASLLCGYIGMVEGLKPSTPVQGKSNESRSNNPHCLPLTLEEALAAMQESDACKEYLGEAFTTGFVAVKQAELENFRRVVSSWEREFLLLSV

SEQ ID NO: 7776 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7777 - protein, 1001 aa, Oryza sativa (japonica cultivar-group)
MAAAAATSTLLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNLRVLDFYNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPVPVGIGGLVGLQKLLVAGNRLSGELPREIGKLQQLSKADLSGNLISGEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHELTHVFYVAMLCVAEQSVERPTMREVVQILTDLPGTAAATAMDAPSHGSGKEQDRSAEMQQQDGSRESPPQQDLLSI

SEQ ID NO: 7778 - protein, 147 aa, Griffithsia japonica
MALKRINKELQDLGKDPPSNCSAGPASDDLFHWQATIMGPPDSPYSGGVYFLTIHFPTDYPFKPPKISFTTRIYHPNINSNGSICLDILRDQWSPALTVSKVLLSICSLLTDPNPDDPLVPEIAQTYKTNRARYEETAREWTRKYAQ

SEQ ID NO: 7779 - protein, 452 aa, Cryptococcus neoformans var. neoformans B-3501A
MLRNLRPLLRTVPAPSRSVLRPLSTTSKAFATAQSSPVRAHSVEELHALTAEEILKEGGVRKEAEMRHFTVNFGPQHPAAHGVLRLILELNGEEILRADPHIGLLHRGTEKLIEYKNYTQALPYFDRLDYVSMMTNELSYSIAVERLLNIEVPERAKWIRTLFGEITRVLNHLMAVLTHAMDVGALTPFLWGFEEREKLMEFYERVSGARMHAAYVRPGGVAFDLPHGLLDDIFKWATQFSSRVDEVEEVVTGNRIWKQRTIGIGPVTAQQALDYSFSGVMLRGSGIPWDIRKVAPYDAYDKVEFDVPVGKNGDCYDRYLCRVQEFRESLRIIGQCLNKIPDGAYKVDDHKIVPPPRASMKESMESLIHHFKIFSEGYSVPPGETYAAIEAPKGEMGVYLVSDGTNRPYKCKIRAPGFAHLAGADFMMRHHFLPDAVAIIGTMDLVFGEVDR

SEQ ID NO: 7780 - protein, 281 aa, Magnaporthe grisea 70-15
MPLTAVQKTLSAQFVHMTATNDKVAQKFLKNANWKLDIAADAYFNSNPNMATSSSSKPKLDKMFSDLQDTQEDSPDELGAGSAIEYASSLGVDPESVGIFVLMELVKAPAFGVITRSGFVEGWQATNAPASKSGQKDYIQSVIRNLPQDHELFKRVYRHAFIAGRETPEQRALPLENALVYWQCFFGPEMPHSKPWVAKSSQSGGTTDFLDLWTEYLKNNWSRTVSKDMWNQTLDFAVKSTADSTLSFWTPEGSWPSVIDGFVEWLRNKGIGVASGMEVDS

SEQ ID NO: 7781 - protein, 378 aa, Triticum aestivum
MSLPIAAIVGIAAGGAALLVLVAVVIALWCRARARRNRTSETGSSDPSTLVEWGKGGRSSSAPERQGARQFSLEELAQATNNFSEANLVGAGSFGLVYKGLLFDGSVVAIKRRMGAPRLEFSDEVRRLSEICHRNIVTLIGYCQEGGLQMLVFEYSPNGNVCSHLYDSGKGSMTRLEFKQRLAIAIGAAKGLNHLHSLMPPLIHKNFKTSNVLVDENFIAKVADAGLFRLLRGHEDVGSSHGFSSSVYQDPEAHLVAQFSESSDVYSFGVFLLELITGREAASLQPAESRESLAHWLEAHFSSNELIDPRLGGGFTTEGMKEFVGLAFQCLNPSSRRRPKMRLVAAELDRILETEMSLTTIMGDGTAIITLGSQLFTS

SEQ ID NO: 7782 - protein, 496 aa, Kluyveromyces lactis NRRL Y-1140
MGNSPSKNQYGIQGTIKNSGGSQQQQGLSLSDESGNEPNDPDDSRSLPTTTNNNNYNNLVSAKSRQISSSTPNNYGLDIDMSLARDLSKYPISISNTSSVSTTGSESSFSMKSVPQIVGSGGGGGSLPTTTSSPFLSDSHFDHSPMSLPPIKEENDTAPSSVSSSFRKGSKIPNQRSSKPIILRRSSHDLSCTDHVNIDDMIDKLLYLGESRIYHSEDFPFRSWEIQLVCTMAREIFLNQPSLLKLQAPIKVVGDVHGQFTDLLRILRLSGVPPDTNYLFLGDYVDRGKQSLETIMLLLCYKIKYPDNFFMLRGNHESANVTKMYGFYDECKRRLSTKAWKMFVDVFNSLPFAAIIQDKIFCVHGGISPQLSNLKQVSKIQRPTDIPDDGLLTDLLWSDPDSSINDWSLNDRGVSYTFSKKNIADFCSKFNFDLIIRGHMVVEDGYEFFARKKLVTIFSAPNYCGEFENWGAVMSVTTGLMCSFELLKPHGIKRKR

SEQ ID NO: 7783 - protein, 393 aa, Populus alba
MNVPATRKDFMIVNMGPHHPSMHGVLRLILSLDGEDVIDCEPILGYLHRGMEKIAENRTIIQYLPYVTRWDYLATMFTEAITINGPEQLGNIQVPKRASYIRVIMLELSRIASHLLWLGPFMADIGGQTPFFYIFRERELIYDLFEAATGMRMMHNYFRIGGVAADLPHGWLDKCLDFCDYFLTGVAEYQKLITRNPIFLERVEGIGIVSAEEAINWGLSGPMLRASGVRWDLRKVDHYECYDEFDWGVQWQKEGDSLARYLVRIGEMTESVKIIQQALEGIPGGPYENLETRSFDRERNREWNDFEYRFISKKTSPAFELPKQELYVRVEAPKGELGIFLIGDQSSFPWRWKIRPPGFINLQILPQLIKRMKLADIMTILGSIDIIMGEVDR

SEQ ID NO: 7784 - protein, 394 aa, Nostoc punctiforme PCC 73102
MTRLETRTEPMVLNMGPHHPSMHGVLRLIMTLDGEDVVDCEPVIGYLHRGMEKIAENRTNVMYVPYVSRWDYAAGMFNEAVTVNAPEKLAGVAVPKRASYIRVIMLELNRIANHLLWFGPFLADVGAQTPFFYQFREREMIYDLWEAATGYRMVNNNYFRVGGVAADLPYGWVDKCLEFCDYLLPKVDEYERLVTDNPIFRRRVEGIGTITREEAINWGLSGPMLRASGVQWDLRKVDHYECYDDFDWDVQWETAGDCFARYVVRMREMRESVKIIRQAIKGLPGGPYENLEAKRLAAGKKSEWDAFDYQFIGKKVSPTFKIPKGEIYARVESGKGELGIYLVGDDNVFPARWKIRAADFNNLQIVPHLLRGMKVADIVVILGSVDVIMGSVDR

SEQ ID NO: 7785 - protein, 337 aa, Cochliobolus heterostrophus
MVVKVGINGFGRIGRIVFRNAIEHNDVDIVAVNDPFIEPHYAAYMLKYDSTHGQFKGDIKVDGNNLTVNGKTIRFHMEKDPANIPWSETGAYYVVESTGVFTTTEKAKAHLKGGAKKVVISAPSPDAPMFVMGVNHETYKPDIEALSNASCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGSLNGILGYTEDDIVSTDLNGDNRSSIFDAKAGISLNKNFVKLVSWYDNEWGYSRRVLDLLVYIAKIDGNA

SEQ ID NO: 7786 - protein, 141 aa, Aspergillus oryzae
MAPYNDGLLAFLFRQLFYTIPEVPPVELHGKSVLVTGANSGVGFCLALELASHGAKVLAAVRSVPKGEAAKQRILERVPTAQVDVQECDLASFDSVKAFANQMKQESKTFDLVILNAGVWCSQWMASTDGFDISLQVSVAR

SEQ ID NO: 7787 - protein, 440 aa, Acidobacteria bacterium Ellin345
MGSAVATVVGESIAIGIFLTPAGMAKALGSPFWLLAVWMLMAAMALSGALCFGELSTRYPEDGGLYVYLREGFGKRIAFLYGWMSLLVMDPGITAAMAVGMATYGSYIFGWGGVGTKIVAVSSVLALGLLNIVNLRVSAGLLRIVTWLKFAVLGALVLRGLLFHLGSSHNFTPFVQQRTGSMPLGPALAVATVAAFFSFGGWWDVSKIAGEMKNPERILPRALVAGVLGVTAAYVIITGVFVYLVPLEKVVSDKGFVAQAGEVLFGGPGAQLLSAAVVICVLGSLAVLIMVSPRVYFAMARDGLFFSAVAETHPKFGTPSRAIAVQVVMASLLIVLGSFGQILSYFMFPAVIFLGLALSTVFVFRRKGIPDGVVKTAGYPITPVFFLVLVVVVLALIVGHDPVQAFTGLGVVLLGLPVYALVHRKTSPAALEPIADQKAS

SEQ ID NO: 7788 - protein, 482 aa, Mycobacterium sp. KMS
MDTTALLKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADVDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGIKESGFGREGGTEGIEEYLDTKYIALTK

SEQ ID NO: 7789 - protein, 89 aa, Thermotoga maritima MSB8
MEVKIEKPTPEKLKELSVEKWPIWEKEVSEFDWYYDTNETCYILEGKVEVTTEDGKKYVIEKGDLVTFPKGLRCRWKVLEPVRKHYNLF

SEQ ID NO: 7790 - protein, 518 aa, Yarrowia lipolytica CLIB122
MRGSIVKAGPMASNAVLSHIDMSTHLVVCTHGVWGTRAHFNYIVEQLLETNSKTMEFYQDDSTCIEDSLAELKSRQGDVVVIYRTRGNEGYSTYDGIDVCGARLAEEAETLISLIENNSDRKVDRLSMAGYSLGGLMSRYAVGLLYTRGVFNRIPPASFTTFCTPHVGVRVLGESRLASAFNSLAGSLMGKTGKQLFLEDRVRVRETAMTDSNREQFSKPMPLLEIMSYAESSFSKGLAAFQHRNLYANVVNDSRTAWYTAGIYDFDPFKGVNMESVTLPTVEGTNEIIVDTSRLNNIKLQQSDTSNLLAPPPEAIKQPPGWLERRFRWAKVIYNIAVTMPMYAVTWIASAIFYGIISNRRRVQYAKGEYWKNNTSDDFVGALFNGKVHSPGDKSSESSSSSSSSQSHGHHRSHSLEEGAFRTALEDQVDKTMDSMFTAMEYKTTEGDTLDLTKTKLVLSDSQKTIIENLSKLKWDKTAIHIRATKQAHAGAIVRHPDPSFYEGKTVVKHWIDNKARL

SEQ ID NO: 7791 - protein, 150 aa, Shigella sonnei
VVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGAMHCLENPGKIPLDLIEVRSGSYLEEDDVVRFADRYGRV

SEQ ID NO: 7792 - protein, 392 aa, Thermococcus kodakarensis KOD1
MRYKKRKYFMAGRINILQRSKIRELFEKASKMENVISLGIGEPDFDTPEVIKEAAKRAIDEGYTHYTPNAGIPEFREAIAEYYKEFYNVDVDMNNIIVTAGAYEATYLAFESILEQGDDVIIPDPAFVCYVEDAKIAEAGIIRIPLREENKFRIDPDELLEAITKRTRMIVMNYPNNPTGAIMKKDVAKAIADIAQDYNIYILSDEPYEHFLYEGARHHPMIKYAPDNTILANSFSKTFAMTGWRLGFAIAPEQVIRDMIKLHAYVIGNVTSFIQIAGITALRDKRSWEAVERMRQVYDERRKLVLKYLNDMPHITPFRPKGAFYIWAKIDPELDMTSEDFAEWLLENAGVVVIPGTAFGRQGEGWIRISYATEKEKLIEAMERMKEALSKL

SEQ ID NO: 7793 - protein, 377 aa, Streptomyces avermitilis MA-4680
MKAVVYKGAFDVAVEDVEKPSIQHPNDVIVRITSTAICGSDLHMYEGRTAAEPGIVFGHENMGIIEELGQGVTALKEGDRVVMPFNVACGFCTNCVDGFTGYCLTVNPGFAGGAYGYVAMGPWQGGQAEYIRVPYADFNCLKLPPGNEHESDFILLADIFPTGYHGCELAQVRPGESVAVYGGGPVGLMAAYSALLRGAKKVFVVDRVLERLQKAEEMGAVPINFAEGDPIAQIKEQTEGIGTDKGVDAVGYQAMAHGTDREEPATVLNSLVGTVRPTGALGVPGLYVPADPGGPDEQAKQGMLLVAIGKLFEKGLRVGTGQCNVKRYNRYLRGMITEGRAKPSFVVSHELPLDQAPSAYDKFDKRIEGYTKVVLHP

SEQ ID NO: 7794 - protein, 207 aa, Bradyrhizobium japonicum USDA 110
MSERLLVLVRHGQSEWNLKNLFTGWKDPDLTEQGVAEAREAGRKLKAQGLVFDVAYTSVLTRAQHTLDLILGELGQKGLPTEKNLALNERDYGDLSGLNKDDARKKWGEDQVLIWRRSYDVPPPGGESLKDTLARALPYYVQEILPSVLNGKRTLVAAHGNSLRALIMVLEKLSPEGILKRELATGVPIIYRLNADSTVASKLDLAG

SEQ ID NO: 7795 - protein, 321 aa, Magnaporthe grisea 70-15
MFGRSAPKFDPAKDIPNQAGRIAFVTGGNGGLGLETVIQLAKAGMERIFIGARNEEKALKAIKEISTNLNCSTTFTFVKMDLTSFDSVCRAADQVISQTDKLHLLINNAGVVGTAPGLTPEGYETQWGTNHMGHALFTRLLLPLLKQTAEGGRVDVRIVNVSSLSERMCALHGCGDLEVFKRAEAKGPLWGAGLFWGYGASKLATILHARMLAKKHPSVKAVAVHPGTVKTTITGSFSKTSPFIGGYVMPFITALFFVDVSEGARNQLWAATSDQANTGEYYAPVGRPNMGSGKSRNMKEAERVWEWTERELDAYLRKTGR

SEQ ID NO: 7796 - protein, 243 aa, Xanthomonas axonopodis pv. citri str. 306
MSNTKIALVTGATRGIGLETVRQLATAGVHTLLAGRKRDDAVAAALKLQAEGLPVEAIQLDVNDDISIAAAVGTVEQRHGHLDILINNAGIMIEDMQRAPSQQSLEVWKRTFDTNLFAVVEVTKAFLPLLRRSLAGRIVNVSSILGSLTLHSQPGSPIYDFKIPAYDASKSALNSWTVHLAYELRDTAIKVNTVHPGYVKTDMNGGGGEIEVEQGAHSSVQMALLDAHGATGSFTHLGEVLPW

SEQ ID NO: 7797 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALSALKADHEFLLRGGVFSKDWIDSYIAFKEEDVRRIRMAPHPLEFEM

SEQ ID NO: 7798 - protein, 429 aa, Nocardia farcinica IFM 10152
MALESSRTAFERARRSVGGGVGSGLRAAMRPHPLFVREARGAHLWDLDGDRYVDYVMAWGPLVLGHSDPRILSAVSEAATKMQVVGTGHALEYLAAEAVLDAVPHGERLLWSNTGTEAVQVALRLARAATGRRRVLKFAKSYHGWHDTVYAGMSEDDSDRPARPGSKGQSPSVLDDLVVARFNDIHLAERLLRESVERDIAAVLIDPVMSNAGVEAPAPEFLSTLRDLCDRHGVVLVFDEVIAGFRIARGGAAEKYGVLPDLSVYGKAMAGGFTQSAVVGRADLVDQVTTGVTHAGTFNANPIALAAVEATMRVLADPDVYEALETISAEFHSVVGAVLGSVPGSGSFNRVGSLLQYVPAGGTTGLHGTGGLWTTIMEGMLRRGFLFMPSGKIFLSTAHTTADIEATAAALLHVISLSSSRDGSDRTLD

SEQ ID NO: 7799 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGETAYFGPEPEFFVFDGIEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7800 - protein, 278 aa, Vibrio sp. Ex25
MMEIRQMEHKKIAFIGAGNMVRAIVSGLVANGYPAQNITATAPSEARRLPLEQDFGIRTTSDNIQAATEADVVVLSVKPQMMADVCKPLQAIDFTNKLVISIAAGINCSRLDDMLDTKLNLVRVMPNTPSQLGLGMSGLFAPAHVTEQDKAFAAELMEAVGKVCWVEQESGINNVIAAAGSAPAYFFLFMEAMQAEAIAQGFDKDTARLLVQQAALGAASMVVSNPETELSTLRENVTSKGGTTAEALRTFNEHQLSDIVAKAMQAAVARAEEMEKLF

SEQ ID NO: 7801 - protein, 374 aa, Xanthobacter autotrophicus Py2
MTDTIERPGFVERNRPGRAKMKAAIFVEKNRIVLDEKPIPDVGPLDALIRITTTTICGTDVHILKGEYPVEKGLTIGHEPVGIIEKLGSAVEGFAEGQRVIAGAITPSGYSNACLCGCASQDGPRMKHGFKPMGGWRFGNTIDGAQAEYLVVPDAMTNLAPVPEALGDEQVLMCPDIMSTGFAGAESGKVRIGDTVAVFAQGPIGLCATAGARLMGATRIIAVDRVGERLNVARAMGADEVVDFSKVDPVEEILRLTDGRGVDVAIEALGRQETFEAALRVLRPGGTLSSLGVYSSDLKIPLDAFAAGLGDNKIVTSLCPGGKERMRRLMDVVASGRVDARALVTHRFKLDDIEKAYDLFSHQRDGVLKVAITP

SEQ ID NO: 7802 - protein, 574 aa, Lotus japonicus
MEGKGYTLDGTVDLAGRPVLSSLTGKQKACTYILVYRVLERFAYYGVGANLVNFMTTQLNKDVVSSITSFNNWSGLATLTPILGAYIADTYTGRFWTITFSLLIYAIGLVLLVLTTTLKSLRPACENGICREASNLQVALFYTSLYTIAVGSGAVKPNMSTFGADQFDDFRHEEKEQKVSFFNWWAFNGACGSLMATLFVVYIQEKNGWGLAYSLSAIGFLLSSIIFFWGSPVYRHKSRQARSPSMNFIRVPLVAFRNRKLQLPCNPSELHEFQLNYYISSGARKIHHTSHFSFLDRAAIRESNTDLSNPPCTVTQVEGTKLVLGMFQIWLLMLIPTNCWALESTIFVRQGTTMDRTLGPKFRLPAASLWCFIVLTTLICLPIYDHYFIPFMRRRTGNHRGIKLLQRVGIGMAIQVIAMAVTYAVETQRMSVIKKHHIAGPEETVPMSIFWLLPQNIILGVSFAFLATGMLEFFYDQSPEEMKGLGTTLCTSCVAAGSYINTFLVTMIDKLNWIGNNLNDSQSRITIMPFFSVISALNFGVFLWVSSGYIYKKENTSTTEVHDIEMSAEKTVKY

SEQ ID NO: 7803 - protein, 660 aa, Oryza sativa (japonica cultivar-group)
MVAFYGLGDGGCLVSAPAELAGMFCRGGVVVQQQQRKRSLVAASAVAAADCVVRAAKRQRQQRQPPSLDALPDECLFEVLRRLPGGRERGASACVSRRWLALLCSIRASELNQATAAAAAAAPPSLPDLNEEFVMEEDDEEEESSPVVDPCVERVLEGKEATDVRLAAMAVVAGSRRGLEKLAVRGSHPTRGVTDRGLLAVARGSPNLCSLALWDVPLVTDAGLAEIAAGCPSLERLDITRCPLITDKGLAAVAHGCPNLLSLTVESCSGVGNDGLRAIGRSCSKIQALNIKNCARIGDQGISSLVCSATASLTKIRLQGLNITDASLALIGYYGKAVTDLTLVRLPVVAERGFWVMANAAGLQNLRCMSVTSCPGVTNLALAAIAKFCPSLRQLSFRKCGHMTDAGLKAFTESARLLESLQLEECNGVTLVGILDFLVNCGPKFRSLSLVKCMGIKDICSTPAQLPLCKSLQFLTIKDCPDFTDASLAVVGMVCPYLEQVDLSGLREVTDRGLLPLINSSEGGLVKVDLSGCKNITDAAVSTLVKGHGKSLKQVSLEGCSKITDASLFAISENCTELAELDLSKCMVSDNGVATLASAKHLKLRVLSLSGCSKVTPKSVSFLGNMGQSLEGLNLQFCNMIGNHNIASLEKQLWWCDILA

SEQ ID NO: 7804 - protein, 468 aa, Neisseria meningitidis
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGIEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 7805 - protein, 468 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEM

SEQ ID NO: 7806 - protein, 419 aa, Neisseria lactamica
FTVPARIVLEDPEEWFENGQAFDGSSIGGWKGIQASDMQLRPDPATAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7807 - protein, 439 aa, Aquifex aeolicus VF5
MSYIPHSEEETKEILSKLGLESLEDLFSHIPKELFAKDFSFPEPKSEEELRRIFERACEDTELPLYFIGAGAYDRIIPSVIWQILSRGEFLTPYTPYQAEASQGTLQAIFEYQSLICELTGMDVANASMYDGASALAEAVLMARAIKGKGDTVVLSKALNPLYRRTVKTYLRGYEDKIVEVPYTEEGTTDLNNLEEVLKESEVHALAVQYPNFFGFVEPLKEIGELCKKYEVPFVVFVDPIALSILKPPAEFGADIVVGEGQQMGIPLSFGGPYVGFFATKKEHVRKMPGRLVGMGEDIEGKRAFTLVLQTREQHIRRERATSNICTNQNLMALANLLYMVLLGKEGMKKVAVQSLSKALYFKKELMKKGFEEVFTGKHLWEFPLRHESLKAIYRKLLKEKIVLGLPLDRFYEDLKNTTLIAVTEKRTKEEIDSVLALL

SEQ ID NO: 7808 - protein, 264 aa, Vibrio cholerae O1 biovar eltor str. N16961
MKKITINDLMKWKQEGRKFATSTAYDASFAQLFESQEMPVLLVGDSLGMVLQGETDTLPVTVDDIAYHTRCVRKGSPNCLLMADMPFMSYATPEQACENAAKLVRAGANMVKIEGGDWLVDTVKMLTERAVPVCAHLGLTPQSVNIFGGYKVQGREQDKADRMVRDALALQEAGAQIVLLECVPAELANRITQILDVPVIGIGAGNGTDGQILVMHDMFGISANYMPKFSKNFLAETGDIRQAVAKYIEDVASGAFPDLAHTIA

SEQ ID NO: 7809 - protein, 543 aa, Glycine max
MSVNNNNPSKGIGASSSSFGNAGVPSNSIPSNPGFSQSQGQAQIPVGYQGQFPLSQAHAIVQAQSKAQAQAQAQAAAAAHAQLQAHLQAQGLSLNQNQAGGLGVSSPLISTPGNASGKRIPLKPPMRPVGFSPPNSFSPLRPMELTPAARRKKQKLPEKQLQDKVAAILPESALYTQLLEFESRVDAALARKKADIQEALKNPPCIQKTLRIYVFNTFANQIRTIPKKPNVEPPTWTLKIVGRILEDGVDPDQPGVVQKSSPLYPKFSAFFKRVTISLDQRLYPDNHIILWENARSPAPHEGFEVKRKGDKEFTVNIRLEMNYVPEKFKLSPALTEVLGIEVDTRPRIVAAIWHYVKARKLQNPNDPSYFHCDPPLQKVFGEENMKFTMVSQKISSHLFPPQPILLEHKIKLSGNSPAGTACYDVMVDVPFPIQRELSALLANVEKNKDIETCDEAICGIIRKIHEHRRRRAFFLGFSQSPVEFINALIESQSKDLKLVSGEPSRNAEKERRSDFFNQPWVEDAVIRYLNRKPAVGSDAPGST

SEQ ID NO: 7810 - protein, 741 aa, Yarrowia lipolytica CLIB122
MSQSPAPNPQGGINNGKPANGAAPGAAGTPNRPANGAQAGGASTPTNRPAQASGSDLNRIVMEYLHKKGYFQTESMLRFESSRAPAPAQPVGSQYTGGQNATNVAPGATPPPPAPPGAPQVAIGTNNAGQMQQVPIPKPPVAKSIHDDTTAIRKGYVMLRNWTEASLDFYQPELRRALYPIFVHCYLDIIAKGQASEARDFFATYSGDHAVLHGHDLQKLSGISLPDHIPSNELAQKFRSSKYRLNISRTVFDLLFYFLQEHDSTGGAIILRIVNQYIDAQVSSGRPNRFDSEGAVHSSEGLPDTAHGSQVDSFNQAEVKLGKLPYEASFEKEVEHSLREIDKGNTDGGNSLEAEFASMKSDQDTAPNREMLPLPPHTSVDIAAEIQAVMDSRAKIKVGPVQAAMPSVCMYTFHNTHDGLNCLDFSSDATLIAGGFSDSFVKVWSLNGSRLKSVVKGDTATTSKRLVGHAGPVYGVSFSPDQRYLLSASADKTVMLWSMDTYTGLVCYKGHNEPVWDVAFSPHGHYFATASHDQTARLWSCDHIYPLRIFAGHMSDVDCVIFHPNGTYVFTGSSDRTVRMWDVAKGSSVRVFIGHTAAINCLAVSPDGRWLASAGEDHVIILWEIGSGRRLKIMRGHGKASIYSLAFSREGTVLVSAGADQSIRVWDVKKSTVESGPEPENLSVERAPEAVSSAKGNEASKKREIVATPDHMAVYHTKSSPVYKVQFTSRNLCLAGGAFNG

SEQ ID NO: 7811 - protein, 232 aa, Candidatus Blochmannia floridanus
MHIIKTVLIRHGESQWNKDNRFTGWIDVDLSNQGYSEAKRAGQLLKKYKFIFDYGYTSVLKRTIHTLWVILDQLNQTWLPIQKVWQLNERHYGALQGLNKNEAIKTYGYDTIQKWRRSFKDIPPKNNKNDLFLGTNDIRYKNIETNTLPNGESLELTANRVIPYWQKYIEPKIYNNNCIIIVAHGNSIRAILKFLNQLDDSEIFNIEIPTGIPLIYEFDNNIKPIRYYYLSE

SEQ ID NO: 7812 - protein, 156 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSTKKAAKSPKKADKKA

SEQ ID NO: 7813 - protein, 605 aa, Glycine max
MQRSRKALLERRAIQKATSGRNYVYLYKVSLSLVFVLWGLVFLFSLWTSHGHGYGDHESREVPVGVSNWNEDEHRQCRKSNSADEYLTKETDDVYIPSETFSSDGAKTDGLISESLSSGESINRVEPGDKESSISPDTEEHEVERSESAVKHQNDVQKYNHLSQAMPLGLDEFKSRAIGSKIKSGTNPSGSVIHRLEPGGAEYNYASASKGAKVLASNKEARGASDILSRNKDKYLRNPCSSEEKFVVIELSEETLVKTIEIANFEHHSSNFKEFELYGSLVYPTEAWIFLGNFTASNVKQAQRFVLEEQKWMRYIKLNLQSHYGSEFYCTLSIVEVYGVDAIERMLEDLIYAQDKPFASGEGNGEKRVASPLSNAAKADNVRPNTITGINSDPASEISSENQEAIIVKRNVPDPVEEIRQQVGRMPGDTVLKILMQKVRYLDLNLSVLEQYMEDLNSRYINIFKEYSKDMGEKDLLLEKIKEEISRFLERQDVMMKEFSDLDSWRSHFSVQLDHVLRDNAVLRSEVEKVRENQVSLENKVVVVFSVCVIFSLLAIFRLSLDMIMNLYRVLSFDRTITSRRFWQGSSSWFFLLLSCSIVIFTLTL

SEQ ID NO: 7814 - protein, 279 aa, Pediococcus pentosaceus ATCC 25745
MINSLNDRIMLNNGTAIPGLGLGVFQIPDADTAQVVANGIKNGYRLIDTAQIYGNEAGTGAGIKAGLTATGLKRADLFVTSKVWNDHLSYDETIAAFESSLKKLGLDYLDLYLIHWPGDNAFQDAWRALETLYKQGKIKAIGVSNFQIHHLQALAEFAEITPVINQIETHPQLSQLEMREYAAKHDIKVQAWSPLMQGKILDNAVLAKIAQKYNKSVAQIVLRWDVQQNILLVVKSVRAERMLSNAQIFDFELAPEDMDQINALNENLRVGPNPDEFDF

SEQ ID NO: 7815 - protein, 474 aa, Thermus thermophilus HB8
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMARIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 7816 - protein, 342 aa, Streptomyces avermitilis MA-4680
MKALVKEKAEPGLWLMDVPEPEIGPGDVLIKVLRTGICGTDLHIRSWDGWAQQAVRTPLVLGHEFVGEVVETGRDVVDIKAGDRVSGEGHLVCGKCRNCQAGRRHLCRATVGLGVGRDGAFAEYVALPAANVWVHRVPVDLDVAAIFDPFGNAVHTALSFPLVGEDVLITGAGPIGLMAAAVARHAGARNVMITDVSEERLELARKIGVSLALNVADTTIADGQRALGLREGFDIGLEMSGRPEAMRDMIANMTHGGRIAMLGLPSQEFPVDWARIVTSMITIKGIYGREMFETWYAMSVLLEGGLDLAPVITGRYGYRDYEAAFADAASGRGGKVILDWTL

SEQ ID NO: 7817 - protein, 450 aa, Blastopirellula marina DSM 3645
MTGMISKADSSGAALSAKTLERGRKSIAGGDSSTMRVLPYHIPLVADRGEGSRLWDIDGNEYIDLNMAYGPLLLGHRPKQVIEAVYRQISERGSQLGFPTEVTIRVAEKLKQLFPCIELLRFANSGTEACASAIRLARTYTGKRKLIMFEGHYHGWSEAVFTKYHAPLEMLPECGYGPAIPGTTGMTDALDDVITCQWNDLDALQRCLEEHGDEAAAIIMEPISGNAGLLLPRDGYLATAREMIHDRGGLLIFDEVITGMRVAAGGAQEHYLVSPDITVVSKAMGGGYPVGSFGASAEIMSCITNGPLFHGGVFSGNAVVMSAAEAVLDTVLADKDNIYANLHALGNQLAGGIDDIYNRLGVPHHVHHLGPLLAGLITKTDVEGLYNYRDVRRHCDFERYIQFQHQMQRSGVYFHPNEFEPMFLSTAHTSADIDEVLERWEDGARQCLVR

SEQ ID NO: 7818 - protein, 263 aa, Haemophilus influenzae R2846
MARRPLVMGNWKLNGSKAFTKELIEGLKAELHDVTGCDVAIAPPVMYLGTAEAALSGCGCNCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 7819 - protein, 437 aa, Chlamydophila caviae GPIC
MPVIDETPMTYTEACRYFPGGVNSPIRACIPVGIVPPIVSSASRDVFIDSFGKNFIDFCGSWGSLIHGHSHPKILDALCSAASQGTSYGLTSENEISLATTLFSCLGLQDHKLRFVSSGTEAAMTSVRLACGVTQRSVMIKFLGCYHGHADVLLKGMTIDENNLMEVPHLVDRYFSSDPCLPLTLILPYNDLKTFEEVMEKIGERVACVIFEPIAINMGVVLPEAGWIESIITTCRRYGALSIMDEVVTGFRMGSRGMRSILDVTPDITVYGKILGGGMPVAAVLAHQSIMEHLMPVGTVFQAGTLSGNPIAMAAGQASIELCQERDFYPKLENLTEGFLSPIEDFIRCKGFPIALVRAGSMFSFFFRETPPRNLRDVQECDQKTFGIFYRHAFSRGVYLSPASMEASFISSVHSRENLAYTQNVLIDSLVKTFEGI

SEQ ID NO: 7820 - protein, 419 aa, Neisseria polysaccharea
FTVPARIVLEDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKVAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7821 - protein, 330 aa, Agrobacterium tumefaciens str. C58
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSSLKALGEKHGLI

SEQ ID NO: 7822 - protein, 419 aa, Neisseria mucosa
FTIPARIVLDDPEEWFENGQAFDGSSIGGWKGIQASDMQLRPDPATAFIDPFYDDTTVVLTCDVIDPADGQGYDRDPRSIARRAEAYLKSTGIGDTAYFGPEPEFFVFDGVEFETDMHKTRYEITSESGAWASGLHMDGQNTGHRPTVKGGYAPVAPIDAGQDLRSAMVNILEELGIEVEVHHAEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7823 - protein, 368 aa, Blastopirellula marina DSM 3645
MTHPWIADRTAAFDSSGIRKVFDLAAKMTDPINLSIGQPDFDVPDAVKDTAIAAIRDGKNGYALTQGMPVLRDKLQASIDAELGHRDRTNFVCSGTSGGLVLSMLALVNPGDEVIIFDPYFVMYESLVKLVGGVPVIINTYPDFRIDLPKVEAAITPRTKLILLNSPANPTGVVATEAEVAGLAKLAGEKNIALISDEIYRMFTYGDFVSPAKYNDQTIVIDGFSKSYGMTGWRVGYVHGPSAVIETMVKLQQYTFVCAPQPAQWASAAALDVDMSQHVATYARKRDLMLEGIGDLYEVSQPDGAFYIFPKAPWGTGTEFVAKAIENNLLIIPGNIFSKQDTHFRISYAAPDETLKRGVDTLRKLAQG

SEQ ID NO: 7824 - protein, 368 aa, Bartonella henselae str. Houston-1
MTYDQKKIVSALRAFERGEIVVVTDDDDRENEGDLIVAAVHCTEEKMAFIIRHTTGIVCAPMPKEEAQRFNLTPMVLDNNSVHRTQFTVTVDFKHGTTTGISAHDRTLAVRNLANSNAGANDFIRPGHIFPLIAHEGGVLMRSGHTEAAVDLCKLAGLPPVGVIGELVNDDGSVKHGDEVTRFAQENQFHIITVADLIAYRQRKEMLIQHVGEMHIETLVGPAVVQSYQLPWEAVQHVAIIFGDIRDGEDIPVRLHRENIVNDVFGQTSDILEIMRRMMKKEKRGVFVYLREGSVGVKSAVSIQALAMRGGESHTQAIEREEEWRQIGLGSQILKHLGISSVILYASKERHYVGLEGFGIRISRTDIL

SEQ ID NO: 7825 - protein, 419 aa, Neisseria cinerea
FTVPARIVLKDPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7826 - protein, 361 aa, Triticum aestivum
  misc_feature (179)..(179): Xaa can be any naturally occurring amino acid
  misc_feature (223)..(223): Xaa can be any naturally occurring amino acid
  misc_feature (337)..(337): Xaa can be any naturally occurring amino acid
  misc_feature (345)..(345): Xaa can be any naturally occurring amino acid
  unsure (1)..(361): unsure at all Xaa locations
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLXVPFVKPEILVDGPHDIDRCAYVTEIVLAACYKALNDQHVLLEGXTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLXGTYKGDAXLGEGASESLHVKDYKY

SEQ ID NO: 7827 - protein, 419 aa, Neisseria pharyngis subsp. flava
FTIPTRIVLDDPEEWFENGQAFDGSSIGGWKGIQASDMQLRPDPATAFIDPFFDDTTVVLTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7828 - protein, 419 aa, Neisseria flavescens
FTIPTRIVLDDPEEWFENGQAFDGSSIGGWKGIQASDMQLRPDASTAFVDPFYDDTTVVFTCDVIDPADGQGYDRDPRSIARRAEAYLKSSGIGDTAYFGPEPEFFVFDGVEFETDMHKTRYEITSESGAWASGLHMDGQNTGHRPTVKGGYAPVAPIDCGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFK

SEQ ID NO: 7829 - protein, 288 aa, Pasteurella multocida subsp. multocida str. Pm70
MNSKKHLGHTARKRFGQNFLHDNNVIHGIVSAIYPQKDQFLVEIGPGLGALTEPVGELVDHLTVVELDRDLAERLRHHPFLHHKITVIETDAMQFDFGQLYRDANLAEKKQKMRVFGNLPYNISTPLMFHLFKYHDCIQDMHFMLQKEVVKRLCAGPNSKAYGRLTIMAQYFCQVMPVLEVPPTAFKPAPKVDSAVVRLVPHKVLPHPVKDLYWLNRVCSQAFNQRRKTLRNALSTLFSADQLTELGIDLTARAENLSIADYARLANWLTDNPPADVNKDEMIEHLDD

SEQ ID NO: 7830 - protein, 194 aa, Triticum aestivum
MAPTVMASSATSVAPFQGLKSTVGLPVSRRSNGASLGSVSNGGRIRCMQVWPIEGIKKFETLSYLPPLSTEALLKQVDYLIRSKWVPCLEFSKVGFIFREHNASPGYYNGRYWTMCKLPMFGCTDATQVINEVEEVKKEYPDAYVRIIGFDNMRQVQCVSFIAFKPPGCQESGKAYTAHSRQAIYKVPLQYGQL

SEQ ID NO: 7831 - protein, 172 aa, Glycine max
MKDEDGLPTTTAVTKKENLDSSLFGKGRYKFWALAAILLLAFWSMFTGTVSLRWSGTLNSLSNDIDTPIHDDLDVLEMEEREKVVRHMWDVYTNSRSVRLPRFWQEAFEAAYEDLTSDVAEVRDAAVAEIAKMSVRSIHFDPPPLQSTSAREFSKSLKQAEKGKDATTSRRA

SEQ ID NO: 7832 - protein, 159 aa, Glycine max
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRMAEKEPKEGKSPKKTAKSPKKADKKA

SEQ ID NO: 7833 - protein, 532 aa, Oryza sativa
MAAVSAAAARLHHLLSLCVAVAGLLLMLLGGGEASVHEYRGLGFLNKGNAFILHAGSEGLYAPSSPANATTAEDDEDAAAAAVADAFIRFDKITFRRPKDAAKETGSAMVQILVFEIEDREMIGGSAYGGQKAICCTSDLAKLGACTEGSVIYRPSQVNPGWPQLLFSSFDGSDTIATLPSRIIPITKTGMYNMYFIHCDPSLAGLEIEGQTVWKNPTGYLPGRMAPLKNFFGIMSFAFVVLGIYWFYQYMKFWREVLPLQNCITLVITLGMLEMSLWYFEYAEFNETGVRPKGITFWAVTFGTVKRTVARVIILIVSMGYGVVRPSLGGLTSKVVMLGGTFFLATEILELVENLGAVNDLSGKARLFLVYPVAILDAAFVVWIFISLAKTLDKLQARRSMAKLDIYRKFTIALAVTVLVSIGWIGYEIYFKSTDVFNERWQYAWIIPAFWHVLSFSLLCVISYLWAPSQNSMRFTYDASENFDREDSLSLIRPGPIASKNGWSLSSSPDTKATKNVTVTSFDGDDEENKRE

SEQ ID NO: 7834 - protein, 276 aa, Yarrowia lipolytica CLIB122
MSSERETKTFLARLCEQADRYDEMVNYMKDVAKSGEELTVDERNLLSVAYKNVIGARRASWRVIFPIEQKEEAKGATHHLELLKTYRAKIEAELEDICSDVLDILTNHLLPKAENAESKVFYYKMKGDYHRYLAEFTSGEKRKEAATAAHESYKSATDVAQTELSSTHPIRLGLALNFSVFYYEILNSPDRACHLAKQAFDDAIAELDTLSEESFRDSTVIMQLLRDNLTLWKNDLEESLQAQQSEETPATDAAAASTEAAAPKEEAKPAAEEPKE

SEQ ID NO: 7835 - protein, 299 aa, Yarrowia lipolytica CLIB122
MGVDIQLKDGYTICFLGCGTMGTAVLGAVLDSLSKGNKEGDAPKPGKFMACVTRQESADRLHKDLTSSAPDIPVEILINDNGSAYKADVFVLGSKPYMAEKILTPLQQMLEGKVLVSLLAGKTIADIESYSGRCPKPLVVRAMTNTPSRIGAGMTVLSFPDNATVDESVVNAVSWIFEQTGKCITLEEKQMDVSTALCGSSPAFCFLIIEALADGAVRMGMPYNTAFQCAAQSMLGAAKMVVESGQHPAVLKSAVCTPGGTTIGGLLALEDKGVRSSVARAVEESTNIAKSLGGGAAKK

SEQ ID NO: 7836 - protein, 242 aa, Brassica napus
VDPRVRLVRLLGCCIDGEEKLLIYEFMVNKSLDSFLFDSTLKLQIDWPKRFNIIEGVARGLLYLHRDSCLKVIHRDMKVSNILLDENMNPKISDFGLARMFQGTQHQDSTLRVVGTIGYMSPEYAWTGMFSEKSDIYAFGVVLLEIISGMKISSFNCGKEGKTLLEYAWESWLETDGVDLLDQDIASSCSPVEVARCVQIGLLCIQQQAVDRPNIAQVVFMITTTTDLSRPKPPVFALQIHD

SEQ ID NO: 7837 - protein, 254 aa, Brassica napus
MARKFFVGGNWKCNGTAEEVKKIVNTLNEAQVPSQDVVEVVVSPPYVFLPLVKSILRPDFHVAAQNCWVKKGGAFTGEVSAEMLVNLDIPWVILGHSERRALLNETNEFVGDKVAYALAQGLKVIACVGETLEQRESGSTMDVVAAQTKAIADRVSNWSDVVIAYEPVWAIGTGKVASPAQAQEVHDELRKWLAKNVSADVAATTRIIYGGSVNGGNCKELGGQADVDGFLVGGASLKPEFIDIIKAPAAEKSA

SEQ ID NO: 7838 - protein, 754 aa, Streptococcus pyogenes MGAS8232
MTRFTEYVETKLGKSLTQASNEEIYLSLLNFVKEEASHKAKNSAKRKVYYISAEFLIGKLLSNNLINLGIYKDIKEELAAAGKSIAEVEDVELEPSLGNGGLGRLASCFIDSIASLGINGEGVGLNYHCGLFKQVFKHNEQEAEPNYWIEDQSWLVPTNISYDVPFKNFTLKSRLDRIDVLGYKRDTKNYLNLFDIEDVDYGLIKDGISFDKTEIATNLTLFLYPDDSDKNGELLRIYQQYFMVSNAAQLIIDEAIERGSNLHDLADYAYVQINDTHPSMVIPELIRLLTEKHGFDFDEAVAVVKNMVGYTNHTILAEALEKWPTAYLNEVVPHLVTIIEKLDALVRSEVSDPAVQIIDESGRVHMAHMDIHFATSVNGVAALHTEILKNSELKAFYDLYPEKFNNKTNGITFRRWLEFANQDLADYIKELIGDEYLTDATKLEKLMAFADDKAVHAKLAEIKFNNKLALKRYLKDNKDIELDEHSIIDTQIKRFHEYKRQQMNALYVIHKYLEIKKGNLPKRKITVIFGGKAAPAYIIAQDIIHLILCLSELINNDPEVSPYLNVHLVENYNVTVAEHLIPATDISEQISLASKEASGTGNMKFMLNGALTLGTMDGANVEIAELAGMENIYTFGKDSDTIINLYATASYVAKDYYDNHPAIKAAVNFIISPELLAFGNEERLDRLYKELISKDWFMTLIDLEEYIEVKEKMLADYEDQDLWMTKVVHNIAKAGFFSSDRTIEQYNEDIWHSR

SEQ ID NO: 7839 - protein, 821 aa, Aspergillus oryzae
MSAEPDHTHDKKRVHLQDASGAEKKEELDTATAILKKKKKPNSLIVTDAVNDDNSVIALSNNTMETLQLFRGDTVLVKGKKRKDTVLIVLADDDLDDGSARINRVVRHNLRVKHGDVITVHPCPDIKYAKRIAVLPIADTVEGLTGSLFDVFLAPYFREAYRPVRQGDLFTVRGGMRQVEFKVVEVDPPEYGIVAQDTVIHCEGEPIQREDEEGNLNEVGYDDIGGCRKQMAQIRELVELPLRHPQLFKSIGIKPPRGILMYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEIMQIHTKNMKLGEDVDLETIAAETHGYVGSDLASLCSEAAMQQIREKMDLIDLDEDTIDAEVLDSLGVTMENFRYALGVSNPSALREVAVVEVPNVRWEDIGGLEEVKRELIESVQYPVDHPEKYQKFGLSPSRGVLFYGPPGTGKTMLAKAVANECAANFISVKGPELLSMWFGESESNIRDIFDKARAAAPCVVFLDELDSIAKSRGGSVGDAGGASDRVVNQLLTEMDGMTSKKNVFVIGATNRPEQLDAALVRPGRLDTLVYVPLPDQASREGILKAQLRKTPVAPDVDLPFIASKTHGFSGADLGFVTQRAVKLAIKQSITADIERQKQREANGEDIKMDEDEEVDEEDPVPELTRAHFEEAMKTARRSVSDVEIRRYEAFAQSLKNSGGSSFFRFPSAGEVQDNNTFGEAGNDDSLYD

SEQ ID NO: 7840 - protein, 75 aa, Glycine max
  misc_feature (34)..(34): Xaa can be any naturally occurring amino acid
  misc_feature (47)..(47): Xaa can be any naturally occurring amino acid
  misc_feature (60)..(60): Xaa can be any naturally occurring amino acid
  unsure (1)..(75): unsure at all Xaa locations
SISWPGDTTVNRAGAGMDAPFTGLKSMAGLPTRXTYNDITSIGCNCXRVQCMQVWPPIGXKKYETLSYLPDLDDA

SEQ ID NO: 7841 - protein, 182 aa, Gossypium hirsutum
MASSMISSATIATVNCSSPAQANMVAPFTGLKSASAFPVTRKANNDITSLASNGGRVQCMQVWPPLGKKKFETLSYLPDLTPVQLAKEVDYLLRSKWIPCLEFELEEGFVHRKYSSLPTYYDGRYWTMWKLPMFGCTDSAQVLEELENCKKEYPNAFIRIIGFDNVRQVQCISFIAYKPKGY

SEQ ID NO: 7842 - protein, 357 aa, Triticum aestivum
FGGEDNKRRLLSDLHVLDLETMIWEEVKTEKGGPAPRYDHSAAVYAEHYLLIFGGSSHSTCFNDLYLLDLQTLEWSQPDTQGAHITPRSGHAGMMIDEDWYIVGGGDNASGSTDTIVMNASKFVWSVVTSVSVRDPLACEGLTLCSTTVDGEKFLIAFGGYNGKYNNEIFVMKPKPRNFVQPRLFQSPAAAAAAASVKAAYAAITATDEKTKDIVATDDLDVKRAEPGSSSKEMVAEIDALNGEKGELESRLAEVRTENSKLKDKLDVVKLSHNELTKELRSVENQLAAEGSRCQKLESQIAAAHKRLESASSLENELEALQQQISQAEQTMTTSQRRKSGGVWKWVGGSAEVSDNE

SEQ ID NO: 7843 - protein, 158 aa, Glycine max
ASQVCKAASRAARSLLSASRASHGRAVGAATAVSLSCKVPLFYGKNGSGSGSASSSSSSWISRALALPAAAYMFQDHDVRAAELERTFIAIKPDGVHRGLISEIISRIERKGYKLVGIEVGECFNECAQEHYQDAEGGHSLDGLSDCLSYGPSNAVVE

SEQ ID NO: 7844 - protein, 135 aa, Aspergillus oryzae
MVAHADNLRSRIPTQPDLFRRVYRYTFPLCRMQGQRNLQFEIAAEQWKLFFTPDKGGVQWETETTPWLDWWIEFMEERGKKPVNKDLWEQVEVFMRKTLDDERFGWWSADGAWPGALDDFVVWVQKKRGDNMEVE

SEQ ID NO: 7845 - protein, 185 aa, Aspergillus oryzae
MRQLTEQETKTLFEKLANYTGRSLNNLITTSDDPNDRYVFRLHGNRVYYMKLSLANLSTAIPRANLLSLGTCIGKFTKSGQFRLHITALDVIAPHARYKVWIKQNGEMPFLYGGNVVKAHVNRWSDDCPEHAGVVVFNSNDTPLGFGVTARSSAEARKLEPTAITVFRQGDIGEYLREEDTLFTT

SEQ ID NO: 7846 - protein, 136 aa, Zea mays
  misc_feature (30)..(30): Xaa can be any naturally occurring amino acid
  unsure (1)..(136): unsure at all Xaa locations
MAWRANLFWSLKKNRVLFCQSSPARAPARXFVKKKYGEIKGRNPPLPFLVPEGSGVPPQLWGRYKMGVEKRVNLDGLPEAQIYKKLEELSKAGESFKTQKFWDSIPPCLTFPKKKTQMGEPMVPQRYLELGPEISL

SEQ ID NO: 7847 - protein, 278 aa, delta proteobacterium MLMS-1
MSQYDEVVQTAREYYNSDDADIFYHTVWGGEDIHIGLYDTPDEDIATASRRTVEHMARRLQNLGKDSYVLDLGAGYGGSMRYLARTFGCRCVALNLSEAENERDRQKNREQGLENLIEVVDDDFTNLHYQDATFDLVWSQDAFLHSGDRAKVIAEAARVLKPGGELLFTDPMQTDDADPATLQPVYDRIHLSSLGSPGFYRQQAAKLGLTEVAFEDHSHQLANHYGKVLAELERMEQQCREAGVSQAYIDRMKTGLGHWINNAKQGNLAWGIFHFHKP

SEQ ID NO: 7848 - protein, 333 aa, Colwellia psychrerythraea 34H
MTKTVKEHLVKSLASGQFISGQLLGEQLGISRTAIAKHIKVLTEIGLDIYSVTGKGYKLAQPLYLLEKDKIISLLADEKNPQAEKQSDLPLIEVHSLIDSTNDYLMRRLPNQVTSGQVCLAEYQSAGRGRRGRQWISPFGSQIYLSMYWYLEQGLSGAMGLSLLTALAVSDAVKAHSNVQVQLKWPNDIYLDGVKLAGILIDLEGQALEPSHCVIGIGLNLHMPVDAGKLIEQKWTDLQSHSKVKIDRNGLSAQLISCLRKRLQQHQQVGLVPMLEEWHAHDAFLNKRVKLITGERVTHGICRGVNNQGALLLEVDGQVKPVYGGEVSLRMDE

SEQ ID NO: 7849 - protein, 458 aa, Pseudomonas aeruginosa PAO1
MSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNKVEPGAPIEGNSYEQLEPSLPNNLRDALRELDDSEILAKYIDPKYIDIFVACKESELEEFEYSISDLEYNWYLHTV

SEQ ID NO: 7850 - protein, 278 aa, Corynebacterium sp.
MTVPSIVLNDGNSIPQLGYGVYKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPGSVRREHLEENLDVFDFDLTDTEIAAIDAMDPGDGSGRVSGHPDEVD

SEQ ID NO: 7851 - protein, 549 aa, Spiroplasma citri
MNKINFQEAIVYEIHPQSFYDSNHDGVGDLQGIIQKLDYLAMLGVNYLWLNPIYVSPQKDNGYDVSDYKNINPLFGTMNDFEMLVTEAGKRNIYIMMDMIFNHCSTEHEWFQKAQTGNLDYLQRFFFLPGDKAKCPNNWQSKFGGSVWEYHDELKMFYLHLFDKTQVDLNWKNESLRQHIYQIVNYWLQKGVRGLRFDVINLIGKPNIFENDLTGDGRKYYTDTPQVHTYLQEMAQNTYLKTNDIITVGELSSTSIKQAILYTKPVSQELNMAFTFHHLKIDYLNNEKWKLAPYDPAKLVAKIKEWQIPVQAAGGWLANFLNNHDQPRALSRFGDPENYRFESATALAAVVLLLRGTPYLYQGEEFGMENNNYTKIEQLKDVESINYYHILQKEGEQPNAILEVLSARSRDNARTPMQWNNQQFAGFSTHKPWIDVNTNYLKINWEKDYHSSQSIFKAYQMLIQLRKNNLAFSYGEIEFVEIDPTILSFYRYYEKNKFLVLINLSDQTIMIPDNLLSEKTIYNNYSTFEKKINPYQVIVFDYLMAKSFK

SEQ ID NO: 7852 - protein, 406 aa, Arabidopsis thaliana
MASSTATMLKASPVKSDWVKGQSLLLRQPSSVSAIRSHVAPSALTVRAASAYADELVKTAVINSIIQKTIASPGHGIMAMDESNATCGKRLASIGLENTEANRQAYRTLLVSAPGLGQYISGAILFEETLYQSTTDGKKMVDVLVEQNIVPGIKVDKGLVPLVGSYDESWCQGLDGLASRTAAYYQQGARFAKWRTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMFLSGGQSELEATLNLNAMNQAPNPWHVSFSYARALQNTCLKTWGGKEENVKAAQDILLARAKANSLAQLGKYTGEGESEEAKEGMFVKGYTY

SEQ ID NO: 7853 - protein, 179 aa, Triticum aestivum
  misc_feature (58)..(58): Xaa can be any naturally occurring amino acid
  misc_feature (62)..(62): Xaa can be any naturally occurring amino acid
  misc_feature (91)..(91): Xaa can be any naturally occurring amino acid
  misc_feature (95)..(95): Xaa can be any naturally occurring amino acid
  misc_feature (100)..(100): Xaa can be any naturally occurring amino acid
  misc_feature (107)..(107): Xaa can be any naturally occurring amino acid
  misc_feature (115)..(115): Xaa can be any naturally occurring amino acid
  misc_feature (119)..(119): Xaa can be any naturally occurring amino acid
  misc_feature (125)..(125): Xaa can be any naturally occurring amino acid
  misc_feature (128)..(128): Xaa can be any naturally occurring amino acid
  misc_feature (136)..(136): Xaa can be any naturally occurring amino acid
  misc_feature (142)..(142): Xaa can be any naturally occurring amino acid
  misc_feature (149)..(149): Xaa can be any naturally occurring amino acid
  unsure (1)..(179): unsure at all Xaa locations
MAPTVMASSATSVAPFQGLKSTAGLPVSRRSNGASLGSVSNGGRIRCMQVWPIEGIKXFETXSYLPPLNTEASSKQVDYLDPSKWVPCLRXSKVXSSSRXHNASPGXYYDGRYWXTMWXLPISGXTDXTQVINEVXKRSRRXPDAYSAXRFDNMRKCMRNSSPTTGSRIRKANSHHTGN

SEQ ID NO: 7854 - protein, 427 aa, Pseudomonas fluorescens PfO-1
MSRSETLFANAQKHIPGGVNSPVRAFKSVGGTPLFFKHAEGAYVTDEDDKRYVDYVGSWGPMILGHSHPDVLDAVRNQLQHGLSYGAPTAMETEMADLVCSLVPSLEMVRMVSSGTEATMSAIRLARGFTGRDSIIKFEGCYHGHSDSLLVKAGSGALTQGVPSSAGVPAAFAKHTLTLPFNDIDAVEKMLAEVGQDVACIIVEPVAGNMNCVPPAPGFLEGLRSLCDKHGVVLIFDEVMTGFRVALGGAQAYYGVTPDLTTFGKIIGGGMPVGCFGGKRLIMERIAPLGPVYQAGTLSGNPLAMAAGLTTLRLISRPGFHAELTDYTTRLLDGLQQRADAAGIPFVTTQAGGMFGLYFSGADDIVTFEDVMASDAALFGRFFHLMLEGGVYLAPSAFEAGFTSIAHGEAELKLTLDAAERAFAKLK

SEQ ID NO: 7855 - protein, 516 aa, Arabidopsis thaliana
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTVTKRSNLL

SEQ ID NO: 7856 - protein, 204 aa, Solanum tuberosum
RTSSLESPIMLLSGHQSAVYTMKFNPAGTIIASGSHDKEIFLWNVHGDCKNFMVLKGHKNAVLDVQWTTDGSTIVSASPDKTVRAWDVETGKQIKKMAEHSSFVNSCCPARRGPPLIVSGSDDGTAKLWDMRQRGAIQTFPDKFQITAVSFSDASDKICTGGIDNDVKLWDLRRCEVTMTLQGHQDTITGMQLSPDGSYLLTNA

SEQ ID NO: 7857 - protein, 448 aa, Oryza sativa
  misc_feature (430)..(430): Xaa can be any naturally occurring amino acid
  unsure (1)..(448): unsure at all Xaa locations
MAAAVRPTVKGSCSSGGHAGAGRGAGWAPRRRDRRRGGPRRGRSTRASSRRGRRRPRSGYQSRVSRAEQVGPEIRTGFLKDGKPIQLKQGKEITITIDYSIKGDENLISMSYHKLAIDLKPGSTILCADGTITLTVLSCDCEQGLVRCRCENSAMLGERKNVNLPGVIVDLPTLTEKDKVDILQWGVPNKIDMIALSFVRKGSDLMLVRSVLGEHAKSILLMSKVENQEGVANVDEIIANSDAFMVARGDLGMEIPIEKIFYAQKVMIHKCNIHGKPVVTATQMLESMIKSPCPTRAEATDVANAVLDGTDCVMFSGETAAGAYPELAVQTMANICSRAELYLDYPFIFKKLSSEAPVPLSPLESLASSAVQTANISKASLILVLTRGGTTARLIAKYRPAMPVLFVVVPELKADDSFNWTCSDEAPARXLIVRGLIPMLSTATPKAF

SEQ ID NO: 7858 - protein, 306 aa, Arabidopsis thaliana
MAATSLTAPPSFSGLRRISPKLDAAAVSSHQSFFHRVNSSTRLVSSSSSSHRSPRGVVAMAGSGKNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 7859 - protein, 204 aa, Oryza sativa
  misc_feature (170)..(170): Xaa can be any naturally occurring amino acid
  misc_feature (184)..(184): Xaa can be any naturally occurring amino acid
  misc_feature (187)..(187): Xaa can be any naturally occurring amino acid
  unsure (1)..(204): unsure at all Xaa locations
MSSMESSCLPATTESIAKAQEAKDASESISILYRVLQDPSSSAEALRTKELAITNLTNYLTKENRAEELRNLLTQLRPFFSLIPKAKTAKIVRGIIDAVAKIIGTSELQISLCKEMVEWTRAEKRTFLRQRVETRLAALLLENQEYTDALTLLTDLIKEVRRLDDKLLLXDIDLLESKLHFSLXKLXKAKASLTAARTAANGLT

SEQ ID NO: 7860 - protein, 126 aa, Brassica napus
  misc_feature (33)..(33): Xaa can be any naturally occurring amino acid
  unsure (1)..(126): unsure at all Xaa locations
MPQGDYIELHQKRHGRRMDYEERKRKKEARAVXKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRP

SEQ ID NO: 7861 - protein, 342 aa, Triticum aestivum
WRATGAEINPKLASRHQELHYQDPIIPGIWPTPPPPPPSRKKAHISGPNWSYAAPDYWLHRNNSPRRRRGARGGKGAEAMTEVALFRGPTNLASPASRGSSSSSSTSLRYLADSDVLQRGTTSSDQSPAGSAERQAGGLQEEEEEEERWSFLALLLELLRKSLLRCRAEDGGQGQGGMEIGLPTDVQHVAHVTFDRFHGFLGLPVEFEPEVPRRAPSASASVFGVSTQSMQCSYDSRGNSVPTILLMMQRRLYEQGGLRAEGIFRINAENSQEELVRDRLNSGIVPYGIDVHCLSGLIKAWFRELPSGVLDPIPPEQVMQCQSEEDVLRVAKCLPTKLKRLT

SEQ ID NO: 7862 - protein, 384 aa, Burkholderia xenovorans LB400
MQSAMQARSKLPDVGTTIFTVIGQLAAQYDALNLSQGAPNFAPDASLIDGVAQAMRAGHNQYAPMAGIAALREALADKVATLYGVHYDPASEVTVIASASEGLYSTISALVHPGDEVIYFEPSFDSYGPIVRLQGATPVAIKLSLNDFRVDWDEVAAAITPKTRMIIINTPHNPTATVFSEADVARLKAITRNTDIVILADEVYEHVVFDGAKHQSMACHAELAERSVIVSSFGKSYHVTGWRVGYCLAPAALMDEIRKVHQFMVFSADTPMQYAFVDALARRESYLGLSAFYQKKRDLLTDALRDSRFELLPSEGSFFMLARFRGFSEESDSDFVLRLIRDARVATIPLSAFYTDGTDSGLIRLSFSKDDATLIEGARRLCQI

SEQ ID NO: 7863 - protein, 155 aa, Anaplasma phagocytophilum
MYCCVLTYLVEYKGGTRVQERTLSILKPDVVERGIIGNVISYIEAAGLKVVAQRMCRLTVSQAEEFYDVHRDRPFFPELVKFMTSGPVVVQVLEGESAIAVYRDVMGATNPKEAAKGTIRADFAESIDANCVHGSDNADNAKREIMFFFGECEIF

SEQ ID NO: 7864 - protein, 478 aa, Candida albicans SC5314
MLRSASRISRHRLYQSLSSQINKQSARCYAAAASSGPENRPLVTPLGRHPQKYSTPAPGFGPTTFTEVLDDVNITWDKNDDPDRLEKQNTKIRHFTINFGPQHPAAHGVLRLILELHGEEIVRSDPHVGLLHRGTEKLIESKTYMQALPYFDRLDYVSMMTNELVFALAVEKLLNVEVPLRAKYIRTLFGEITRILNHCMSVLTHIMDVGGLTPFLWGFEEREKLMEFYERVSGARLHTAYFRPGGVSQDLPAGLLDDIYMWATQFGDRIDEVEELCTDNRIWKDRTIGVGVVSAEDALNYSLSGVMLRGSGIPFDIRKSQPYDAYDLVDFDIAVGINGDCYDRYLIRMAEFRQSLRIIFQCINDIPEGPVKVEDYKISPPSRSLMKEDMEALIHHFLLFTKGYAVPQGETYTAIEAPKGEMAVYVVSDGSERPYRCKIRAPGFAHLGAFDHIARGNLLADAVAIIGTMDLVFGEVDR

SEQ ID NO: 7865 - protein, 821 aa, Arabidopsis thaliana
MRIVACLLLITALFSSYGYAAITTSSPLSIGVTLSSPGGSYELGFFSSNNSGNQYVGIWFKKVTPRVIVWVANREKPVSSTMANLTISSNGSLILLDSKKDLVWSSGGDPTSNKCRAELLDTGNLVVVDNVTGNYLWQSFEHLGDTMLPLTSLMYDIPNNKKRVLTSWKSETDPSPGEFVAEITPQVPSQGLIRKGSSPYWRSGPWAGTRFTGIPEMDASYVNPLGMVQDEVNGTGVFAFCVLRNFNLSYIKLTPEGSLRITRNNGTDWIKHFEGPLTSCDLYGRCGPFGLCVRSGTPMCQCLKGFEPKSDEEWRSGNWSRGCVRRTNLSCQGNSSVETQGKDRDVFYHVSNIKPPDSYELASFSNEEQCHQGCLRNCSCTAFSYVSGIGCLVWNQELLDTVKFIGGGETLSLRLAHSELTGRKRIKIITVATLSLSVCLILVLVACGCWRYRVKQNGSSLVSKDNVEGAWKSDLQSQDVSGLNFFEIHDLQTATNNFSVLNKLGQGGFGTVYKGKLQDGKEIAVKRLTSSSVQGTEEFMNEIKLISKLQHRNLLRLLGCCIDGEEKLLVYEYMVNKSLDIFIFDLKKKLEIDWATRFNIIQGIARGLLYLHRDSFLRVVHRDLKVSNILLDEKMNPKISDFGLARLFHGNQHQDSTGSVVGTLGYMSPEYAWTGTFSEKSDIYSFGVLMLEIITGKEISSFSYGKDNKNLLSYAWDSWSENGGVNLLDQDLDDSDSVNSVEAGRCVHIGLLCVQHQAIDRPNIKQVMSMLTSTTDLPKPTQPMFVLETSDEDSSLSHSQRSNDLSSVDENKSSEELNASS

SEQ ID NO: 7866 - protein, 546 aa, Arabidopsis thaliana
MNHSTSDQSLYIESDDGDDERKHLSDDEDDDGTLSDTSDAYNQNQHHLSKASPYSTAWPKSYRQSIDMFGSVPSPNLGFLANSSMSRRGSSFMSSTLTRRHTPESLPCVTKPLLEDEEAPKHKLSTHSLLPSKPSSSMVVSHDMGISNDSSFGQAVLNGVNVLCGVGILSTPYAVKEGGWLGLIILFAFGILCFYTGLLLRYCLDSHPDVQTYPDIGHAAFGSTGRILVSVILYMELYAMSVEYIILEGDNLSSMFPNASLSIGGFHLDAPRLFALLTTLAVLPTVWLRDLSVLSYISAGGVIASVLVVLCLFWVGLVDDVGIHSKGTPLNLATLPVSVGLYGYCYSGHGVFPNIYTSMAKPSQFSAVLLASFGICTLMYAGVAVMGYSMFGESTESQFTLNLPQDLVASKIALWTTVVNPFTKYPLSRNIQRLFIYLFAMSLEELIPSNYGKSRFYAIAIRSALAISTLLVGLAIPFFGLVMSLIGSFLTMLIFLDTDADTTASLFLEHLKEKSNPYSGDNLYLNYDSRSSMFSHWHIFSPCKDH

SEQ ID NO: 7867 - protein, 774 aa, Coccidioides immitis RS
MTVDTSYLTTQVNNIVEQLHGLFDEIGVPNHERDSRESELFAALSETLNGHLQGVHNEKNDMIEEANRLITTIKQMQASLDDGAYGSRRASDDPDLRVTLPLNHCLALLREKQHAVGKRHQERFEQVKKLVEALESYSSHLESTFVKIPLPPTAPGTIVPPSFDLSAAYVNALDNEFTRVYEEYNRRLVTVSTVCEEIIKLWAELGTPQAQTDPAIVEHHRDSPEQLGLHESDLASLRTKRDKLLNEKKAREGKIKELRTAVEALWGRLGVEESDRKGFLAANRGCGLRTINEFEEELARLNELKRQNLHLFVEDARCRLQELWDSLYYSEEEMLDFTPAFSDVYSDALLSAHEAEIARLEALKEQRMPVLQLIDKHRSLVEDRDALAASSQDASRLMGRGTGQRRDPTRLLREEKMRKRISKELPKVEVELRKILETWEDEYGRPFLVHGERYLDELGPPPQKIPPRSKTPCPSVSRPVSRAAPSRAGGTIRGQQNPSSAAKTPTGNGTLKRNAVGTGSLRSGTNPRPKSPTKIPARVPLANMPDGSNSPDRQPAQSYSTSTFRGKMGPPRAPPPKMRELFSREETPQATYQTGLSRSRSVMSSTSSGKVRPVSPEDVYDDRQRSFMSSSMSHYRPISDQSFTSSYISSREDVSFCNQQPKSYANQFQQQYQAQSPPPRQISNSSTINTLASGSENWETYDDASEPEVDATEAYYAKVRAAQGKRAGAEAQLGYPNKPKSIRGVGSDDACVQSSFHSKRLGGSDDWTDDLETY

SEQ ID NO: 7868 - protein, 97 aa, Brassica napus
MAGAAKASWMVAMSVGAVEALKDQVGLCRWNYALKSIHRAAKARANVCGGVSQGAKQLPASAAAVAERRQGEKAEEGLRTVMYLSCWGPIRSCLLGS

SEQ ID NO: 7869 - protein, 304 aa, Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVATY

SEQ ID NO: 7870 - protein, 821 aa, Arabidopsis thaliana
MDFLFLLLERKNKHMGKKRVVLLWLSIFISFSSAEITEESPLSIGQTLSSSNGVYELGFFSFNNSQNQYVGISFKGIIPRVVVWVANREKPVTDSAANLVISSNGSLQLFNGKHGVVWSSGKALASNGSRVELLDSGNLVVIEKVSGRTLWESFEHLGDTLLPHSTIMYNVHTGEKRGLTSWKSYTDPSPGDFVVLITPQVPSQGFLMRGSTPYFRSGPWAKTKFTGLPQMDESYTSPFSLTQDVNGSGYYSYFDRDNKRSRIRLTPDGSMKALRYNGMDWDTTYEGPANSCDIYGVCGPFGFCVISVPPKCKCFKGFIPKSIEEWKTGNWTSGCVRRSELHCQGNSTGKDANVFHTVPNIKPPDFYEYADSVDAEECQQNCLNNCSCLAFAYIPGIGCLMWSKDLMDTVQFAAGGELLSIRLARSELDVNKRKKTIIAITVSLTLFVILGFTAFGFWRRRVEQNEDAWRNDLQTQDVPGLEYFEMNTIQTATNNFSLSNKLGHGGFGSVYKARNGKLQDGREIAVKRLSSSSEQGKQEFMNEIVLISKLQHRNLVRVLGCCVEGTEKLLIYEFMKNKSLDTFVFVFTRCFCLDSKKRLEIDWPKRFDIIQGIARGLLYLHRDSRLRIIHRDLKVSNILLDEKMNPKISDFGLARMFHGTEYQDKTRRVVGTLGYMSPEYAWAGVFSEKSDIYSFGVLLLEIISGEKISRFSYGEEGKTLLAYAWECWCGARGVNLLDQALGDSCHPYEVGRCVQIGLLCVQYQPADRPNTLELLSMLTTTSDLPLPKQPTFVVHTRDGKSPSNDSMITVNEMTESVIHGR

SEQ ID NO: 7871 - protein, 459 aa, Sulfolobus tokodaii str. 7
MVKRLDNAEVIRLHILATIIGALGGFLFGYDTGIIGSVLVYVTPLFHLTPPEVAILTSGTSLLAGIGALAAGPITDKYGRKSLLVTDGIMYAVFALLSAIAINSFLLILWRSLVGFAIGADTAIATAYISEFSPKRWRGRLAITQQLMIFSGITASFWAGYLLSFSANWRLMLGLGVIPAVILVALRAFLPESPRWLLLNGMEEKAKNILRKFGVNIAENEHIAAPSKELSFKEMFNNKAIRTAIILVGLWLAFQQITGINVILYYGPTIYKYLGLTGPRAILNTAISESLGAIEYAISFYLIDKWGRRKLGIFGYAGLVGSLAIMLIGLRAFTSGIVFAGVALVFTAMTLFLLFFHVGVGGVGWVLQGETIPTEVRGRGAGLLAAIDWFANFVIIFIFPYWKAAFGVYSFFALELVLSILAIAIVYLFMPETKGVSLEDMLKVFERGLSVQRQKQYAK

SEQ ID NO: 7872 - protein, 771 aa, Magnaporthe grisea 70-15
MATSDPSNATPPGPGIDVGAASVDNAVNSGQSAAASVAGSSSSSSAAPAASSDPSAPAQKRSSSPPAKTLPVRTKESLQEYVLNRIMARDKVAHEAFVKTEERARAAMDRLHRKVEDYETVHAHKNEFTPSRMYGQGYNGFGNGTTDDPAGPRIIYPKNKPRPGKRTTEPLKWRKKDMRKQAEQHEELVPIRIDVDYDKVKLRDTFTWNLHDRLVSVDLFARQLLEDLGLTPQKDPTLYSPVLTQVGRQILDQLEDFYPSVCSDEDALDPELPYSAYKNDEMRILVKLNITIGQVTLVDQFEWEINNPINSPEEFANSMSRDLSLSGEFATAIAHCIREQSQLFTKSLYSIGHPFDGRPVEDPDLVAAFLPSPIPSVFRPQQQAKEYAPYLYELTDADLERNEVIFSREQRRQKRSVNRRGGPQLPDLKERQRTVRTLVVSSVLPGAATSVDESRLYKRVPAGPGPGGRRKGLREGDLSDSDDSEDSAPDSPAMSQLVGTARTRGMRGAATAAQQRMANLGRSETPESGTILYHDARPSRRLNPREARESTEDTPSLVVKLTVSRDRLKRLLDGERVKPSIPVGLRTPGMPQRTPGAMGPPSTPATSSQNLVATPSGVQSLPPGQFGRLPAPRPPIGDPAPTAPPVPDWLVASLRELQQLYPSDMFEGTMRYCALKAETNQVVAAPPLDQPAPPELVFYYLPRIRCLDCPGKVYTPGPDTSVINFEVHLKNRGHREKVDQRVGRPTAPRNPSASAPRPSASQSPAPRAPSA

SEQ ID NO: 7873 - protein, 324 aa, Magnaporthe grisea 70-15
MVCTGIGSVYIGTSPADGLQAAGGDTQGTVPPTHQYRIRLVTRSEHHIADLQHRYPGSLITSCIRNMSLWGALPRHEVFGLHVVLICTQPQFTRDVCVDLRAIYASAKHLNTDDPAVKQSMVSSSSLLSSWPKTVLEIPTVFVTACPGIRVKTLASWLPQNAAIVRTMPNTPACIRQGATAAFAGPTVTAIPGAAEAVAALIRHVSPSLCFVPTEDLLDVAASVSGSAPAYIFTLMQAMVEAGVRRGLPPDIAASLVKQSAFGSAGLALQTGQLGCLEKLTSDVCVPGGSTSQAMMVLHEEGFVSAVDRAIGVSLAANRAMSNN

SEQ ID NO: 7874 - protein, 479 aa, Pasteurella multocida subsp. multocida str. Pm70
MSRRLRRTKIVCTMGPSTERGNNLEKIIMAGANVVRMNFSHGTPEDHIGRAEKVREVAKKLGKTVAILGDLQGPKIRVSTFKDGKIFLNIGDKFVLDADLPKGEGTQEGVGLDYKTLPQDVVPGDILLLDDGRVQLKVLSTEGNKVFTEVTVGGPLSNNKGINKLGGGLSADALTEKDKNDILLAAKIGVDYLAVSFPRSSADLNYARELAEAAGLKAKIVAKVERAETVATTEAMDDIILASDVIMVARGDLGVEIGDPELVGVQKKLIRRARQLNRVVITATQMMESMISNPMPTRAEVMDVANAVLDGTDAVMLSAETAAGQYPAETVATMAKVCLGAEKMPSINVSRHRMDITFDSIEESVAMSAMYAANHMKGVAAIIAMTHTGRTALLMSRISSGLPIFALSRNQDALNLCALYRGVTPVHFDEVSRNSKGAAAAIRLLKEKGFLVSGDLVLLTQGDELLASGTNTCRTLVVE

SEQ ID NO: 7875 - protein, 275 aa, Bacillus thuringiensis serovar konkukian str. 97-27
MHIPTTTLHNGVKMPLIGLGVYKAKEGDEVKQAVKTALEVGYRSIDTATVYENESGVGEAVRESGIPREDIFITTKVWNDDQGYEETLEAFEKSLKKLQMDYVDLYLIHWPIRGKYVDTYRALEKLYEEGKVRAIGVSNFHKHHLELLLPNCKIKPMVNQVELHPMLTQFELRNFCQGEQIQMEAWSPLMRGGEVFQHPIIQAIATKYEKTPAQVILRWDIQSGIVTIPKSVTPSRIQENFSIFDFSLTEEEMTEINTLNRNLHVGTNPDKYDTL

SEQ ID NO: 7876 - protein, 145 aa, Sesbania rostrata
EIATIPPAVNQVEMNPSWQQGNLREFCKQKGIHVSAWSPLGAYKIFWGSGAVMENQILQDIATAKGKTIAQVALRWVYQQGSSAMAKSFNKERMKQNLEIFDFELSEEELEKIKQIPQRRQYTGDMWLSENGSCKTLEELWDGDV

SEQ ID NO: 7877 - protein, 342 aa, Rhodopirellula baltica SH 1
MAIKVAINGFGRIGRLTFRNLMERSDEFEVVAINDLTDNRTLAMLLKYDSIHGRFDGTVEYDNTSLTVNGKKIVALAERDPRNLPWKDHNVDIAIESTGFFTARSTADKPGYDSHLAAGAKKVVLSAPAKDGADLTCVLGVNDDKLSADLNCVSNASCTTNCLAPVAKVLNDSFGIESGLMTTVHAYTNDQNVQDQPHADLYRARGAAQNIIPTSTGAAKAVGLVIPELQGKLTGIAMRVPVPTGSVVDLTVNLSKEVTKEDINLAIQTAAEGPMKGILFYAVDPIVSSDIVHDPHSSIFAADFTQVLGDKGKMAKVVSWYDNEWGYSSRTADLCSKLGKML

SEQ ID NO: 7878 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 7879 - protein, 104 aa, Oryza sativa
MSAGVGGLRQLLAAAVTTGVAEARAAIFGHALNPTGKRAATKLLRKKMVGEQLAQWYPYDIKRDDPLVMAREEKARLSKLEMLKRRGKGPPKKGQGRRAVKRSK

SEQ ID NO: 7880 - protein, 234 aa, Zea mays
NDLTPITTIAGGSVANTIRGLSAGFGISFGIIGACGDDNQGLLFVNNMRYAQQNMEQIIEAIRIAKQEGLSVSLDLASFEMVRDSRSKLINLLETGNIDLCFANEDEAREVIGGGLESDPEEALAFLGKYCKWAVVTLASKGCMAKHGKQVVQVPAIGESNAVAVDTTGAGDLFASGFLYGLVKGLPLEECCMVGACSGGSVTRALGGEVRPENWQWMYKQMHARGMLLPELKN

SEQ ID NO: 7881 - protein, 254 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQHDVDGFLVGGASLKPEFVDIINAAEAAKQA

SEQ ID NO: 7882 - protein, 283 aa, Streptomyces lavendulae
MPHSELSELPMPSPASEEVGALYDRFTALGAASLGENLHFGYWDSPDSQVPLAEATDRLTDMMAERLRIGAGSRVLDLGCGVGTPGVRIARLSGAHVTGISVSHEQVVRANALAEEAGLADRARFQRADAMDLPFEDESFDAVIALESIIHMPDRAQVLAQVGRVLRPGGRLVLTDFFERAPLAPEGRAAVQRYLHDFMMTMVSAEAYPPLLRGAGLWLEEFLDISDQTLEKTFRLLSERINSSKQRLETQFGEEMVNQFDPGDLVGVKEFGYLLLVAQRPGK

SEQ ID NO: 7883 - protein, 501 aa, Lachancea kluyveri
MESRLGWLTELQTETGANLRRTSIIGTIGPKTNNPETLVALRKAGLNIVRMNFSHGSYEYHQSVIDNARKSEELYPGRPLAIALDTKGPEIRTGTTTNEVDYPIPPNHEMIFSIDDKYAKACDDKVMYIDYKNITKVIEKGKIIYVDDGVLSFEVLEVVDEQTLKVKSLNAGKICSHKGVNLPGTDVDLPALSEKDKSDLRFGVKNGVHMVFASFIRTAQDVLTIREVLGEDGKDVKIIVKIENQQGVNNFDEILKVTDGVMVARGDLGIEIPAPQVFAVQKKLIAKCNLAGKPVICATQMLESMTYNPRPTRAEVSDVGNAVLDGADCVMLSGETAKGNYPINAVTIMAETALIAEQAIPYVATYDDLRNFTPKPTSTTETIAAAAVSSVFEQKAKAIIVLSTTGDTPRLVSKYKPNVPIVMVTRNPRAARFSHLYRGVFPFVYESDTESEWTKDVESRLNFGIAKAKEFGMLKEGDTIVTIQGFAAGVGHSNTLRVLTV

SEQ ID NO: 7884 - protein, 531 aa, Nocardia farcinica IFM 10152
MTATPAVPDDPRRSWWRSAVFYQVYPRSFADSDGDGVGDLGGVREKLGYLELLGVNALWICPVMRSPMADGGYDVSDPRDIDPLFGGMAAMDALIAEAHARDIKVTMDLVPNHTSDRHPWFAEALRSAPGSPARARYIFRDGRGPDGSLPPNNWPSIFGGPAWTRVTEPDGTPGQWYLHLFAREQPDLNWENPEVVADFEKTLRFWLDRGVDGFRIDVAHGMAKPADLPDMAAVSTKMLIHDDSDPRFNNPGVHDIHRRIRKVLDEYPHAVSIGEVWVDDNTRFGEYVRPDELHLAFNFRLAETPFRAEAVREAIENSLAAVAEVGAPPTWTLSNHDIEREVTRYGGGARGVARARAMILVELALPGAVFLYNGSELGLPNVDDLPEEVLQDPVWERSGHTERGRDGCRVPLPWEGERPPFGFTRAERSWLPIPPEWADLTVEAQLERLDSTLCLYRMAVDLRGTRPEFAGEGLEWYGSPPGRLAFRRPGGLVCVLNTTEEPIPLPPGEPLLTSTPLDNGHLPPDAAAWLV

SEQ ID NO: 7885 - protein, 807 aa, Arabidopsis thaliana
MGKKWIVFFAYLLLSSFFISSSSAGITKESPLPIGQTLSSSNGFYELGFFNFNNSQNQYVGIWFKGIIPRVVVWVANREKPVTDSTANLAISNNGSLLLFNGKHGVAWSSGEALVSNGSRAELSDTGNLIVIDNFSGRTLWQSFDHLGDTMLPSSTLKYNLATGEKQVLSSWKSYTDPSVGDFVLQITPQVPTQVLVTKGSTPYYRSGPWAKTRFTGIPLMDDTFTGPVSVQQDTNGSGSLTYLNRNDRLQRTMLTSKGTQELSWHNGTDWVLNFVAPEHSCDYYGVCGPFGLCVKSVPPKCTCFKGFVPKLIEEWKRGNWTGGCVRRTELYCQGNSTGKYANVFHPVARIKPPDFYEFASFVNVEECQKSCLHNCSCLAFAYIDGIGCLMWNQDLMDAVQFSEGGELLSIRLARSELGGNKRKKAITASIVSLSLVVIIAFVAFCFWRYRVKHNADITTDASQVSWRNDLKPQDVPGLDFFDMHTIQTATNNFSISNKLGQGGFGPVYKGKLQDGKEIAVKRLSSSSGQGKEEFMNEIVLISKLQHKNLVRILGCCIEGEEKLLIYEFMLNNSLDTFLFDSRKRLEIDWPKRLDIIQGIARGIHYLHRDSHLKVIHRDLKVSNILLDEKMNPKISDFGLARMYQGTEYQDNTRRVVGTLGYMAPEYAWTGMFSEKSDIYSFGVLMLEIISGEKISRFSYGKEEKTLIAYAWESWCDTGGIDLLDKDVADSCRPLEVERCVQIGLLCVQHQPADRPNTLELLSMLTTTSDLPPPEQPTFVVHRRDDKSSSEDLITVNEMTKSVILGR

SEQ ID NO: 7886 - protein, 355 aa, Arabidopsis thaliana; identical to SEQ ID NO: 298

SEQ ID NO: 7887 - protein, 101 aa, Zea mays
PTRASRPSNKCQRALADAERESTFIMIKPDEIQRRLIGEIISRCEKKVLYLKDSNLANVERSFAEKHYSDLECKPFFQGVVDYIISDPVEVMVCEGKSRIT

SEQ ID NO: 7888 - protein, 432 aa, Vibrio cholerae O1 biovar eltor str. N16961
MTKSAELYQKAQTTIPGGVNSPVRAFNGVGGSPIFIDRADGALIFDADGKAYIDYVGSWGPMILGHNHAVIREAVIQAAQRGLSFGAPTEMEITMAELVSELVPSMEQLRMVNSGTEATMSAIRLARGYTGRDKIIKFEGCYHGHADSLLVKAGSGALTLGQPSSPGVPADFAKHTLTARFNDLDSVRELFAANQGEIACIIVEPVAGNMNCIPPVEGFHEGLREICDQEGALLIFDEVMTGFRVALGGAQAHYNIKPDLTTLGKVIGGGMPVGAFGGRREVMQYIAPTGPVYQAGTLSGNPIAMAAGYACLNLLREEGNEKRLAAKTKQLADGFKSLADQHGIPLLVHQVGGMFGFFFTEQETVTCYEDVARCDVERFKRFFHLMLQHGVYLAPSAFEASFTSLAHGSKEIEATLEAADRSFAILAAEAKA

SEQ ID NO: 7889 - protein, 493 aa, Bordetella pertussis Tohama I
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEAEVVAAANATAFGLAAYFYSTDVRRIWRLADALETGIVGVNEGALAAEAAPFGGVKDSGYGREGSRHGLAEYMQIKYVCQGQLD

SEQ ID NO: 7890 - protein, 581 aa, Oryza sativa
MTICSCEETINEFEMLTRDAARVQKDTLKKILEINASAEYLQNFGLGGRTDAESYKSCIPLCVHNDIEPYIQRIVDGDTSPVVTGEPITNLSLSSGTTHGKPKFIPFNDELLETTLQIYRTSYAFRNRKYPIGQGKALQFVYGSKQVITKGGILATTATTNLYRRQRYKEGMKDIQSQCCSPDEVIFGPDFHQSLYCHLLCGLIYSEEVHSVFSTFAHSLVHAFQTFEEVWEDLCTDIRDGVLSKKVTAPSIREAVSKILKPNPELADSIYKKCIGLSNWYGVIPALWPNAKYVYGIMTGSMEPYLKKLRHYAGNLPLISADYGASEGWVGSNIDPTVPPEQVTYAVLPQVGYFEFIPLEKPIGEETENSASIHYIESDPVGLTEVEVGKIYEVVITNFAGLYRYRLGDVVKIARFHNSTPELQFICRRSLVLSINIDKNTEKDLQLAVEEASKFLEGEKLEVMDFTSFVERSSDPGRYVIFWELSGDASDEVLSSCANALDLAFIDAGYTGSRKIKTIGPLELRILRKGTFKEILDHFLSLGGAVSQFKTPRFVNPSNSKVLQILSRNVTQSYFSTAYGF

SEQ ID NO: 7891 - protein, 64 aa, Zea mays
  misc_feature (26)..(26): Xaa can be any naturally occurring amino acid
  misc_feature (55)..(55): Xaa can be any naturally occurring amino acid
  unsure (1)..(64): unsure at all Xaa locations
MEQTFIMIKPDGVQLSLIADIISLLXKKGFYLKGMKIMNVERSFTQQQYADLADXPVFRGLVEN

SEQ ID NO: 7892 - protein, 181 aa, Zea mays
  misc_feature (158)..(158): Xaa can be any naturally occurring amino acid
  misc_feature (163)..(163): Xaa can be any naturally occurring amino acid
  unsure (1)..(181): unsure at all Xaa locations
MSSQICRSASKAARSLLSSAKNARFFSEGRAIGAAGAVTASGKLPLYASNFARSSGSSKSWITGLLALPAAAFMVQDEEVFAAEMERTFIAIKPDGVQRGLISEIISRFERKGFKLVGIKVVVPSKDFAQKHYHDLKERPFFNGLCDFLSSGPGIARXMGREXVIRYGRKLIGRTDPSESE

SEQ ID NO: 7893 - protein, 468 aa, Anaplasma marginale str. St. Maries
MFLRAEDLLDYIAKNSVKFIDWRFTDLLGRWHHTTYSVSSLSAEVFSSGIAFDSSSVPGWQPIEKSDMLLVPDVSTAFVDPFSPQPSLAVICNVVNPHGHNDYQRDPRYTARKAYEYMLSSEIADKCFFGTELEFFVFDHVRFGTDPYNTYFKLASQEDGGLGSRGCFSNHGYRMKAKDGYMRLAPVDSLHDVRSEMLAMLSEVGVTPLLHHHEVAASQCEIGFRYAELVTSADNVQKCKYVLRNVASSYGKSVTFMPKPVRGDNGSGMHCHQSLWKDGNNIFSGSNRGLSELCLHYIGGVIKHGRALSAFANPSTNSYKRLLPNFEAPTWLVYSHENRSAAIRIPCIPDGGSTRIEVRFPDPLANPYLCFAAQLMAGLDGIKHKVHPHEVSGKCLYSMEESETRDLLSVPTSLEEALTSLDKDRDFLLQGEVFTNEQIESYIQLKRSEVDNLRSYPHPVEFSNYYAL

SEQ ID NO: 7894 - protein, 165 aa, Zea mays
  misc_feature (46)..(46): Xaa can be any naturally occurring amino acid
  unsure (1)..(165): unsure at all Xaa locations
MASATVLKSSFLPKKSEWGATREGGAARAATGSMGGRASAYADELXVKTAKKIASPGGGILGMDESNATWGKRLAAIRLENTEGNRQGDRTLVVTAPGLGQYISGGILFEEKLEQSAVDGRKNVDILAEQGIVAGIKVDKGLVPLGGSNNKSWWQGLDGLASREG

SEQ ID NO: 7895 - protein, 674 aa, Cryptococcus neoformans var. neoformans JEC21
MFRLPSALLSTLLFFSSIFLRSHAFRVPISDTDSLREVCSGMYGGKDAYIEVDFDQTSSGQVALIIYEWNDVQYLGAQTGDETRTYICTTSAVRSGLCSNAQLGSFLTSFPDDVSAESSSIFTTPLKFSNDYTPTPTTDEDDNNTLPTENEDQEETSTEVAEEPVQETDSVDADMDEDEADQEQAEQVEGLAEALGDGWQKRQVGDIVNRIVTGVAISDDESAEDSEDWTETGSSTADSDSTSTAPVSVPVFSAPITYAVPKTGYYCVGIVPVTLVNSRDSVRERQATHAEYSGMVLFRNNFAGELPAVEYPKIHFYFALSIVYFVLGCGWAYLCSKHHRELLPMQYYISGTIVFLIIEMLAQFAYYRYINKHGGGTASLAFLFVIAVLNAARNSLSFFLLLIVCMGLSVVTHSLGSVMNKVRLLTILHFIFGVLYSVGTVEVELDDASLFTVLLLIFPLSITLTAFLMWIIVSLNGTIMHLQARKQRHKLQMFQRLWRILVVSVIAVAAFFVVSSMSLSNRMNEDYTPNSWRYRWILLDGSLATIYLCAFTAIAYLWRPTRDNVRFSMSQELAQDEAEADAEDYEIEALENGHGRGLGGHQQLSQHDDEDYNEDERKGLVRNGVGEENVVFAMGDDSDEEEDHVHGHGRTEYRDSEEVGRSSEAKSKDRGKDD

SEQ ID NO: 7896 - protein, 402 aa, Erwinia carotovora subsp. atroseptica SCRI1043
MGSEVGSVYIASTADTKGNEQIYVRDLIIATGLKTVTVDLSTHSRMSNTTDISAETVASYHPQGASVVFCHDRGQAISAMAIAFEHFMLSRDDIAGVLGLGGSGGTALITPAMQALPIGMPKLMVSTMASGDISGYIGASDISMMYSVTDVAGLNRISRQVLGNAAHQIAGAVKFHIHEHHEDKPAIGLTMFGVTTPCIQEASKLLEAEFDCLVFHATGSGGKAMEKLVDSHLLTGVLDLTTTEVCDLLFDGVLACGPERFDAIAKTQVPYVVSCGALDMVNFGAPASVPEKYAHRLFYNHNAQVTLMRTTIDENIAMARWIGEKLNRCEGEVRFLIPEGGFSALDAPDQAFWHPEARDAFIRTLESVVQQTARRQIIRLPFHINDPLFAHGAVDAFRALLK

SEQ ID NO: 7897 - protein, 477 aa, Coxiella burnetii RSA 493
MLRSTKIIATLGPATDDLSILEEIIHEGVDIIRLNFSHGTHEKHKQRIEMVRKAAKKQERVIGILADLQGPKIRISSFKTGKINLKKGELFILDAGLPPEEGTEKSVGIDYKNLPKDVKAEDILLLDDGRLTLKVQNVKGEQIICRVVEGGALSDHKGINRLGGGLSAEAMTEKDINDLKFAVDFDVDYVAISFPRDAQDILKAKHLVQGYKGKAGIIAKIERTEAVKNIDAIIEASDGVMVARGDLAVEIGDAQVPLVQKDIIHRARSMDKPVIIATQMMESMIHATVPTRAEVSDVANAVLDNTDAVMLSAETAVGDYPVLAVAAMARTCVVSESQPRSHISRHRVECRFKRIDEAIAMATMYAANHLDIKAIITLTESGITPLWMSRIRTAIPIYGLSRFDKSLGRMTLYRGVYPIKFDPTQYTRDEINVKAVETLQSQDLLKNGDLVVLTKGDYMGVGGGSNAMKIMVVGKVV

SEQ ID NO: 7898 - protein, 277 aa, Erwinia carotovora subsp. atroseptica SCRI1043
MMSGINRQELLAKFRAMIARREPIIGGGAGTGLSAKCEEAGGIDLIVIYNSGRYRMAGRGSLAGLLAYGNANEIVVDMAKEVLPVVKHTPVLAGVNGTDPFCQFDKFLDDLKALGFSGVQNFPTVGLIDGNFRANLEETGMGYALEVDMIRLAHEKGMLTTPYVFNAEDAVAMTKAGADIIVPHMGLTTGGNIGAETALNLADCVPLINHWADAAKAVRKDVIVLCHGGPISTPQDAQFIMDHCPQCDGFYGASSMERLPTEIALTATTQQFKKIKR

SEQ ID NO: 7899 - protein, 212 aa, Ashbya gossypii ATCC 10895
MTSPCTDIGTAIEQFKQNKMIIVMDHISRENEADLICAAAHMTAEQMAFMIRYSSGYVCAPMTNAIADKLDLPLMNTLKCKAFSDDRHSTAYTITCDYAHGTTTGISARDRALTCNQLANPESKATDFTKPGHIVPLRARDGGVLERDGHTEAALDLCRLAGVPEVAAICELVSERDVGLMMTLDECIEFSKKHGLALITVDDLKAAVAAKQ

SEQ ID NO: 7900 - protein, 356 aa, Xanthobacter autotrophicus Py2
MKAARFHARRDVRVEDIPTPTDQPAPRQVLVKNRFCGICGTDLHEYAAGPIFIPTQPHPYTGAKAPQILGHEYGGTVVAVGSSVTNVAVGDRVSVQPMVSPRDDYFGQRGLYQLSESLAIIGLAWPWGGMAEYSLVNDYNVFRVPDSVSDAQAALIEPTAVTVYAAERGGVKPGDSVLVTGAGPIGQLQVLAARAAGATRIFLSDTNDNRLAMARQILPDVITLNPRSDKVPEAIRDQTEGGVGVDVALECVGAEAALGTCIEAVRRQGVVVQVGLHVGKPAVDGFTVTFKDIDVRGSWCYTTLMWPRVAALIGSGILPAEKVVTRRIRLDEVVENGFEALLSPAGTELKILIDLQ

SEQ ID NO: 7901 - protein, 398 aa, Pylaiella littoralis
MALKKKEFNKKLKHFTINFGPQHPAAHGVLRLILELNGEVVQRADPHIGLLHRGTEKLIEAKTYFQALPYFDRLDYVSMMCQEHTYALSVENLLQVSIPRRAQFIRVLFAEITRILNHLLAVGCHAMDVGAMTPFLWAFEEREKLMEFYERVSGARMHASYFRPGGVSQDISVGLVDDIFAFVAQFGQRLDEIEEMLTDNRIWQERLVDIGVVSAQEAIDWGFSGVMLRGSGIRWDLRKNEPYEIYSDLNFQGVVGKTGDCYDRYLARVEEMRQSLSIIYQCLNKMPRGSVKIDDAKISPPSRSEVKQSMESLIHHFKLYTEGVFVPAGETYTATEAPKGEFGVYLVSKGSSRPYRCKIKAPGFSHLQGLNFMACSHMLADVVTIIGTQDIVFGEVDR

SEQ ID NO: 7902 - protein, 471 aa, Aeropyrum pernix K1
MLVYPQLEHPWIPNSHKAILDEMLEAIGVSSVDDLYRDIPPTILLSPEEWDSLPIGEGRPLSEAEVLARINDILSRNKYFTDPPPFVGGGVWPRYVPSVVKALITRGEFLTAYTPYQAEISQGLMQALFEYQSLVAELLEMEVVNASLYDWSSAVGEAMLMARRVTRRNRVLVPETMNPLHLETATTYAYGGGIRVEKVRVDRETGFIDLEDLESRLSQGDTAALYMEYPSSYTGVIDENVEAAGEAVHKAGGLFILGVEPVSMAILKPPGRLGADIAVGDGQPLGLGLNYGGPYLGVFAVRWDGRLVRQMPGRLIGMTVDAEGRRAFAMILQTREQHIRRAKATSNITTNEALMAIAAAVYLSLLGPQGLREVAEASWYMSHYAAKRLSELRGVEAPLLEGEFIMDFTVRLPMDAGVARRRLLEKGVLAGIPLGGFSFFSDNDMLLTVTEAHTRRHVDLLVNLLDSVLGG

SEQ ID NO: 7903 - protein, 467 aa, Roseovarius nubinhibens ISM
MAKRFAKRFGRNNKGPLMLSFDTLKDQVADGSVDTVLACLVDMQGRLMGKRFHAGHFIASAWEETHCCNYLLATDLEMATPEGFASTSWEQGYGDYVMKPDLTTLRPVPWLEGTVMVLCDVLDHHTHEPVPHSPRAMLKKQLARLDAMGFDAMMATELEFFLFEKSFEELRKDGYRDLQPYSGYNEDYNIFQTTKEEHVMRPIRNHLWNAGIPIENSKGEAEAGQEELNIKYAAALDTADYHTIAKHAVKEISWQQGHAASFLPKWHHDKVGSSSHVHQSLWKEGKPAFYDANDPLGMSELMKHYMAGLLKYAPDMTYFFAPYINSYKRFVKGTFAPTRIIWSVDNRTAGYRLCGEGTKAVRVECRVGGSDINPYLAMAALLAAGIAGIEEKLSLPAPFKGDAYGEDTGLIPGNLRDAREALLGSSMLRKALGEEVVTHYARAAEVELEDFDRIVTDYELKRGFERV

SEQ ID NO: 7904 - protein, 444 aa, Zea mays
  misc_feature (86)..(86): Xaa can be any naturally occurring amino acid
  unsure (1)..(444): unsure at all Xaa locations
MREQQRAMDPCPFVRVLVGNLALRMPVAPPASGAGAGVHPSTSACYCKIRLGKMPVQSVPAPLVVTDGGEQTPASGALAAAFHLSXDDLEWFDGKPSLFSSRRGAGEASLKVSVYAGRKGSACGVSSGRLLGKATVPLDLKGAEAKPAVLHSGWISIGKRAGKGSPAAAAELCLTVRAEPDPRFVFEFDGEPECSPQVLQVRGSMRQPMFTCKFGCRSNSDLRRPGMRRERDAKERKGWSVTVHDLKGSPVAMASMVTPFVPSPGTDRVSRSNPGAWLILRPAADGAWEAWARLECWRDRRGAGASDSLGYRFDLLVPGVDHAAVALADSSIPSSKGGKFAIDLTAAQPLSRGGTPGCSPRGSGDLSPLPLGNYRGFVMSALVQGEGRCSKPTVEVGVAHVGCAEDAAAFVALAAAVDLSMDACRLFSHRLRKELSHPQADLLR

SEQ ID NO: 7905 - protein, 275 aa, Neisseria meningitidis serogroup B
  misc_feature (1)..(1): Xaa can be any naturally occurring amino acid
  misc_feature (12)..(12): Xaa can be any naturally occurring amino acid
  misc_feature (21)..(21): Xaa can be any naturally occurring amino acid
  misc_feature (33)..(33): Xaa can be any naturally occurring amino acid
  misc_feature (40)..(40): Xaa can be any naturally occurring amino acid
  misc_feature (49)..(49): Xaa can be any naturally occurring amino acid
  misc_feature (65)..(65): Xaa can be any naturally occurring amino acid
  misc_feature (80)..(80): Xaa can be any naturally occurring amino acid
  misc_feature (105)..(105): Xaa can be any naturally occurring amino acid
  misc_feature (111)..(111): Xaa can be any naturally occurring amino acid
  misc_feature (120)..(120): Xaa can be any naturally occurring amino acid
  misc_feature (129)..(129): Xaa can be any naturally occurring amino acid
  misc_feature (180)..(180): Xaa can be any naturally occurring amino acid
  misc_feature (215)..(215): Xaa can be any naturally occurring amino acid
  misc_feature (218)..(218): Xaa can be any naturally occurring amino acid
  misc_feature (234)..(234): Xaa can be any naturally occurring amino acid
  unsure (1)..(275): unsure at all Xaa locations
XSLITVNTLQKXKAAGEKIAXLTAYESSFAALXDDAGVEXLLVGDSLGXAVQGRKSTLPVSLRDXCYHTECVARGAKNAXIVSDLPFGAYQQSKEQAFAAAAELXAAGAHXVKLEGGVWXAETTEFLQXRGIPVCAHIGLTPQSVFAFGGYKVQGRGGKAQALLNDAKAHDDAGAAVVLXECVLAELAKKVTETVSCPTIGIGAGADCDGQVLVXHDXLGIFPGKTAKFVKNFXQGHDSVQAAVRAYVAEVKAKTFPAAEHIFADEGGSHHHHHH

SEQ ID NO: 7906 - protein, 161 aa, Triticum aestivum
  misc_feature (58)..(58): Xaa can be any naturally occurring amino acid
  misc_feature (79)..(79): Xaa can be any naturally occurring amino acid
  misc_feature (83)..(83): Xaa can be any naturally occurring amino acid
  misc_feature (95)..(95): Xaa can be any naturally occurring amino acid
  misc_feature (117)..(117): Xaa can be any naturally occurring amino acid
  misc_feature (123)..(123): Xaa can be any naturally occurring amino acid
  misc_feature (128)..(128): Xaa can be any naturally occurring amino acid
  misc_feature (148)..(148): Xaa can be any naturally occurring amino acid
  unsure (1)..(161): unsure at all Xaa locations
LAGTNGETTTQGFDDLGKRCAKYYEAGARFAKWRAVLKIGATEPSQLSIDQNAQGLAXRYAIICQENGAGCPLLSLRSXVDGXHDIDRCAYVTEXLLAACYKALKRPHSSFEGTSLXPNMAPXVPTPXSGPEVISDTPSDLQKDLPAXSPHSLRGEEPGTP

SEQ ID NO: 7907 - protein, 394 aa, Aeropyrum pernix K1
MSWAKGSRIRDYRGREYIDFHMAFGAVALGHNDDDVAARVSEQLNRLVLHGAGVSDAEIEFAKMLIRKFPMYDKVLFTNSGSEAVMMAMRLARAYTGRDVVVKFDGNYHGWHDYSIYNIKNPASKGKTVESKGVPSATASTVEVLPYNDVDALEDYAERFGDRVAAYILEPVAHSMGVIPAEKGFVERLRKLCDTHGSLLIFDEIITFIRASDRGMQDYFGVRADLTTVGKAIANGMPVAAVLGGDNVMELLARGVVSSGTYSGHPLSMAAGVATLEKAEDVGLTRALRSRAEALAGILRDISEDLGVEAAVSQFGGSVSIYFGIDRRPKNLEEALRANGDAYRVFAREMRRRGILVTPNPLKRMHLAYSHSEEELEAFHRAAEEAVRVAKEYL

SEQ ID NO: 7908 - protein, 418 aa, Chromobacterium violaceum ATCC 12472
MNVQSNPFLFESAALSHLPGFGAVRSTQLAGYLSVGDSAGGWLYFCFSEAGDHPEQAPLLVWINGAPEWSALDALLDEHGPYLLDPSGRIYSNPFGWHHHVNLLIIEQPLGHGLSFTTHPRYLPESHDEASLQLYHALQEFLLRWPRYRERDCYLFGNAAATHTIARLAHRVLDGNSGGQPQISLKGLGLGNAQLAPDIQLPSHIDYAYQHRLINLDERNHAQAGLDEFNRAHASPIALQQQSAGRIAVGIERYIQQCCGRDLHDIRHPPQKPSKALSEYLKKPSVQQALHIDPRSNNELQPHSSLMTEAIWQESSSHLLPMLLDQLKVLFFHGECCMTGNYLGLDAWFNTQSWSQADAFRRQKRQAWRPYGLAAGLIRSHGNLSQIIIQNAGLRVARDQPAAAQAMLRDFLAGDAPQ

SEQ ID NO: 7909 - protein, 334 aa, Coxiella burnetii RSA 493
MSFNIAINGYGRIGRNILRALYESGKNKDLKIVGINDLGDIKTNAHLTKYDSVHGRFSGEVGVSGNSLVINGDKIEVCAIRNPEELPWRNLEVDLVLECTGLFTSKEKAEAHLKAGAKKVLISAPAGNDVKTIVFGVNENIISSDDEIISNASCTTNCLAPLVKVLNDEIGIERGLMVTVHAYTNDQNLTDSYHKDLHRARAATQSMIPTKTGAAAAVGLVLPELDGKLDGYAIRVPTINVSVIDFTFDAKKLVSASDVNAMMKKAAQGKMKGVLGYNDEPLVSIDFNHDPHSSVFDAGQTRVIDQLVKVVSWYDNEWGFSNRMLDTALAFLKA

SEQ ID NO: 7910 - protein, 460 aa, Lactobacillus plantarum WCFS1
MKITNADGTIRALSNRHVQMIAIGGTIGTGLFLGSGSTISKTGPSVMWVYLVLGFFFFLMMRAIGEMFYSDPTQHTFVAFISRYLGPSVGYFTGWTYWIGLIFVCMAELTATATYVKFWLPNVPAWLIEISFLLILAGVNLTAARLFGEAEFWFAMIKIVAIIALIITGIFMMVGHHPTPLGQASIGNLFHNYQVFPNGIANFISAFPMVFFAFQGIEFVSITIGEAKNPHRVIKKAVNETLLRILLFYIGALIVIMGIIPWTSLSPDSSPFVQVFKLAGYPAAAAIINFVVLTSAASSLNSCLFSAGRHFYQLATEMPVTSRMHQIFGQISKSGVPAAAIVLSAILVLVTPIMSLSAATTAVFTVVTGISSDMYLIVYTLAMLAHRKYRLSNDYLADGFKMPAYRITSPLTIAFFVLIFASLFFIQADIVGAIGAIIWTLLFGGITFAHQARLRAVTRS

SEQ ID NO: 7911 - protein, 582 aa, Oryza sativa
  misc_feature (161)..(161): Xaa can be any naturally occurring amino acid
  misc_feature (189)..(190): Xaa can be any naturally occurring amino acid
  misc_feature (195)..(195): Xaa can be any naturally occurring amino acid
  misc_feature (207)..(207): Xaa can be any naturally occurring amino acid
  unsure (1)..(582): unsure at all Xaa locations
EEERSPAGGAAVAVYGESLRRPEEEGGRRKKGGWITFPFMAVSLLAFGLSSAGAMGNLVVYLVKEYHVPSVDAAQISTIVSGCISVAPVAGAIVPDAFFGCFPVVAVAMVFSVLALVVFTLTASVRGLTPAACVPGATACEAATAGQMAVLYAGVFLLCVXSAGARFNQATMGADQFEAAAERDVFFNXXFIFFXASAWLGFNVLVXVQDAVSWELGFGLAATIAAAGLAALLLGARYYRRPAARGSPFTGIARVVVAAARKRKIDVAAAAAASGDLKFYYGPRSGGLQEFGTRPSDDNNFAPSDSFSFLNRAAVITDGDVDAADAAAPLRPWRVCTVRQVEDLKAVLRILPLWSSSIFLSISIGVQLNFTVLQALAMDRAIGRFHVPAASMVVSSFVAVVVSLGLIDRALLPLWRALTGGRRAPTPLQRIGVGHVLTVLSMAASAAVERRRLATVRAHGEAARDDPAWVSPLPAAWLVLPFALSGAGEAFHFPAQVTLYYQEFPPSLKNTASGMVAMIVALGFYLSTALVDAVRRATAWLPDNMNASRLENLYWLLAVLVAINFGYYLACAKLYKYQNFGK

SEQ ID NO: 7912 - protein, 393 aa, Lactococcus lactis
MKKCSDFVLKMDESVTLAAANRAKALKAQGRDIIDLTLGQPDFPTPKKIGQAAIEAINNGQASFYTQAGGLPELKKAVQHYWTRFYAYEIQTNEILITAGAKFALYAYFMATVDPLDEVIIPAPYWVSYVDQVKMAGGNPVIVEAKQENNFKVTVEQLEKARTSKTKILLLNSPSNPTGMIYSKEELTAIGEWAVAHDLLILADDIYHRLVYNGAEFTAISSLSDEIRNRTTVINGVSKTFAMTGWRIGLAVGDPEIIAAMTKIASQTTSNPTAVAQYAAIEAFEENDKSFEKMHAAFEERLNKIYLQLSEVPGFELVKPNGAFYLFPKVTKAMAMKGYTDVTDFTTAILEEAGVALVTGAGFGSPENVRLSYATSLETLEAAVTRLKDWMND

SEQ ID NO: 7913 - protein, 530 aa, Synechococcus sp. WH 5701
MIVVVDDENRENEGDLICAAQFATPEQINFMATEARGLICLAMEGERLDALELPLMVDRNTDSNQTAFTVSVDAGPENGVSTGISADDRARTIQVAIHPASRPADLRRPGHIFPLRARQGGVLKRAGHTEAAVDLARLSGLYPAGVICEIQNPDGSMARLPQLASYARRHGLRLINIADLISYRLETERFVRRQAEAEMPSAFGQFRAIGYRNELDDSEHVAIVKGHPELASGPVLVRVHSECLTGDAFGSLRCDCRPQLEAALRMIEAAGEGVVVYLRQEGRGIGLINKLKAYSLQDGGLDTVEANERLGFPADLRNYGVGAQILSDLGVHHLRLITNNPRKIAGLGGYGLRVEDRVPLVMDPGQHNAAYLLTKQTKLGHLMHSGPAREHTGAGGPTAVISWSATTMAPEQAEAEHWPQLRQWASQRGLELLREEHPRLLALLGQPQLALLLAQQAGGDQRLAEADLLSALTLMAGWAGTRAVSLLLSPDAQRSAHPSSTLEPERRPLQELTQVSPQLVTTPGAFVRWG

SEQ ID NO: 7914 - protein, 481 aa, Chlamydophila caviae GPIC
MIARTKIICTIGPATNTPEMLEKLLDAGMNVARLNFSHGTHESHGETIRLLKELREKKGAPLAIMLDTKGPEIRLGNIPTPIQVSRGQKITLVGKEVEGSAEGGVTLHPQCVFPYVREGVDVLIDDGYIQAVVTSVGEDHLELEFINSGELKSHKSLSIREIDLALPFMTDKDINDLQFGVAQGVDVIAASFVRYAEDIESMRKCLADAGRPDMPIIAKIENRLGVENFSQIAKASDGIMIARGDLGIELSVVEVPNLQKFMAKMSREMGRFCITATQMLESMIRNVLPTRAEVSDVANAIYDGTSAVMLSGETASGSYPVAAVKIMRSVIQETEKNLNYKSFLELSDSECAVKVSPYLKSIGLSGIQIAEKADAKAIIVYTESGGSPIFLSKYRPRFPIIAVTPNLSVYYRLALEWGVYPMLTQESDRAVWRHQACIYGIERGILSNYDKILVLSRGAQMKDTNNLTLTTVNDIITASAK

SEQ ID NO: 7915 - protein, 283 aa, Mycobacterium sp. JLS
MTSTRGEAAGIPSVSLNDGHSIPVLGLGVGELSESEAERSVAAALEAGYRLIDTAAVYGNEAAVGRAVNASGIPREEIYVTTKLAVADQGFGTSQDAARASLERLGLDYVDLYLIHWPAGDHGKYIDSWGGLMKAKQDGVARSIGVCNFNAEHLSNIIDLSFFTPAINQIELHPLLNQAELREVNAGYGIVTEAYGPLGVGRLLDHAAVTGVAQAHDKTPAQVLLRWSIQLGNVVIARSANPDRITSNLEVFDFELTDDEMATLNGLDEGTRFRPDPETYTGP

SEQ ID NO: 7916 - protein, 471 aa, Burkholderia mallei ATCC 23344
MSKTVADVMQLAKDEDVKFVDFRFTDTRGKEQHVSVPVSAFGEDKFESGHAFDGSSIAGWKGIEASDMLLMPDPNAAFIDPFYEESTLVLTCDVVEPADGKGYERDPRSLAKRAEAYLKSTGIGDTAYFGPEPEFFIFDSVQWNTDMSGCFVKINSEEAPWSSAKEFEGGNTGHRPGVKGGYFPVAPVDQFQDMRSEMCLLLEQIGIPVEVHHHEVAGQGQNEIGTKFSTLVERADWTQWAKYIIHNVAHSYGKTATFMPKPVVGDNGSGMHVHQSIWKDGQNLFAGNGYAGLSETALFYIGGIIKHARALNAITNPTTNSYKRLVPHFEAPVKLAYSARNRSASIRIPHVSNPKGRRIETRFPDPMANPYLCFSALMMAGLDGIQNKIHPGEAADKNLYDLPPEEDAKIPTVCAGLDQALEALDKDREFLTRGGVFTDAMIDAYLGLKEQELAKFRMTTHPIEFEMYYSL

SEQ ID NO: 7917 - protein, 974 aa, Ustilago maydis 521
MPRFLVPRAADSVIGGADPTKFETSNPLRLFIIQAAIIIIVTRVLGFALQKIRQPRVIAEVIGGILLGPTAMGRIPGFTQHIFPPPSLPYLNLVSTLGLVLFLFLVGLEVDVRVVRRCAKPSIAISVAGMILPFGLGAAVSVGIYNSFIDKNNVSFGHFVLFTGVAMAITAFPVLARILTETKLLYTKVGVIVLAAGVGNDVVGWILLALTVALVNADTGLTALYILLCAVGWVLILFLVIKPALIWLARRTGSFENGPNQVMIMITLLLVLVSAWITDIIGVHPIFGSFLVGLMVPHEGGYAIALTEKMEDLVLVIFLPIYFALSGLKTNLGDLNSAKAWAYTVAIIVIAFFSKFIGCAAAAKAFGFNLRESAAVGTLMSCKGLVELIVLNIGLSAGILDTRVFSMFVLMAVVSTVITTPLTLWVYPESHRTRLDDASIHSHHAHKITTGEEEEKDQDTSSRLSPKRLLVVLTSFEHLPGLMTLVQLMQPTLAAANTSSSDSTASHGLRHRRSKQTCSASEGEATEKATETGDEDDPSINGAEYQTPVLASEAPYASATAARWHAQISIDALRLVELTDRTSAVMKVSESEDTMRADPIINVFQTFAHLNRLPVQSTMSVIPQEEFATAVTRRCKAAGSNFIILPMTLAQPSANAHSGGAAASGSGAQDAAVAGPSSPLAATLSNPLESLFGGGWASAPSEGLKGRYSAQHFNVVRKIIQTAETDVGLLIEHKAALGNHGVQQPPFSRLGEQPILLAFMGGPDDRAALDLVARLCANNRQLSVLVVRMNRISSEEAGEDQLPTVPPTVHHELSLSYAQQAALRVGGSNMDTLYPTQHSGARSGAPLQSALEATLEDDLALQRIQDQIAADRFSGRLSIETVCTARPLRQLIELAEKHQPALVVVGRGRRNPTQTHRDELKAMIRQRSAAADAVDRQLNSEITKVIGEAATSLTFVNAPSSTLVIAAGWSVASS

SEQ ID NO: 7918 - protein, 438 aa, Synechococcus sp. WH 5701
MTSAPVSVPALNTSRSQDLFSAAQTLMPGGVSSPVRAFRSVGGDPIVFDRVKGAYAWDVDGNRYIDYIGSWGPAICGHARPEVIAALHEALDKGTSFGAPCALENTLAEMVIEAVPSVEMVRFVNSGTEACMSVLRLMRAFTGRDKLIKFEGCYHGHADMFLVKAGSGVATLGLPDSPGVPRSTTTNTLTAPYNDLEAVKQLFADNPGEIAGVILEPVVGNAGFITPEPGFLEGLRELTTEHGALLTFDEVMTGFRISYGGAQARFGITPDLTTLGKVIGGGLPVGAYGGRAEIMAMVAPAGPMYQAGTLSGNPLAMTAGIKTLELLKQPGTYERLEAITKRLSDGILAAGREAGLPICGGSISAMFGFFLCEGPVRNFEEAKATDSQRFGRLHRAMLERGVYLAPSAFEAGFTSLAHSDADIEATLRAFRDCFAAIA

SEQ ID NO: 7919 - protein, 233 aa, Synechococcus sp. WH 5701
MTCAEARAYASAFLPLLGNLPSDREVVLAPPFTAIAALSEALEGSAVKIASQNVHWDDVGAYTGMISAPMLLEHGVSHAIVGHSEPRKYYSETDEQINLRARTAQKSGMIPILCVGESDSQREAGEAERVIRRQVDQGLEGLDPTQLVVAYEPIWAIGTGKTCGAEEANRLCALIRGWVGYEDVVIQYGGSVKAENIDLLMAQPDIDGVLVGGASLDPTGFARIARYQVPVAA

SEQ ID NO: 7920 - protein, 262 aa, Rubrobacter xylanophilus DSM 9941
MRRVGVIGAGKIGGSLLSRLAESGDFELAVSDVHPEQVERFRRYDRVRPASSNLELAEASEIVIVAVKPWDVAGVLEEISPAMGSGGRSVTSVAAGVEIRTIESYLPEGTPVLRVMPNVCASVGLGAAVITANEPGRRVLPEVMDIFGRVGEVMELPERLFDAATALHGSGPAYVALFADALIQAGVREGLPREVARRLVVGTLAGTAVLLKDRSAHQVRDEVMTPGGTTAAAFVAMEKAGFVGAVYDGVNAATRRARELGG

SEQ ID NO: 7921 - protein, 265 aa, Magnaporthe grisea 70-15
MKAVVFEGPYKISVQDRPVPQLQDDKDIIVKVHASGLCGSELHSYRGIEESGSGFIMGHEFTGTVTEVGSAVKTVQTQTSRCEHSQLFGSAGLDGGQAEYVRVPFADGTVVKAPAEFAEDDKVLVLMADIWPTGYFGASNAFKLLEATPDPVVVVIGCGPVGLCAVVAALEHKPKHLFAIDGVDSRLDLARGLGAEPLNFVTDREGMFKRIMEVTGGRGVDAVVEVVGLKDALRTAFDILRPFGVISSIGVHSTELPWTAAEAYE

SEQ ID NO: 7922 - protein, 176 aa, Triticum aestivum
  misc_feature (164)..(164): Xaa can be any naturally occurring amino acid
  unsure (1)..(176): unsure at all Xaa locations
MAPTVMASSATSVVPYQGLKSTAGLPVSRRSNGASLGSVSNGGRIRCMQVWPIEGIKKLETLSYLPPLSTEALLKQVEYLIRSKWVPCLEFSKVGFIFREHNTSPGYYDGRYWTMWKLPMYGCTDSTQVINEVEEVMKEYPDAYVRIIGFDNMRQVQCVSFIAXFKPPGCEESGKA

SEQ ID NO: 7923 - protein, 596 aa, Cryptococcus neoformans var. neoformans B-3501A
MIPPLDDSSLVKAADKAWWKSATVYQVYPASFCDHADAGHGTLLGILTKVDYLQSLGVDIVWLSPIYESPQADMGYDISNYRQIDKRYGSLEDWDRLLAALHQRGMKLVMDLVVNHTSDQHPWFKESRSSRDNPKRDWYIWRPPRYNEKNERIPPNNWKGTFGQGSAWEFDETTNEYYLHLFLKEQPDLNWENPQVRAEVYDLMHWWLKRGADGFRMDVINFIAKAPGLPDAPVIDPGRTYQSFGMMSINRPEVHGWLKEMNRAVLSHYDCFAVGECPGDEAVVSYAPYSVPHNKELQMVFHFHHQSFDRAAGGLGRVHNPDWKLSELKRVFNTWQIEMAREGVLRITTSLGSSPGWHLTILRTGHGQELGMINVPRGWGLVEYKDVETIQNSEAEVQHRQVMCGHANPDISDLLESNRITARDNGRTPMQWDSSLNAGFSKGEPWMRIHDDYREGWNAAAQVNDPDSAWSFWKQMLRLRKKYDAMIYGKHKPSPFDSEGTINHPATQGDFIALDESNEETYAYIREHPPSGQKLLVVLNLSRGNDGRGAPSTFVLPSGLDTSGSKLLISNGEVQEGQRIEGNILLGPWEGRIYLL

SEQ ID NO: 7924 - protein, 358 aa, Glycine max
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 7925 - protein, 383 aa, Oceanobacillus iheyensis HTE831
MEHLLNQQVQNIEISGIRKFFNLVSNEKDIVSLTIGQPDFYTPHAIKQASINAVNNNHTTYTANAGVIELRKAIANYYESRYQIPYHPESEIIVTAGASEAIDITLRTILEPGDEVILPAPIYPGYEPLITLARAKPIHMDTTKTNFKITKSQLEETITEKTKCIIIPSPSNPTGAAYTKKELDEIVSVLKDKKLFILSDEIYSEIIFDQPHVSIASYPEMRDQTIVINGLSKSHSMTGFRIGYALAPHWLSKHMLKVHQYNVSCASSISQYAALEAFNSNDDHLQLIKDTYKSRRDLVYNRLTSMGIDVQLPEGAFYMFPRFPMRNENSFEFGLTLVKQAKVALVPGNSFSQYGEGFMRLSYAYHEDVLNKGLDRIEKFLNQ

SEQ ID NO: 7926 - protein, 483 aa, Zea mays
  misc_feature (415)..(415): Xaa can be any naturally occurring amino acid
  unsure (1)..(483): unsure at all Xaa locations
MGSDADMEDYGFEYSDEEPEEQDVDIENQYYNSKGLVETDPEGALAGFDQVVSMEPEKAEWGFKALKQTVKLYYKLGKYKEMMDAYREMLTYIKSAVTRNYSEKCINNIMDFVSGSASQNFSLLQEFYQTTLKALEEAKNERLWFKTNLKLCKIWFDMGEYGRMSKILKELHKSCQREDGSDDQKKGTQLLEVYAIEIQMYTETKNNKKLKELYQRALSIKSAIPHPRIMGIIRECGGKMHMAERQWDEAATDFFEAFKNYDEAGNPRRIQCLKYLVLANMLMESEVNPFDGQEAKPYKNDSEILAMTNLIAAYQKNDIMEFEKILKSNRRTIMDDPFIRNYIEDLLKNIRTQVLLKLIKPYTRIRIPFISQELNFPEKDVEQLLVSLILDNRIQGHIDQVNKLLERGERSKGMXEVQCHRQVEYSAQVHLPNIVQQSLMRRIVAAVCFAHLELLIACFGDLRATAKKSCMATLAVESWIWVK

SEQ ID NO: 7927 - protein, 374 aa, Oryza sativa
VDTIEPYPASRRFSPPLISSLCLVVLASPLAMGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKGYRSVMSASEGKLKGIIGYVEEDLVSTDFVGDSRSSIFDAKAGIALNDNFVKLVAWYDNEWGYSNRVIDLIRHMAKTQ

SEQ ID NO: 7928 - protein, 315 aa, Mesoplasma florum L1
MSAEFNWFPGHMNKTLKNIEEKIPVVDLVIEILDARAPYSSRNLTFSKILKNKPILYVLSKADIADPNITKEWVEFYEKKNNTVMVLDDKQKNIVKPLIDLINKATKEKQEKDKAKGMVNSLINVLVIGIPNVGKSTFINRLIKNKSVKAGNKPGLTRGIQLIHLSQFISLLDTPGVLPAKLENETVATNICAINSIKEDVYPKERVAGKLMQYLFNHYEGLIENHYKISPRLQRPIQITDTFIIFEMIAKVRKWYMNDDLLDYDRVIDAFMRDIIANEFNKVSFERILEVVPEEMEKASKIKNEKAIEDISDLW

SEQ ID NO: 7929 - protein, 304 aa, Zea mays
MAATSTFLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 7930 - protein, 55 aa, Triticum aestivum
  misc_feature (2)..(2): Xaa can be any naturally occurring amino acid
  misc_feature (10)..(10): Xaa can be any naturally occurring amino acid
  unsure (1)..(55): unsure at all Xaa locations
GXAESWVGPXGQYYRELPCPNCRGRGYTPCKKCGIDRSSLDCPMCNGKVTLPNLL

SEQ ID NO: 7931 - protein, 581 aa, Lachancea kluyveri
MSFIQDSYRKDLEKIVSNSNTTSKDVENLDLSNQDDISSQESHLNIDGKHDGIRLKKELEARHVSMIAIGGSLGTGLLIGTGTSLSLAGPVSILIAYSFVGFLVYIVMTCLGEMATYIPLDGFTSYASRYCDPALGFAVGYSYLFKYLIITPNQLTAAALVLQYWVSREKVNPGVWITIFLVIIVTINVVGVKFFGEFEFWLSSFKVLVMLCLIVLLFVIMLGGGPSHDRLGFRFYKDPGAFRPYSEAISGSKGKFVSFVAVFVYALFAYLGTELCGIVAAECKNPRRNVPRAIKLTLYRIVVFYLVTIFLLGMTVAYNDPLLLQAKKKSTSAAASPFVVAIKNAGIPVLPHIFNACVLMFVFSACNSDLYVASRSLYGLAIDNKAPKIFAKTNKWGVPYNSLILCILFCLLAYMNVSSGSAQVFNYFVNVVSIFGLMSWIAILITYIYFDRALRAQGVDKSTLAYAAPLASKGAYFALFFCCLIALIKNFTVFLGHKFDYKNFITGYIGIPVFIICFFGYKYIRGTKFVKPEEADLYTFKELIDLEEEEGKLWDAAQKEKMESSPKNFKWFYEKFLGWIF

SEQ ID NO: 7932 - protein, 168 aa, Prunus armeniaca
SQQWPPATCIRSKKPCSKHRALQNFTIHGLWPSNYSNPTRPSNCVGSHFNGSKLSPQLISKLRISWPDVESGNDTQFWEGEWNKHGKCSQEKLNQMQYFERSHDMWMSYNITDILKNASIVPHPTQTWTYSDIVSAIKSKTQRTPLVRCKRDPAPNKNAPNSQFFHEG

SEQ ID NO: 7933 - protein, 136 aa, Glycine max
DESVQIEVQPNGTLADDTGLTSNVFSMDNNEFDSDSPSAGFASIPEAIEDIRQGKMVVVVDDEDRENEGDLIMAAQLATPDAMAFIVKHGTGIVCVSMKEEDLDRLELPLMVNSKDNDEKLCTAFTVTVVCTTFLP

SEQ ID NO: 7934 - protein, 254 aa, Listeria monocytogenes
MRKPLVGINMKNYINTRAQTSEWLEATIPLLGNFSDVDTFIFPSMGTLETTANLLAGTSFGFGPQNMAPEKSGPLTGEFSVESIIDLSANYVEIGHAERKNLFHEKTSEIAKKIQLALDEKITPVVCVGEGIRANDTNELKNALKKQIEALFDTIQVTQFKNVVLAYEPEWAIGKANSADTDYIESAHQALREIIRELGGDETLVRIIYGGSVSKENAAEIVRQKNVDGLFVGRFGHKPQNFADIVSIVSKTKG

SEQ ID NO: 7935 - protein, 462 aa, Aeropyrum pernix K1
MKAHMPETGPQRDKDGQREGRVLVHYTDIAGYLRQVEVPLRNVEKEFVASFDGSSVYGFTPVEDSDLLLKHVPETLVSVPWRSGLWRVIATVYNATRERSPRDPRLAAETAEKIMSSMGYRVKAGAEIEFFIFDKIGVDVLNPARGLGYIVESREQPGGQDGIFGQVKKSYHMPEPPDSLLDYRLMLTETLQRFKVDVAVSHHEVAVSQVEVSIGSRTSLARLGDDIMTVKWVSKVLARMDGRVATFMPKPIFGDNGSGMHIHLSLWSPGGENLFAGHGDSDLSETALHFIAGILEHARSLSAILSPTTNSYRRLVAGYEAPVYVAWGWRNRSAMIRIPASAGNIDAVRIEVRSPDPTANPYLALAALFMAGLDGVKKKLAPPDPYEGNLYKISPEELREKGIKTLPRNLDEALDELESDNDYLKPAFTREMLESYIEVKRKESEDTRLYPHPIEVYKYLNL

SEQ ID NO: 7936 - protein, 133 aa, Zea mays
  misc_feature (64)..(64): Xaa can be any naturally occurring amino acid
  misc_feature (74)..(74): Xaa can be any naturally occurring amino acid
  misc_feature (96)..(96): Xaa can be any naturally occurring amino acid
  misc_feature (123)..(123): Xaa can be any naturally occurring amino acid
  unsure (1)..(133): unsure at all Xaa locations
STFIMIMPDYAQRPLLGEILLPFMRTTPSHLKDLMLGNAQRTFAEKTYADLPSWPFFHGLVDYXISGPVEAMVXDVYSVVTTGRNDIGGSHSPLAXSSPEHIRGNFAGNLGTNVIHGSDCIEXANLEIALRFP

SEQ ID NO: 7937 - protein, 230 aa, Pisum sativum
MEAMAVFSGSNLFATSSLLLTTNSKTRYSQLRTTQNLSAFSSKSHLFSPSSTSSSYPKTFRTRSSTESGIFLPRLITSLEQVDQAYIMVKPDGVQRGLVGEIISRFEKKGFKLTGLKLFQCSKELAEEHYKHLNQKSFFPKLIEYITSGPVVSMAWEGVGVVPSARKLIGATDPLQAEPGTIRGDFAVQTGRNIIHGSDSPENGEREIALWFKEGELCEWTPVQEPWLRE

SEQ ID NO: 7938 - protein, 457 aa, Prochlorococcus marinus subsp. marinus str. CCMP1375
MLFSPVISVLSTHDIEVAETLIGVIRFLLIFVAARTLAEILVRLSLPTIVGELLAGVLIGASGLHLLIPPSAHASLNNGLINIISSLASIPKEAVPDLYFETFPSLQAVATLGLYALLFLTGLESELEELVAVGTQAFTVAMAGVILPFAFGTLGLMFIFHVDLIPAIFAGASMTATSIGITASVFGELGYLKTREGQIVIGAAVLDDILGIVILAVVVALATGGSLEIAPIVKLVVAATVFVIAPIGLSRTAAPAFDWLLDRLKAPGAVVVASFVILVLSCFVATAIGLEAALGAFAAGLILSSSKNNHAIQQSVLPLVSLFATIFFVLVGAGMDLSVINPLDPASRSALIVAGFLLIVAIIGKIAAGWSFVIDKPTNRLVVGLGMMPRGEVGLIFLGLGTSAGLLTPSLEAAILLMVIGTTFLAPVLLRIVLKDKKPGGGNAIPDDIAADPVGLL

SEQ ID NO: 7939 - protein, 840 aa, Prochlorococcus marinus subsp. marinus str. CCMP1375
MSSSQPKDLRLPTPGCYADPIKAGIDADAVFDGMTEHLFFSLGKLATTASLRDLYMALSYAVRDRLMTRYLASQEAIRAKPQKTVAYLSAEFLIGPQLNNNLLNLGITKEAEEAVGRFGIESLSHILEVEEEPGLGNGGLGRLAACYMESLASLQVPAIGYGIRYEFGIFNQLIRDGWQVEVTDKWLKGGWPWELPQPDESCFVGFGGRTESYVDEKGKYRSRWIPSEHAIGVPHDIPILGYRVNNCDRLRLWRADATESFDFYAFNIGDYYGAVEEKVASETISKVLYPNDGTDEGRRLRLKQQHFFVSCSLQDMLRSLEKRGIEVEDFSEHWTVQLNDTHPAIAVAELMRLLIDHYHFEWEKAWHITTSSVAYTNHTLLPEALEKWDLDLFSSLLPRHLDLIYEINKRFLQQVRLRYPGNDLILRKLSIIDEDGCKAVRMAHLATIGAHHVNGVAALHSDLIKRQLMPEFAELWPEKFTNITNGVTPRRWVGLANPELSSLLDKEVGKDWITNMELLKKLEQKENDSGFLELFSKTKLSGKRKLAGYIHRQTGVLVDPSSLFDVQVKRIHQYKRQHLNALQVIAQYLRIKNGVDQDIAPRTVIFGGKAAPGYFMAKLMIRFINGIADVVNADPDMDGRLRVVFLPDYNVKLGEQVYSATDLSEQISTAGKEASGTGNMKFAMNGALTIGTLDGANIEIRDRVGSENFFLFGKTESEIVELRENQYDPKTYISNCKELSEALRLVEVGHFSNGDSELFLPLINSLTGSDPFFVMADFADYLRAQDEVNKVWKNPQKWNRMALLNTARSGFFSSDRSIKEYCKSIWKVKPLDVEISCDIN

SEQ ID NO: 7940 - protein, 289 aa, Glycine max
MGMADAKQRYAVVTGANKGIGLETVKGLASNGIKVVLTARDVKRGYQAVEELKREFGFSDLVVFHQLDVTDPSSVASLVEFVKIKFGRLDILVNNAGISGFNTDGMVPSKINWKELPQTYEMAEKCLTTNYYGAKETTEAFIPLLQLSNLPMIVNVSSEAGLLKYISNEWARSVLDDTENLTEELIDEVLKEYMKDLDDGLLEKKGWPTYLSAYMVSKAAMNSYTRLLAYRHQKLCINCVCPGSVKTDINRNTGILSVENGAASVVRLALLPNGSPSGHFFTRQEVSSF

SEQ ID NO: 7941 - protein, 407 aa, Oceanicola granulosus HTCC2516
MSATIYILSTADTKGEETAFLRERIEAQGGTAKVIDFGVMSEPTIPVDVTAGEVARAGGADLAALRAGRKREEASAAMTRGMIALLSGLHDDGKLQGVVGLGGTQGTAAATAVMRALPYGLPKVMISTMASGDTSGYVGNRDITMMFSVSDILGLNPFLRNVLNNAAGAVVGMADAAAKVSYRSERPVIGMTNLGVLTQGTMHAIGKLNEAGYEVIVFHAVGSGGAAMEAMMREGVVTAVFDYALGELTDQMFGGIRASDDSRMTVAAELGLPTVIVPGGADHIGVLVDEPDAVPERYAGRKVSWHNPVILVPRTSADEGRALMAELARRMRHARNCAILLPLKGVSSYSVEGGELRDPDADAALFEAAHAEFDGHLPVIDVDAAAEDPAFVERAIAELTGLIDRAS

SEQ ID NO: 7942 - protein, 285 aa, Oceanicola granulosus HTCC2516
MITARLDPKEFLKALRAKVAGREPVMIASAGSGLVAQILEEQGVDFINTFSGARLRSNGMGTMSMLWPILDSNEQTLRYTREDIMPAVRGKASICACLNANDPLKDMRVVLDDCLRMGVTSVSNIGPSVSYVDAGSEIKKVLTSAGITLDNEIEMLKLAREMGLITVGLAFTVEDSLRIVDEARPDVFCYHAGTTKGGRKGYDDGTTIADTARTTEEAYRAIRAVDPDVILLGHGAAMETPEDAQFMLDNTSGDGFWTGSSTERLPIERAVTEAAARFKSLKFSK

SEQ ID NO: 7943 - protein, 115 aa, Prunus armeniaca
YPRLRSKLKISWPDVENGNDTKFWEGEWNKHGRCSEQTLNQMQYFERSYEIWNLFNITNILKNASIVPSATQTWTYSDIVSNIKAVTQRTPLLRCRRNPAYNKSGPNSQFLHEVV

SEQ ID NO: 7944 - protein, 571 aa, Oryza sativa
APPHPHEIAPHTKLLHSSCAIDSYVLHSRACACMAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 7945 - protein, 103 aa, Vibrio vulnificus CMCP6
MIQEIIETKLHNTFEPSHLSVVNESYMHNVPPGSESHFKVIVVSDLFEGKRLIARHRLVNQALANELENNIHALAIHTYTVQEWKLQRDGAPDSPMCMGGTSH

SEQ ID NO: 7946 - protein, 721 aa, Candida albicans SC5314
MSYKRKSYNPSPLSSPKSNTSLRHDITVTSSEYNNSDEYEVEDNVPTIFLNQLATFPLFKNAPTSFHKQVAANLRLIHYRPQEFIIKKGDLSRSMYWILKGTVSVTSTDGEEVYAELNQGEFFGEIGILYNRPRTATVIAKTRILLGVLTAESLNRVLKNFPLIERRIRDEAQERLAMQDKKNKEPLSIQSFITNLPLFQFLPPDIIHKLALSVEPLVFSPFEYILRKGDTCGDIYFIIEGEVEVLNQEGVIEIPLARLSSGSYFGEMSFLNYLQNKPRIRTATIRSVTYCELMVIKSEYLEKLCDDYPTIIEDMKITAEERKVVKPAQGIFRPNWSINPTRTIPPQKRQRENENENVDYVPFTKRMRMASMKRRRSSALAIVEPLPETILMKIFGYLSLPDLMKLRRVSKRWRKMVTTTAPLEVLDLSQYSTTIDNKALIAITDFAGSRPRVIDISGCFHITDEGFSHMVNEIGIGGRLEVLRMASVWEVTGMAIMDLCFPGEKLEEIDLTNCRKVDDNVVQRLLQKCHLKVLNLSYCKGISDSVVPYFNNLESLDLTRCSGITDAGFAQLPFSPSLRKLSLKQCSYLTDNAIYSIANAARNLEILNLNFCCGLTDGSLSAIAMGFPYLREIDLSFCGSAVSDSSVASLSVLYYLERVLVRGCVRLTRAGLDTLFGGPCPLNFIDISQCRNAHVYPGNFPAPPFQSNLVRVSNKIIYIVV

SEQ ID NO: 7947 - protein, 276 aa, Bacillus halodurans C-125
MANNLQATTTLHNGVKMPWFGLGVFKVSEGDEVIQSVKDAIRAGYKSIDTAAVYGNEEGVGKAIAESGVPREELFITSKVWNADQGFDSTISAFNTSLKKLGLDYLDLYLVHWPVKGKYVETWKALEKLYQDGLVRAIGVSNFQVHHLKDVLEAGSIVPMVNQVEYHPHLTQTELHDFCKQNKIQLEAWSPLKQGQLLNDPTIVAIAEAHQKTPAQIILRWDLQNEVVTIPKSVKKDRIISNADIFDFQLTEEDMQKINELNKNERVGPDPDNFDF

SEQ ID NO: 7948 - protein, 334 aa, Pichia ciferrii
MAITVGINGFGRIGRLVLRIALSRKDIQIVAINDPFIAPEYASYMFKYDSTHGRYSGEVSHEGENIVIDGKKIRVYQERDPVNIPWGKDGVDYVIDSTGVFKELDSAQKHIDAGAKKVVITAPSSTAPMFVVGVNEDKYTPDLNIISNASCTTNCLAPLAKIINNKFGIEEGLMTTVHSITATQKTVDGPSHKDWRSGPTASGNIIPSSTGAAKAVGKVIPELAGKLTGMSLRVPTVDVSVVDLTVKLLKDATYDEIKAAVKEAAEGPLKGVVGYTEDQVVSSDFLTDNRSSIFDAEAGIWLSPRFVKLIAWYDNEYGYSTRVVDLLEYVASKN

SEQ ID NO: 7949 - protein, 144 aa, Oryza sativa
  misc_feature (103)..(103): Xaa can be any naturally occurring amino acid
  misc_feature (128)..(128): Xaa can be any naturally occurring amino acid
  unsure (1)..(144): unsure at all Xaa locations
MQVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTXMEVVAAQTKAIAEKISDWTNVVLAXYEPVWAIGTGKVATPA

SEQ ID NO: 7950 - protein, 783 aa, Arabidopsis thaliana
MGAKCCRGHRGSVVESNGSVILSLADLEVQATDLREMTVVEARDAAGPSEPRPPSPTLRPSEVEETSEPVCQGSLVETSNTDDAGPSEPNPPSPTLRPSEVEKIYVPVCQGSLAETSNLDQDGVSSYEASNIFWSTGSLSDPIPSGFYTVIPVERLMHFKSIPTLEEINALGEDRLKADAIFVDLKNDIQLVLIKEFVIKLVTGLDSDKVIKKIAGLVANIYKRKTLQSPARTLQYFDVQGFTLLGQIKHGSCRARAILFKVLADAVGLDSKLVMGFPTDLRFSASIDSYNHISAVVELNNVEMLVDLKRCPGQLKPFSPKAVYMAHISMAWQPDFVDNNPCASPLEPNSPMERSGPPSALQSGQAKALCTYKSNFCCFLSRSLGEPNIATEVLRRKVIKEPPPADFSGNSGAAESESKRTNGRATMMQSDLLKERGVDDSSPYSPDEKNVSGFQLDSHDLVSGECSTVYPRKSISLPSSPRSYQIQLSERSEHSPQEISHIWNEVLESPMFQNKPLLPFEEWNIDFSKLKVGASVGSGTSGVVCRGVWNKTEVAIKIFLGQQLTAENMKVFCNEISILSRLQHPNVILLLGACTKPPQLSLVTEYMSTGSLYDVIRTRKKELSWQRKLKILAEICRGLMYIHKMGIVHRDLTSANCLLNKSIVKICDFGLSRRMTGTAVKDTEAAGTPEWMAPELIRNEPVTEKSDIFSFGVIMWELSTLSKPWKGVPKEKVIHIVANEGARLKIPEGPLQKLIADCWSEPEQRPSCKEILHRLKTCEIPIC

SEQ ID NO: 7951 - protein, 454 aa, Burkholderia mallei ATCC 23344
MKNLQRHLSARHIRFLALGSAIGTGLFYGSASAIRLAGPAVILAYIVGGAAVYMVMRALGEMAVREPVPGSFGHYATENLGPFAGFVTGWTYTLEMVIVAIADITAFGIYMGFWFPHVPQWIWVLAIVAIICGLNLCHVKVFGELEFWLSIVKVGAIVAMIGGGAAILFTGMRLGSGGAPSLANLWSHGGFLPNGVGGLVASLSVVIFAYGGIEVIGMSAGEAKEPERVIPRAINAVPMRILLFYVLTMIVLMSIFPWTGVGANGSPFVQIFSALGVRSAAEILNLVVISAAISAINSDIFGAGRMMYAMALQGQAPRALAAMSARGVPWVTVLVMAGALLVGVVLNYLMPKDVFLMVAASATFATVWVWLMILLSQVAMRRRLGAAEVAALKFKVPFWPVGPALTIAFMAFVIAMLGYFDDTRVALFVGAAWLAILALVFYTRIRPRLAAVAR

SEQ ID NO: 7952 - protein, 459 aa, Nocardioides sp. JS614
MTTFGVEDPASLEIIAQVPDQGPDEARVAVDRAAAAFADWSRTSPRHRSDVLRRAFDLMMRDSEELTGLITSENGKSLVDAAAEVGYAAEFFRWFSEEAVRPSGEYGEAPTGGVRTIVTHRPVGVAALVTPWNFPAAMVTRKIAPALAAGCTVVLKPAAETPLTALAVGRILSEAGVPDGAVEIVTTTDAPGVVTAWLSDDRVRKVSFTGSTGVGRALLHQAADRVLNASMELGGNAPVVVTDDADLGAAVAGTMIAKFRNSGQACTAANRIFVHNDVAFDFVARLGAAVEKLSVGPAIDGAAIGPLITQAALQRVTEAVDFAVREGARISHQAQLPEAPGYFFPPTVLAGLAPDATILREEIFGPVAPVVVWHDEDELLELVNDTEYGLAAYVFAGDIGRAVRLGERIDAGMVGINRGLVSDPSAPFGGVKQSGLGREGAREGLREFQETQYLSVDWS

SEQ ID NO: 7953 - protein, 273 aa, Arabidopsis thaliana
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYLDEDLQVGRDGKGNVFVLERIEKP

SEQ ID NO: 7954 - protein, 334 aa, Flavobacteria bacterium BBFL7
MSKKLKLAINGFGRIGRIVFRATLERANVEVVAINDLVDVEQLAYLLEYDSVHGRYGGSIEIKDGNLIIDGVQVRVTSERDPKNLKWDEVDVDVVADCTGIFTDLDSAQAHIDAGAKKVVISAPSKTAPMFVMGVNDNELTADHKIVSNASCTTNCLAPMAKILDDNFGIAEALMTTVHATTATQATVDGPSKKNYRLGRSAMNNIIPATTGAAVAVTKVIPALKGKLTGMAFRVPTVDVSVVDLTVKLSKETSLEEINKAFKDASTGAMAGVVGYTDEAVVSQDFVSDARTSIYDAGAAIELNSTFFKLVSWYDNEFGYSNKLVDLAEKVHSL

SEQ ID NO: 7955 - protein, 326 aa, Triticum aestivum
  misc_feature (277)..(277): Xaa can be any naturally occurring amino acid
  misc_feature (285)..(285): Xaa can be any naturally occurring amino acid
  unsure (1)..(326): unsure at all Xaa locations
MASTTAVPEVALRSGDARPMPAIGMGTAKLPVVPETTVKAVLEAVVVGYRHFDTASMYATERPLGEALAEAVRRGLLASREEVFVTSKLWCTQCHPHLVLPSLRESLQNLQMEYVDLYLIHWPISLKPGPTVFPVKREDAVPFDFEGVWRAMEECHRLGLAKAIGVSNFTTSHLDKLLAAATVHPAVNQVELNPVWQQRKLRGYCAEKGIHVAAYSPLGGQNWNGDGNAVLDSEVLAEIAKARGKTIAQVALRWIYEQGVTPIVKSFSKEMLKENSXIFDWGLRXDDLRKIGQNPQKKIVRAETVLFSAEGEFTSADLADMEIVEE

SEQ ID NO: 7956 - protein, 1035 aa, Debaryomyces hansenii CBS767
MISRVVARSARANRLSTLTRSVPRAYNLNLKLAASNRFLASKADTSSADYEKVYDPSAKTVSLGNLDTFARRHLGPTPENVKTMLSALGYKDLDEFLSKAIPEHVLYKRALQIQPQQGFTELEMLEHLHNLANKNKIVKSFIGKGYAGTKVPPVIQRNLLESPEWYTSYTPYQPEISQGRLESLLNYQTMVTSLTGLNMANASLLDEGTAAGEAMSLSFHSLKGKRGKYAVDTNLHPQTLDVMKSRAENIGVEIVELPLSTQEGLEELERIASDSCGALVQYPGTDGSLNNYTKVGEIVHAHKGLFAMATDLLALTLIKSPAEFNADIALGTSQRFGVPFGYGGPHAAFFATNMKYSRKIPGRIVGLSKDRLGKPALRLALQTREQHIKREKATSNICTAQALLANMAAMYAVYHGPKGLKDIASRVYGYTTVLANEISNNSQHEIVNDKWFDTLTVKLGGGVKSDEILNKALNEYNINLFKAGEDKVSLCLDETVEEKDLIALVDVFTGNDLFSTSSISELPKLPTELLRTDEILAHPVFNTHRSETSMLRYLHLLQSRDLSLANSMIPLGSCTMKLNATVEMQTLSMPGFNQIHPFAPLNQAQGYKELVDEFEKDLNDITGFDATTNMPNSGAQGEYTGLSLIRQYHKSKGEYEQRNICLIPVSAHGTNPASAAMCGLKVVPVKCLNNGSIDVDDLKVKAEKHAENLCSIMITYPSTYGLFEPGIKTAIDLVHNNGGLVYLDGANMNAQVGLTSPGDLGADVCHLNIHKTFALSHGGGGPGQAPVCVKEHLKPFLPKHHFLDTPHSTNESIQAVNSAPYGSASVIPVSYSYIKMLGAKALPHVSSIAMLNANYMLEKLKDDYQIMFVDHSASTDEGLKHCAHEFILDLREFKAVGVEAIDVAKRLQDYGFHAPTMSFPVAGTLMIEPTESENLEELDRFINSLLSIRKEINAMANKEPLGQVLKNAPHSLNDIVSTSQADWEARGYTREQAAYPLPFLKESKCWPSVSRVDDTYGDMNLMCTCPSVEEVAADQ

SEQ ID NO: 7957 - protein, 139 aa, Brassica napus
KDMLDNLIDAKDENGRTLEDEEIIDVLLMYLNAGHESSGHTIMWATIFLQEHPEILQKAKEEQERIVKKRVPGQSLTLKETREMEYLSQGIDETLRVITFSLTAFREAKSDVQMNGYIIPKGWKVLTWFRDVHLDPEIY

SEQ ID NO: 7958 - protein, 478 aa, Prochlorococcus marinus subsp. marinus str. CCMP1375
MTQSSLIPVILCGGSGTRLWPLSRESYPKQFWDLTGDSNKTLLQQTHQRIQNIRGLQEPYLICNEKHRFIVAEQMREINVQPQAIFLEPVGRDTAPAVTIAALKAQEKGEDPLLLVLSSDHIIANNENFTKAIDEGRQAAESGKLVTFGIYPTAPETGYGYIEATENDNKSLIALPIKRFVEKPDLKTAEQFLKDSRFTWNSGMFLFKASVILQEIERFSPEILSHCKKALKDNSKDLDFLRLNVQAFHKCPSLSIDKAVMEKTNLGAVLQLNAGWNDIGSWQSLWETSTKDKNGNVLKGKVILEDSKNCYLRSEKRLVVGLGVKDLIVVETDDAVLVADRQQSQKVKSIVATLKNNKSAEAKAHTKIYRPWGHYTSIVQGKRWQVKKIEVKSGASLSLQMHHHRSEHWVVVKGTALVERDGEKQLLEENQSTYIPLGCKHRLTNPGKIPLELIEVQSGAYIGEDDIVRIDDNYGRKN

SEQ ID NO: 7959 - protein, 384 aa, Staphylococcus aureus subsp. aureus NCTC 8325
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCIFANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 7960 - protein, 280 aa, Streptococcus mutans UA159
MEAYTLINGVHIPKIGFGTWKLADGDEAYKSVSYALEVGYRHVDTAQYYGNEVSVGRAIADSPIKREELFITTKIWNDKHSYDEAKQSVEESLAKLKLNYLDLLLIHWPNPKALRENDAWKTRNADVWRAMEDLYQAGKVRAIGVSNFMIHHLEPLLEVATVKPMVNQVLLAPGCSQEELVAFCRQNEMILEAYSPLGTGSIFDNQTAQDLANKYNKTVAQIALRWSLQKGFLPLPKSATPKNILSNLAIFDFDLTEDDILKLDKIENVKSQGNPDETAF

SEQ ID NO: 7961 - protein, 473 aa, Photobacterium sp. SKA34
MATVITEERSNGTLSLEKSDLNKNVFIACLIAALAGLLFGLDIGVISGALPFIAKEFGLATHTQEWVVSSMMFGAAFGAIGSGPLSNKFGRKYSLVVASILFTIGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQVMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNSQTFWLYAVLNIIFLFVTLILIPETKGISLEKIEQNLMTGVPLSKLGKK

SEQ ID NO: 7962 - protein, 530 aa, Yarrowia lipolytica CLIB122
MNFPRNKMTGLRDENTSASMRLPRAKTAEPSDMDISIGENGALNARPALNDLSNVGLSGNVFKHTAASQARRALTSKTTNGAATNKPAVKPTFSAAVAGLSRTRQPYSNNPNTQQPSNITRASSTTTNPYTRPQRASLQTKSVSADFSIPVFQSKTGPLDVPPMTRKRPSQGAKDMEMPRLAARGGKHHQTMETFAYREEGPLAKKHKQEEDKTAVALEAEQEEVIRRPLIQVLAPGATGIDVEHDDLDAEDIDDPMAAGEYVDEIFTHLYNLEEEYQPNPRYIDDQKSLSWNTRAVLIDWLVEVHQKFRLLPETLFLAVNIVDRFMSRRVVALNKVQLVGITSLLLATKYEEVFTPALSNFVYVVDGSYPEDEILRAERFILQVLQFNLSYPNPMNFLRRISKADDFDIHSRTFGKYLCEIALVDHTFMEFKHSLVAAAAMHVGRMMLARSQWTNNLVYYSGGYTQKDIAPVCRKIFQFLIGPVEHEAFFKKYATKKFLKASIIAREWALGVQEQIKNGVNSYETNLFI

SEQ ID NO: 7963 - protein, 287 aa, Zea mays
MAAATPSPHSARVAVVTGGNKGIGLEVCRQLASNGITVVLTARDEKRGAAAVEELADAGLSGVVFHQLEVTDAQSIARLAGFLKARFGKLDILIKGMDAFQMAELMRKSCRETNDTAKAGVQTNYYGVKNVTEALLPLLLQASSSGGGRVVNVSSDFGLLRYLRNEEVKHELDDIEGLTEERLDELLSTFLRDFEAGALESRGWPTEFAAYKVAKAALNSYSRVLARRHPELRVNCAHPGYVKTDMTRQTGLLTPAQGAANVVKVALLPEGGPTGAFFALGKEAPFV

SEQ ID NO: 7964 - protein, 528 aa, Mycobacterium sp. JLS
MSLPVVLIADKLAASTVAALGDQVEIRWVDGPDREKLLAAVPEADALLVRSATTVDAEVLAAAPKLKIVARAGVGLDNVDVDAATARGVLVVNAPTSNIHSAAEHALALLLSAARQIPAADSTLRERTWKRSSFNGTEIYGKTAGVVGLGRIGQLVAARLAAFGTHVVAYDPYVSHARAAQLGIELLSLEDLLARSDFISVHLPKTPETAGLIGREALAKTKKGVIIVNAARGGLIDEQALADAVTGGHVRAAGLDVFATEPCTDSPLFELPQVVVTPHLGASTAEAQDRAGTDVAASVRLALAGEFVPDAVNVGGGVVGEEVAPWLDLVRKLGLLAGTLATEPTTTLSVRVCGELAAEEVEVLRLSALRGLFSTVTDQQVTFVNAPALAAERGVQSELTTASESPNHRSVVDVRAVGSDGSVTNVAGTLSGPQQVEKIVQINGRNFDLRAEGVNLIVNYIDQPGALGKIGTLLGTAEVNIHAAQLSEDAEGPGATILLRLDRDVPAELRSALAEAVDAKTLEVVDLS

SEQ ID NO: 7965 - protein, 595 aa, Synechococcus sp. WH 5701
MAQPDLSRRTKIVATIGPATESPQRLRDLIQAGATTFRLNFSHGDHSEHAARIATIRQVAHELGIHVGILQDLQGPKIRLGRFEGGPITLANGDPFALTSRPVSCNQSIATITYDRLADEVTAGSRILLDDGRVEMVVKSVDIPEQTLHCTVVVGGVLSNNKGVNFPDVQLSIRALTTKDREDLSFGLQQEVDWVALSFVRNPSDMQEIRELISSQGYSTPVIAKIEKFEAIDQIDAILPLCDGVMVARGDLGVEMPAEEVPLLQKELIRKANTLGIPIITATQMLDSMASCPRPTRAEVSDVANAILDGTDAVMLSNETAVGDYPVEAVETMARIARRIERDYPRRVVDSHMASTIPNAISQAVSTIARQLQAAAILPLTKSGATARNVSKFRPSTTILAITSEVKVARQLQLVWGVNPLLIGHQASTTSTFTLAMGVAQERGLLKEGDLVVQTAGTLSGVSGSTDLVKVGIVSAVLGRGLGIGNGSVSGRVRVATTAEEAARLESGEILVVRDTNAGYLDAIRKARGVIAEEHGCDSHAAVIAQRLGVPVIVGVANATSDLRLGEFVTLEVREGVVHRGARNHTQADRSETIL

SEQ ID NO: 7966 - protein, 392 aa, Pseudomonas fluorescens Pf-5
MRYSALTQRIAGEGSAAWDIHYRALALREQGGDVLLLTIGDPDFDTPRPVVQAAIDSLLAGDTHYSDVRGNLALRSCIARCHHQRTGQIVDAEHVVVLPGAQCAVFSVAQCLLDPGDEVLVAEPMYVTYEGVFGACGATVVPVPVRAEQGFRLDPQEVAARISPRTRAMLINSPNNPSGASLSLDDWQVLARLCMEHDLWLVSDEVYGDLLYEGQHLSPGGLPRMGGRTATINSLSKSHAMSGWRVGWVIAPPVLVGHLSNLALCMLYGLPDFIQNAAVVALTRELPELPQMREEYRQRRDLVCTLLGQCPGLRPVLPDGGMFVMVDVRRTGLGAQAFAERLLEGYGVSVLAGEAFGPSVVGHIRIALVLDRERLAEACRRIAQCTAQLLAL

SEQ ID NO: 7967 - protein, 357 aa, Glycine max
MSAFVGKYADELIKNAKYIATPGKGILAADESTGTIGKRLASINVENIEANRQALRELLFTAPNALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAACYKALNEQHVLLEGTLLKPNMVTPGSDSPKVPPEVIAEYTVNALRRTVPAAVPGVVFLSGGQSEEEATLNLNAMNKLEVLKPWTLSFSFGRALQQSTLKTWGGKKENVAKAQEAFLARCKANSDATLGKYVGGSGSGLTSESLYVKNYKY

SEQ ID NO: 7968 - protein, 821 aa, Gibberella zeae PH-1
MAPQPDEHHPHKKVNLTDASGAEVKNEDDVATAILKKKKKPNQLMVTDAVNDDNSIIALSEATMDQLQLFRGDTVLVRGKKRKDTVLIVLADDELDDGSARINRVVRHNLRVKHGDMITIHPCPDIKYAKRIAVLPIADTVEGITGSLFDVFLAPYFREAYRPVRQGDLFIVRGGMRQVEFKVVEVDPPEYGIVAQDTVIHCEGEPIQRDEEENNLNEVGYDDIGGCRKQMAQIREMVELPLRHPQLFKSIGVKPPRGVLLFGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGVPDPTGRLEILQIHTKNMKLGDDVDLEQIASETHGYVGSDVAALCSEAAMQQIREKMDLIDLDEDTIDAEVLDSLGVTMENFRFALGVSNPSALREVAVVEVPNVRWEDIGGLQEVKQDLKENVQYPVDHPEKYLKFGMSPSRGVLFFGPPGTGKTMLAKAVANECAANFISVKGPELLSMWFGESESNIRDIFDKARAAAPCVVFLDELDSIAKARGGSMGDAGGASDRVVNQLLTEMDGMTSKKNVFVIGATNRPEQLDPALCRPGRLDSLIYVPLPDEPGRLSIIKAQLRKTPIASDIDFGYIASKTHGFSGADIGFITQRAVKIAIKESIAIDIERQKAREAAGDEMDTDEDAEDPVPELTKAHFEEAMQMARRSVSDVEIRRYEAFAQQMKNAGPGAFFKFPEAGAEAAGGDAGNSFGDAGNDDDLYD

SEQ ID NO: 7969 - protein, 294 aa, Triticum aestivum
ARDESSGLWESIWGEHMHHGFYDSGEAASMSDHRRAQIRMIEEALAFAAVPDDPTNKPKTIVDVGCGIGGSSRYLANKYGAQCSGITLSPVQAERGNALAAAQGLSDKASFQVADALEQPFPDGQFDLVWSMESGEHMPNKQKFVSELARVAAPGATIIIVTWCHRNLAPSEDSLKPDELNLLKKICDAYYLPDWCSPSDYVKIAESLSLEDIKTADWSENVAPFWPAVIQSALTWKGLTSLLRSGWKTIKGALVMPLMIQGYKKGLIKFSIITCRKPQAAIEGEPEAASPSVE

SEQ ID NO: 7970 - protein, 475 aa, Arabidopsis thaliana
MASQSSVAVISSAAARGESFPDSKKPIGSVRFQQPLRLSFSYCKSGNMSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDDSCIRISYATSLDVLQAAVEKIRKALEPLRATVSV

SEQ ID NO: 7971 - protein, 253 aa, Geobacillus stearothermophilus
MRKPIIAGNWKMHKTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGPLVGGASLEPASFLQLVEAGRHE

SEQ ID NO: 7972 - protein, 269 aa, Metarhizium anisopliae
MGHEDAVYLAKLAEQAERYEEMVENMKIVASEDRDLTVEERNLLSVAYKNVIGARRASWRIVTSIEQKEESKGNSSQVTLIKEYRQKIEAELAKICDDILDVLDKHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSGAAGQADAPAKEESGAAAEAPAAAEQTKASE

SEQ ID NO: 7973 - protein, 269 aa, Moraxella sp.
MQAWVIGNWKQNPATSHDVNALLDDLCAAISTTKQMSHDNSARCQIMVAPSLIHLAAVNGRLKDTSILCAAQDVSGHSASVGAYTGECSAQQIVDAGATWTILGHSERRQYHQESNDALLQKMIHALSQDLGVVFCIGESQEQYDTKQTLTVIDNQLVVIKEFITQQPELIDALPTRLIIAYEPVWAIGTGKVPTVAEVSATHKHIKQTLAGFADSLSNMTVLYGGSVNADNANSFAADPMIDGALVGGASLKADSFLTIATAFSQASI

SEQ ID NO: 7974 - protein, 174 aa, Zea mays
  misc_feature (50)..(50): Xaa can be any naturally occurring amino acid
  misc_feature (126)..(126): Xaa can be any naturally occurring amino acid
  unsure (1)..(174): unsure at all Xaa locations
GRVPTAPTKPDHPNKCQRPLAVAAMESPFIMIKPDGVQRGLIGEIISRLXKKGFYLKALKLVNVERSFAEKHYADLASKPFFQGLVDYIISGPVVAMVWEGKSVVTTGRKIIGATNPLASEPGTIXRGDFAVDIGRNVIHGSDSIESANKEIALWFPEGPADWQSSQHPWIYEK

SEQ ID NO: 7975 - protein, 374 aa, Chromobacterium violaceum ATCC 12472
MTISPIQDIIADIQAGKMVVLMDAEDRENEGDLVMAAEFVTPEAINFMAKYGRGLICLTLTEERCKLLNLPMMATNNGTSFGTNFTVSVEAAEGVTTGISAADRAHTIKTAVARLAKASDLVQPGHVFPLKAQNGGVLIRAGHTEAGCDLAMLAGVEPAGVICEIMNDDGTMARLPELLEFAKQHGLKIGTISDLIQHRSRTESLVEKVGERPVETPFGSFDLHVFRDITTSATHLALSKGKIRPDKEILVRVHEPLSVIDVLAPLCSHHSWTLPNALETMEEEGCGVMVLLYRDETGADLAQRALDQEPPRQKWDSKTFGIGAQMLKALGVGKMKLMSSPVSLPSMAGFELEVTGFCQPGHFHVDRDGGPGVA

SEQ ID NO: 7976 - protein, 273 aa, Arabidopsis thaliana
MGEYCNEDLSCFPANELRFSKHVHDNVHGNIYLDPLCLKFIDTEQFQRLRELKQLGETVQRLKTFQGMELGIDNHDLQTVRLAGLLHDIGHGPFSHMFEREFLPKVISGCQWSHELMSINMIDYIVDTHHIDVDAKMLKRVKDMILASTEVSELKGNAEKRFLYDIVANGRNGIDVDKFDYIVRDSRACGLGCNFQFQRLTEPMRVIDNEICYPAKEYRTVHKLFATRADLCGTVYMHPKKMAIELMIVDAMVKANNVLEISSMINDPSQYWK

SEQ ID NO: 7977 - protein, 487 aa, Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 7978 - protein, 590 aa, Oryza sativa
MKFAKKYEKYMKGMDEELPGVGLKRLKKLLKKCRSDLQSHENDGSSAGRCPGHCSVCDGSFFPSLLNEMSAVIGCFNEKAKKLLELHLASVTIFVRINVSIIVLVFGFKTVLNGYINNYIHYSKQGQEFKAQAQSLHIEILQSPWLCELMAFYMNLRRSKKNNGAMELFGDCSLVFDDDKPTISCNLFDSMRVDISLTCSICLDTVFDPVALSCGHIYCYLCSCSAASVTIVDGLKSAERKSKCPLCRQAGVFPNAVHLDELNMLLSYSCPEYWEKRIQMERVERVRLAKEHWESQCRAFLGIFLETGPKARMFEEILIPREAAAVRSSPKQPQGDHIELHQKRHGRRLDYEERKRKRAAREVHKRSRDARQLLGAKGKRFAKKRYAEKAQMKKTLKMHDESTSRQKVDDVQEGALPPYLLDRDQTQRAKVLSNTIKQKRMEKAGKWEVPLPKVRPVAEEEMFKVLRTGKRKTKQWKRMVTKATFVGPGFTRKPPKYERFIRPTGLRFTKAHVTHPELKCTFNLDIISVKKNPNGQMYSTLGVLTRGTIIEVNVSELGLVTPAGKVVWGKYAQVTNNPENDGCINAVLLV

SEQ ID NO: 7979 - protein, 390 aa, Vibrio angustum S14
MVDSINTMIFELCAIVISAAGLGSLFLFAKQPIIIAYIVAGIIIGPYGLGMINNAEAITQMGHIGVILLLFLLGLNLQPQRLLRLFRESALITLCCSLFFFICTLLFALMIQLPLKDAIITAAAMMFSSTVIGLKLIPTTTLHHQKMGEIMTSILLIQDILAITVLLLLNIDTEQRIDLAIFLIFAKLLIVIVSAYFAVKFILLPLMKKFDVIQEYSFVATLAWCFCWAEISHRIGLSYETGAFIAGTLLAVSPISNVISIHLKPLREFFLILFFFAIGANINVLASDIYTLWGILFGVVLIRLKAWGFYRALIISNTEAPINKELSARLSQASEFSLLLAYTAVANGLISVQGKTFIQIVTLTTFILSTYWIVSRYPTPISNVNTLRQD

SEQ ID NO: 7980 - protein, 246 aa, Arabidopsis thaliana
MAVMSLMKDQQNPIQQFQVKFKEIETGFKSWLSKQKLPVEAAVVTAMGGVQGAFIGGLMGTLSPEMPQAGIDPQAMASLKQTQALVGGPLVQARNFAAITGVNAGIACVMKRIRGKEDLESAVVAAFGSGVAYSLVSAGLQGQPMNAITTAAGFAVFQGVFFKLGERFSKPSVEDPYYTRGRSMLLKLGLEKYEKNFKKGLLADPTLPLLTDSALRDVSIPPGPRLLILDHIQRDPELKGKRGSRG

SEQ ID NO: 7981 - protein, 248 aa, Mycobacterium sp. JLS
MGDSTLILLRHGESEWNAKNLFTGWVDVDLTDKGRAEATRAGELIADLDRLPDELYTSLLRRAITTANIALDKADRHWIPVHRDWRLNERHYGALQGLNKAETKEKYGEEQFMAWRRSYDTPPPPIEAGSEYSQDRDPRYADIDGGPLTECLADVVARFVPYFEQTIVPDLREGKTVLIAAHGNSLRALVKYLDGMSDEDVVGLNIPTGIPLRYDLDSDLKPTVAGGTYLDPEAAAAGAAAVASQGAK

SEQ ID NO: 7982 - protein, 529 aa, Ashbya gossypii ATCC 10895
MSESLLQTVVAYVELVLHHFMALSWTQQLSIVIVAPFIYSLVWQTLYSFRKDRVPLVPFMVPWVGSALAYGRAPYEFFGKCQQKYGDVFAFMLLGRVMTVYLGTKGHEFILNAKLAEVSAEEAYTKLTTPVFGEGVVYDCPNHRLMEQKKFCKNALSTEAFRRYVPMVMDEVRKYLRTSKHFMMNERSSGVVNVMETQPEMTIFTASRSLLGAEMHSMLDADFAYLYADLDKGFTPLNFVFRDLPLDNYRRRDNAQRTISSTYMKVIERRRKNNDVQDRDLIDALMTSAQYKDGVKMTDQQIANLLIGVLMGGQHTSAATSAWVLLHLAERPDIQEELYEEQMRVLDGGAKELTYELLQEMPLLNQVIKETLRMHHPLHSLFRKVTRDMPVPNTSYVIPKDHYVLASPGFCHLSEEYFPNAKEFNPHRWDNDAASSVSTGEKVDYGFGAISKGVSSPYLPFGGGRHRCIGEGFAYMQLGTIFSVVVRSMKWHFPADMKGVPNPDFTSMVTLPSEPCRIAWERRVPDQII

SEQ ID NO: 7983 - protein, 268 aa, Populus alba
RATMIMRLKTKIQTLDEQMAAVSEKSSKYGQIAAEEIPKGLYCLGIRLTTEWFGNSNLHRRMNERMHIETKLRDDSLYHFCVFSDNILATSVVVNSTTLNSKNPDMVVFHLVTDEINYAAMKAWFSMNTFRGVTIEVQKFEDFKWLNASYVPVLKQLQDSETQSYYFSGHNNDGQTPIKFRNPKYLSMLNHLRFYIPEVFPALEKVVFLDDDVVVKKDLSGLFSIDLNSNVNGAVETCMETFHRYHKYLNYSHPLIREHFDPDACGCA

SEQ ID NO: 7984 - protein, 473 aa, Synechococcus sp. WH 7805
MATTAQDVLRQIKDEGIELIDLKFTDLHGKWQHLTICSDLLEAESFNEGLAFDGSSIRGWKSIDASDMAMVPDPSTAWIDPFYSHKTLSLICSIQDPRTGDAYDRCPRALAQKALAYLSGSGLADTAFFGPEPEFFLFDDVRYSSSEGGSFYSVDTIEAAWNSGRLEEGGNLGYKIQLKEGYFPVSPNDTAQDIRSEMLLVMAQLGIPIEKHHHEVAGAGQHELGMKFAELIQAADNTMTYKYVVRNVAKKYGKTATFMPKPVFNDNGSGMHVHQSLWKGGQPLFFGEGTEANLSQTARWYIGGILKHAPSFLAFTNPTTNSYKRLVPGFEAPVNLVYSEGNRSAAVRIPLTGPNPKAKRLEFRSGDALANPYLAFAAMMMAGIDGIKNQIDPGAPTNVDLFELSAERLSEIDTVPASLNGALEALNADHHYLMEGGVFTKDFIDNWIDLKYEEVQQLRQRPHPHEFTMYYDA

SEQ ID NO: 7985 - protein, 367 aa, Geobacillus kaustophilus HTA426
MMLRTEEMILNVGPQHPSTHGVFRLILKIDGEIIQEATPVIGYLHRGTEKIAEGLQYTQIIPYTDRMDYLSAMTNNYVLCHAVETMMGIEVPERAEYLRVLAMELGRIASHLVWWGTYLLDLGATSPFLYAFREREMIINLLNELSGARLTFNYMRIGGVKWDAPDGWIDKVKQFVPYMREKLHGYHELVTGNEIFRQRVTGVGRYTKEEAISYSLSGVNLRSTGVKWDLRKDEPYSIYDRFDFDVPVREGGDCLARYECRMAEIEQSLRIIEQACEQFPPEGPIMGKVPRIIKAPPGETFVRIEAPRGEIGCYIASDGKKEPYRLKFRRPSFYNLQILPKLLKGENLANVIAILGSIDIVLGEVDG

SEQ ID NO: 7986 - protein, 193 aa, Arabidopsis thaliana
  misc_feature (47)..(47): Xaa can be any naturally occurring amino acid
  unsure (1)..(193): unsure at all Xaa locations
STASRALSQNGNIENPRPSKVQELSVYEINELDRHSPKILKNAFSLXFGLGDLVPFTNKLYTGDLKKRVGITAGLCVVIEHVPEKKGERFEATYSFYFGDYGHLSVQGPYLTYEDSFLAITGGAGIFEGAYGQVKLQQLVYPTKLFYTFYLKGLANDLPLELTGTPVPPSKDIEPAPEAKALEPSGVISNYTN

SEQ ID NO: 7987 - protein, 310 aa, Colwellia psychrerythraea 34H
MAINWFPGHMHKAQKEIKEILPQIDVVIEVCDARLPFSSENPMITEIRGDKPLIKILNKSDLADPESTKVWLDYLESQHNVKAIALTTEQPSVAKNLVNLIRKLVPNKDEEGKQINAMIMGIPNVGKSTLLNTLVGKAKAKVGNEPAVTKGQQRIRLEEGLYLFDTPGMLWPKIANENSGYRLAVSGAVKDTAFDHDDIAYFAADYLLKNYPKRIMERYKLSELPAHEEDLIEAIGRKRSCIKSGGRVDLHKASVILINEIRDKTLGAISFELPDIIDAENAHFTELEEKRIAAREAKKAARGRGRKNKR

SEQ ID NO: 7988 - protein, 263 aa, Neisseria meningitidis MC58
  misc_feature (1)..(1): Xaa can be any naturally occurring amino acid
  misc_feature (11)..(11): Xaa can be any naturally occurring amino acid
  misc_feature (70)..(70): Xaa can be any naturally occurring amino acid
  misc_feature (110)..(110): Xaa can be any naturally occurring amino acid
  misc_feature (124)..(124): Xaa can be any naturally occurring amino acid
  misc_feature (142)..(142): Xaa can be any naturally occurring amino acid
  misc_feature (157)..(157): Xaa can be any naturally occurring amino acid
  misc_feature (189)..(189): Xaa can be any naturally occurring amino acid
  misc_feature (258)..(258): Xaa can be any naturally occurring amino acid
  unsure (1)..(263): unsure at all Xaa locations
XNVYFLGGGNXAAAVAGGLVKQGGYRIYIANRGAEKRERLEKELGVETSATLPELHSDDVLILAVKPQDXEAACKNIRTNGALVLSVAAGLSVGTLSRYLGGTRRIVRVXPNTPGKIGLGVSGXYAEAEVSETDRRIADRIXKSVGLTVWLDDEEKXHGITGISGSGPAYVFYLLDALQNAAIRQGFDXAEARALSLATFKGAVALAEQTGEDFEKLQKNVTSKGGTTHEAVEAFRRHRVAEAISEGVCACVRRSQEXERQYQ

SEQ ID NO: 7989 - protein, 436 aa, Zea mays
MRARGRSILGSEKQSFQEYTESGAASRSDGLGGPSTSNARRIRRRSISITPEIGDDIVRAVRAMNETLKQNRLQRDHVEGSCSYVMEDQSNTNDCPNKDDASWRIGATDSDSRNRTGSTQKAMSLPSSPHEYRGQVTQKSDDFISKEKMALAWNKVFQSSPFLNKALLPFKEWNIDFSEITIGTRVGIGFFGEVFRGIWNGTDVAIKVFLEQDLTTENMEDFCNEIYILSRLRHPNVILLLGACITPPHLSMVTEYMEMGSLYYLIHMSGQKKKLSWRRKLKIIRDICRGLMCIHRIKIVHRDLKSANCLVNKHWTVKICDFGLSRLMIDSPMTDNSSAGTPEWMAPELIRNEPFTEKCDIFSLGVIMWELCTLSRPWEGISPVQVVYSVANEGSRLEIPEGPLGRLIADCWSEPENRPSCQEILTRLLDCEYTVS

SEQ ID NO: 7990 - protein, 591 aa, Bacillus sphaericus
MIMLEAVYHRMGQNWSYAYNDSTLHIRIRTKRDNVPRIDLHCGEKYDPEKYKETIPMERMASDGLFDYWQAAVQPRYRRLVYYFALHSDNGDAVYFMEKGFFDQPPKVMYEGLFDFPYLNRQDVHTPPAWVKEAIFYQIFPERFANGDPSNDPEGVQEWGGTPSAGNFFGGDLQGVIDHLDYLSDLGVNALYFNPLFAATTNHKYDTADYMKIDPQFGTNEKLKELVDACHARGMRVLLDAVFNHCGHTFPPFVDVLNNGLNSRYADWFHVREWPLRVVDGIPTYDTFAFEPIMPKLNTGNEEVKAYLLNVGRYWLEEMGLDGWRLDVANEVDHQFWREFRSEIKRINPSAYILGEIMHDSMPWLQGDQFDAVMNYPFTNILLNFFARRLTNAAEFAQAIGTQLAGYPQQVTEVSFNLLGSHDTTRLLTLCSGNVERMKLATLFQLTYQGTPCIYYGDEIGMDGEYDPLNRKCMEWDKSKQNTELLAFFRSMISLRKAHPALRGSGLRFLPVLEHPQLLVYERWDDNERFLIMLNNEDAPVNVVIPAAQPGASWRTVNGEPCAVVEESSIQAALPPYGYAILHAPIAGTAE

SEQ ID NO: 7991 - protein, 237 aa, Prochlorococcus marinus str. MIT 9211
MEDLQTQMKEAVAKAAIEQIHDGMVLGLGSGSTAALMIKALGAKISSGHLKDIVGVTTSFQGEVLATELGIPLQGLSAVSQIDLAIDGADEVDSNFQLIKGGGACHVQEKLVASLAERFVVVVDSSKIVKTLNLTFKLPVEVLPSAWQLVKNKIHEIGGVSQLRMAQKKAGPIVTDQGNLVLDVTFAGGINDPQTLEKQINNIPGVLENGLFVNLADEVLVGEIVSGTPGVKSLQKI

SEQ ID NO: 7992 - protein, 561 aa, Vibrio sp. Ex25
MAMTKHDESWWKTATIYQIYPKSFCDSGSKGTGDIKGIISKLDYLKHLGVDAIWLTPVYQSPMVDNGYDISDYYAINPEFGTMEDFDTLLAEAHQLGIRIIVDIVVNHTSTEHKWFQSALGDKNSPYRDYYIWKDPVDGAEPNNWQSKFGGNAWELDEATGQYYLHLFAKEQADLNWENPVVREEVKEVISFWADKGVDGFRLDVINLISKQQDFPSDDIGDGRRFYTDGPRVHEYLQEISEAVFQKYGSVTVGEMSSTTLEHCQQYSSLAGKELSMVFNFHHLKVDYPNGEKWTKAPFDFIQLKQIFNHWQTGLNGKGWGALFWCNHDQPRVVSRLGDDKQYRVESAKMLAASVHMMQGTPYVYQGEEIGMTNPGYTEISQYRDVESTNMYDIMVNRDGVSHEEMMAILAQKSRDNSRTPMQWNSQKHAGFTEGTPWLEVAQNYSEINAEAAVADLSSVFYFYKRLIELRKQVSVITDGCYEDLLPEHQRIFAYARQNDKQTLLCINNYYAEEVECVLPERFDMSKAKNLLSNYQNSASAVASNHQVLRPYETRILLIEE

SEQ ID NO: 7993 - protein, 815 aa, Bifidobacterium longum DJO10A
MTEITAPKSPVTAEQFADEIREQLKYTQNVTTEQATPADVYVAASKAVRNHLADSWFKTQADTVNGNTKAVGYLSAEFLMGKQLRNALLNAGLTEQFDKAVEALGFKVQDVVDAEYEPGLGNGGLGRLAACFIDSLASLGVPAFGYGIQYKYGIFKQEFDKDGKQVETPDYWLANEEPWGHIDYNRDQKVSFGGKVVENADGTKTWQPAWSVRAVPVDYLVPGYKSGRVNTLRLWSAKSYDEFDLLAFNRSEYMEAVTPQVKAENISKILYPEDSTKVGKELRLEQQYFFVSASLHDAIRVFYPGQDKPDLTTFPNKIVFQLNDTHPVIGIPELMRILIDEYGYDWDTAWSITTKTFNYTCHTLLPEALEVWPASLIGELLPRHLEIIEKINAQFEDELKSKGVDKNTIKDMAIYTGDAVRMAYLATYGGSHVNGVAELHSQLLKDVTLKNFSDVYPDKFTNVTNGVTPRRFVKLANPRLSDLITEGLGTDKWLSDLEMLKGLEPLAKDDEFVKKFAAVKKANKHAFVGFAKDHYGIDIDENTLFNTMVKRLHEYKRQSLKILAVISTYADIKSGKVKAEDVTPRTVFFGAKAAPGYYLAKMTIQLINNVSRVVNNDPDVKGKLAVYFPWNYNVRLAQHLIPATDLDEQISQAGKEASGTGNMKFALNGAMTVGTLDGANVEIRERVGAENFFLFGMTVDEVEKKYAEGYNPASYYEADPRLKHAIDMVADGTFSNGDRNAYSPLVADWLTKDWFMTLADFSAYMDIQSEIEALYADELEWNRKALLNVANSGYFSSDRSMEDYLERIWHTAPLA

SEQ ID NO: 7994 - protein, 153 aa, Euphorbia esula
MDTGAKLKKGAGERKGGGPKKKPVSRSVKAGLQFPVGRIGRFLKKGRYAQRVGSGAPVYLAAVLEYLAAEVLELAGNAARDNKKNRIIPRHVLLAVRNDEELGKLLAGVTIAHGGVLPNINPVLLPKKAEKAAAAATKEPKSPAKATKSPKKA

SEQ ID NO: 7995 - protein, 230 aa, Rhodothermus marinus
MAENERPKTHEALKFYFTPVDPPRGDELNPHAKATTYVPEVVEALKERFGDVIEEVELYAGEHTVRVRADKIVEVCRFLKEEQGFNYLADLGGIDRFTDEGRFEVFYNLVSIERRKRIRLKVRVEEDNPVVPSVTSVYRAANWNERECYDMFGIRFEGHPDLRRMYMPEDFEYHPLRKEFPLLGIPGSLPLPPQTPGGPLTYDPFARAHGYVPPPGFEEPPAEDEEVSEH

SEQ ID NO: 7996 - protein, 441 aa, Rhodothermus marinus
MSTAPSLVGPDRHGLFNFWPRHNEAIYRRLETKHAWLEERHRPPGGDGEPDPLEHEMILNIGPQHPATHGVLRCIVKLDGEVMEKCVLDLGYLHRGLEKVAEHKTYQEFMPYTDRMDYLSPYSNNVAWCLAVEKVAGIEVPERAQWIRMIMCELARISSHLLWLGVGLMDAGAVSVFLWAFKYREEIYSIFDEVCGARFTVSHSRIGGVASDLSPTAIAMIRRFVEEFPEELAGWEKIINRNKIWIDRNEGIGVLTAEEAIELGVTGPNLRGSGVDYDIRRFEPYLKYDEVDFNIPIRTEGDSLARYFVRMEEMKESVRIIRQCLERLPEGPIRNDNAKLAYPSKEEVYYSMEGMIHDFLYTDVGVCPPKGAHSYHAIEAPKGELGFYIISDGTGKPWRVRIKAPSFSNLQGLEYMMEGAMIGDMVILIGTIDPVMGEADK

SEQ ID NO: 7997 - protein, 133 aa, Rubrobacter xylanophilus DSM 9941
MEQTLVLIKGDGVRRRLIGEIIRRLENKGLAIRDLKMMRVSRELAEEHYAEHREKPFFGELVEFITSAPVVAMRVEGEGAIGVVRNLMGATDPAKAAPGTIRGDLALSMPDNLVHGSDSPQSAARELRLFFGG

SEQ ID NO: 7998 - protein, 286 aa, Lactobacillus plantarum WCFS1
MTALTKLTDTYTLNNGTKIPIVGFGTWQTPDGQVAYDSVLAALKAGYRHIDTAAAYGNEESVGKAIADSGVAREDLFVTTKLWNADHGYDAAKKALDTSLAKLGLDYVDLYLIHWPNPAAMRDNWEQLNADTWRAMEEAYTARKARAIGVSNFRPKHLDALLKTAKVVPAVNQIFLNPSDMEDEVVAYNRKHDILSEAYSPLGTGKIFSIPELKTLADKYDKSVAQVVLRWSLQHGFLPLPKSVHADRIEQNTELFDFELSDDDMKVIDGFHGVAGLANDPDQVNF

SEQ ID NO: 7999 - protein, 402 aa, Rhizobium sp. NGR234
MNTVYVVGTCDTKGGELRYLRDLIRQAGCDAVLVDVSVSEFHSQAADVDVQPSEVARFHPNPPKPEDLKDRGKAVAAMAQALVEFIRSRPDVDGIIGAGGTGGTALIAPALRALPIGTPKVLVSTVASGNVAPYVGPTDISMMYSVTDVSGLNRISRVVLANAAHSVAGMVLNKVSAAKDERPAIGLTMFGVTTPCVQAVTRALEADFDCLVFHATGTGGQSFEKLADSALLVGGIDVSTTEVCDYLVGGVFPCTADRFGAFARTRLPYVGSCGALDMVNFGAMDTVPSRFRSRRLHVHNPQVTLMRTTPEECNRIGEWIAERLNLCEGTVRFLIPELGVSAIDAPGQPFHDPEADSALFAALERTLRRTTKRQLIRVPLHINDPQFAELLVTNFKEALREH

SEQ ID NO: 8000 - protein, 211 aa, Triticum aestivum
  misc_feature (198)..(198): Xaa can be any naturally occurring amino acid
  unsure (1)..(211): unsure at all Xaa locations
MAAAPAAGGQGGGMDAALLDDIIRRLLEVRTARPGKQVQLSESEIRQLCTASRDIFLTQPNLLELEAPIKICGDIHGQYSDLLRLFEYGGFPPEANYLFLGDYVDRGKQSLETICLLLAYKIKYPENFFLLRGNHECASINRIYGFYDECKRRFNVRLWKVFTDCFNCLPVAALIDDKILCMHGGLSPDLGHLDEIKXLPRPADVPDTGLL

SEQ ID NO: 8001 - protein, 285 aa, Rhizobium sp. NGR234
MSTDTLVKRPTRSELIDRFHSKIRAGEPIIGGGAGTGLSAKSEEAGDIDLIVIYNSGRYRMAGRGSLAGLLAYGNANQIVVDMASEVLPVVKHTPVLAGVNGTDPFVVMPTFLRELKEIGFAGVQNFPTVGLIDGLFRQNLEETGMSYAQEVAMIAEAHNLDLLTTPYVFGPDDAVAMAKAGADILVCHMGLTTGGAIGAQSGKTMEDCVALINQCIKAAREIRDDIIILCHGGPIANPEDARFILGACPGCHGFYGASSMERLPTEEAIKSQTLAFKAIRRKPA

SEQ ID NO: 8002 - protein, 974 aa, Trichodesmium erythraeum IMS101
MVATYKSNIQSSYQIQLANQNQGQRPIDFSQRHIGLTSSEIQQMLEVLGISSLEDLIDKTVPEKIRFQKPLNLPKSLSENAALAQIKEIISKNQIFRSFIGMGYYDCITPPVILRNILENPGWYTAYTPYQAEIAQGRMEALLNFQTMITDLTGLEIANASLLDEATAAAEAMSMTYGLCKTKAEVFFVDSACHPQNIEVVKTRAQPLGIEVIVGDFRTFTFDKPIFGALLQYPATNGAIYDYREFVEKVHKVGGLVTVAAELLSLTLLTPPGEFGADIAVGNTQRFGVSLGYGGPHAAYFATKEAYKRQTPGRIVGVSQDANGNPALRLALQTREQHIRREKATSNICTAQVLLAVIAGMYAVYHGPGGLKQIAENIHNLTFKLATGLKQLGYQIGAELFFDTIEIKLGADSPVKSAKEIIDAAENLGINLRTFDEQTVGISLDETTTEVDVQNLWQIFASGEKFPNIENENISTLSQSYYARTSNYLTHPVFKSYHSETNLLRYIHRLQSKDLSLTTSMIPLGSCTMKLNATAEMIPVTWPEFANIHPFSPISQTQGYQIIFQQLEEWLAEITGFAEISLQPNAGSQGEYTGLLVIREYHAHRGEAHRDICLIPESAHGTNPASAVMSGLKVVVVKCDAQGNIDIADLQTKAEKHKDNLAAIMITYPSTHGVFEEEILDICEIIHAHGGQVYMDGANMNAQVGLCRPAEIGADVCHLNLHKTFCIPHGGGGPGMGPIGVKSHLAPFLPGHSVINLGGENSSGAVSAAPWGSASILPISWMYIAMMGTDGLTEATKIAILNANYIAQRLGSYYSVLYKGKYGFIAHECILDLRPLKKLAGIEVEDIAKRLMDYGFHAPTVSWPVAGTIMVEPTESESKDELDRFCDAMISIRQEIEEIETGKADKNDNLLKNAPHTAESLMVDEWKHGYSRQRAAYPAPWTREHKFWPAVGRVDNAFGDRNFVCSCLPIEAYS

SEQ ID NO: 8003 - protein, 394 aa, Arabidopsis thaliana
MTTRKRQIKNFTLNFGPQHPAAHGVLRLVLEMNGEVVERAEPHIGLLHRGTEKLIEYKTYLQALPYFDRSDYVSMMAQEHAYSLAVEKLLNCEVPLRAQYIRVLFCEITRILNHLLALTTHAMDVGALTPFLWAFEEREKLLEFYERVSGARMHASFIRPGGVAQDLPLGLCRDIDSFTQQFASRIDELEEMLTGNRIWKQRLVDIGTVTAQQAKDWGFSGVMLRGPGVCWDLRRAAPYDVYDQLDFDVPVGTRGDCYDRYCIRIEEMRQSLRIIVQCLNQMPSGMIKADDRKLCPPSRCRMKLSMESSIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 8004 - protein, 199 aa, Triticum aestivum
  misc_feature (87)..(87): Xaa can be any naturally occurring amino acid
  misc_feature (91)..(91): Xaa can be any naturally occurring amino acid
  misc_feature (100)..(100): Xaa can be any naturally occurring amino acid
  misc_feature (110)..(110): Xaa can be any naturally occurring amino acid
  misc_feature (129)..(129): Xaa can be any naturally occurring amino acid
  misc_feature (134)..(134): Xaa can be any naturally occurring amino acid
  misc_feature (138)..(138): Xaa can be any naturally occurring amino acid
  misc_feature (144)..(144): Xaa can be any naturally occurring amino acid
  misc_feature (151)..(151): Xaa can be any naturally occurring amino acid
  misc_feature (153)..(153): Xaa can be any naturally occurring amino acid
  misc_feature (158)..(158): Xaa can be any naturally occurring amino acid
  misc_feature (161)..(161): Xaa can be any naturally occurring amino acid
  misc_feature (165)..(165): Xaa can be any naturally occurring amino acid
  unsure (1)..(199): unsure at all Xaa locations
RRALRELLFCTPGALQYLSGVILFEETLYQSTKGGKPFVDILKAGNVLPGIKVDKGTIELAGTNGETTTQGFDDLGKRCAKYYEAGXARFXKWRASLKIXAPTEPSQSPXDQEPQGLVRYPSTGKENGXVPIVXPEIXVDGLKXFTAVLTXPXFLAAXKRXQRQXFPIPEKRVNQKGARRITSNPKDSGFPNRGKGGTT

SEQ ID NO: 8005 - protein, 609 aa, Rhizobium sp. NGR234
MADPIVHPGVHRPEFSAPLHARAEIIATLRAALGKPNTTLVGAAIGTGMAAQAASRGGADFILALNAGRLRSMGAPSIFSLLALRKSNDFVLDFAQSEILPFVKVPVFFGASAFDPRCSIEAELERIADAGFGAIVNFPTSIFLDGRFRADIEGAGLGFQRELEMLRAAQKRNMATLAYVRTVAEAQQAATAGVDIINLNLGWNVGGTVGSRTELSLRQAAEYAKIIFRQIRAISEDTLCVLEGGPIVSPDQMYEVSALSKADGYIGGSTIDRVPLEASMEQITSAFKSVGTLQKRIDELERQLEHVQREYSIVGRSPSIQQIKQRIEKLAASSLPVMITGQAGTGKKLLARGIHEAARRSGSKLISSEDASGESLFGFAPSEGGRKVLGLLQYHPKATLLIESVECLCVDAQERLIEVIETGAYRRLGDNERGRFEGRLILASTRPLPELGSSGQLIPALESRLAPGHVFLPPLCDRLEDLPLLAEHFLQALRKDRRSRKLSVDHSAYRVLMTYGWPENIRELRSVLETAAIRCEGDWIKSEHLPPLGDANADAPHPHPGEEREWILDALQRHRFRRGEAARYLGISRKTLYNKMRVYGLPLQPRERS

SEQ ID NO: 8006 - protein, 227 aa, Ralstonia solanacearum
MPSGDASADPIEARFDPAAMPARMAAALDAMRLGIPVVVLDDADRENEADLIIAADRLTHAGMAMLIRECSGIVCLCLTAEKAAVLGLRPMVEHNRSQYGTAFTVSIEARVGVSTGVSAADRITTIRAAVAPDADAQSVVSPGHVFPLVAQAGGVLARRGHTEGSVDLARLAGLSPAGVLCELMLPDGTMARRDDAVRFADQHGLPVLTIEDIARYREQMARAVSFA

SEQ ID NO: 8007 - protein, 328 aa, Dehalococcoides ethenogenes 195
MTAYRLEAIGLGAVHVDHIYTVEQILHDGECVVTESASFPGGSGANTIHGLSRLGLKCGFIGAVGNDPDGNLLISDFENAGIDNRYLLVKNEAQTGSVVSLSESSGRRSTYVNPGANNYLDLSDVNLEYLSQAKLVHMSTFFNQNEFALCHEIAERLAPDILFSFSPGSLFAAQGIKKLAPILSRTNALFTNQQDIEKMTQKNYQRATDMCIRSGCEHVVVTLGESRRFQRKGKITLQTYIRDKDHECHMESTVSLRKDIRTVVDTIGAADAFTTGFLFGLMEEKPIEECGLLGDISARFCIGKLGARSGLPDLEALKERFGMHYFTS

SEQ ID NO: 8008 - protein, 257 aa, Burkholderia xenovorans LB400
MPNGNTTSSLHGKFALVTGGARGLGLEIAQQLATLGAHVIIGARDTAKAEAVATELRNLGHAVSALKLDVTSDEDRQAAYAEIDRAHGRLDILINNAGILLDSPDGGTPATRQPSEALPNVVRDTFEANFFAPVFLTQTLLPLIRRSSAGRIVNVSSIRGSLAHLSDPCSPVYPIRALGYDTSKAALNAFTILIAAELRDTPIKINAVHPGWLRTSMGGERANMSAEDGAHAVVKYASLGEDGPTGGFFFLDERLPW

SEQ ID NO: 8009 - protein, 320 aa, Hordeum vulgare
MASAKATMGQGEQDHFVLKSGHAMPAVGLGTWRAGSDTAHSVRTAITEAGYRHVDTAAEYGVEKEVGKGLKAAMEAGIDRKDLFVTSKIWCTNLAPERVRPALENTLKDLQLDYIDLYHIHWPFRLKDGAHMPPEAGEVLEFDMEGVWKEMENLVKDGLVKDIGVCNYTVTKLNRLLRSAKIPPAVCQMEMHPGWKNDKIFEACKKHGIHITAYSPLGSSEKNLAHDPVVEKVANKLNKTPGQVLIKWALQRGTSVIPKSSKDERIKENIQVFGWEIPEEDFKVLCSIKDEKRVLTGEELFVNKTHGPYRSARDVWDHEN

SEQ ID NO: 8010 - protein, 433 aa, Rickettsiella grylli
MISSHELFNKAKQRIPGGVNSPVRSFHAVGGEPLFFSQGKGAYLFDVQDKPYIDYVGSWGALILGHAPEKIVAAVDEAVKCGLSFGTATPGEIYFAEKISNLMPHLEKIRLMNSGTEATMTAIRLARGFTGRDKILKFNGCYHGHVDSLLVKAGSGVAHFSIPDCIGIPKEVVSQTLSVEFNNLEQVAQMFMHHGKEIAAIIIEPIAANMNCILPLPGFLEGLRELCDYYGSLLIFDEVISGFRVALGGAQEIYHVKPDLTTLGKIIGGGLPVGALGGRAEIMDCLAPEGKVYQAGTLSGNPLTVAAGLATLEVVSQPGFYSALNAINEKLVAGLRARANDANICFQAHAIGGLFGFVFTQTEIYNYQHVKLAYQPLFKEFFHRMLAEGIYFSPSPFESGFLSSAHGEYEIDATLVAAEKVFSKLKEKNLMLS

SEQ ID NO: 8011 - protein, 91 aa, Triticum aestivum
MAGAAKASWMVAMSVGAVEALKDQAGLCRWNYALRSIHRAAKARANVRGTVSLGTKQASCIHGGRVAERRRAEKAEEGLRTVMYLSCWGTN

SEQ ID NO: 8012 - protein, 338 aa, Vibrio sp. Ex25
MSGLRTLGEFIVEKQADFPHASGDLSSLLASIRLAAKIVNREINAAGLGDITGAVGTENVQGEDQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEEGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 8013 - protein, 85 aa, Prunus mume
FVQQWPPTTCRFRKKCFKPRPLQIFTIHGLWPSNYSSPTKPSSCTGSEFKELPPRLRPKLKISWPNVESSNDTKVWEHEWDKHGT

SEQ ID NO: 8014 - protein, 87 aa, Prunus mume
FVQQWPPTNCRVRTKCSKPRPLQMFTIHGLWPSNYSNPTMPSNCNGSQFDARKVSPQLRNKLKRSWPDVESGNDTKFWEGEWNKHGT

SEQ ID NO: 8015 - protein, 423 aa, Xanthomonas campestris pv. vesicatoria str. 85-10
MSTAPQKPLAIRERLSEVRYEIRGELARRARELEAQGRKLIKLNIGNPGAFGFRAPEHLQRAIADDMGRTDPYTHQQGLPEAREAVATAYSRRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLQLVAPAGALYAFPAVVGAAARNFDDHAFALDLMNEEGVLVVPGSSFNVPYRHHFRVTLMPEAGVMRDVFARIDRALARRAEAITKVVPLKPRNVA

SEQ ID NO: 8016 - protein, 141 aa, Brassica napus
  misc_feature (9)..(9): Xaa can be any naturally occurring amino acid
  misc_feature (136)..(136): Xaa can be any naturally occurring amino acid
  unsure (1)..(141): unsure at all Xaa locations
MALAYDPLXFITSDKSSMDVPSTPPPMVLTQDELKRIAAYKAVDFVESGMVLGLGTGSTAKHAVARIGELLRQGKLSNIVGIPTSKKTQEQALSLGIPLSDLDAHPVIDLSIDGADEVDPHLNLVKGRGGSLLREXMIEGA

SEQ ID NO: 8017 - protein, 88 aa, Prunus mume
FVQQWPPATCIRSNKPCTKHRPLPIFTIHGLWPSNYSNPRMPSNCRGSLFETRKLSPELQSKLKRSWPNVETDNDTKLWEHEWNKHGR

SEQ ID NO: 8018 - protein, 89 aa, Prunus mume
FVQQWPPTNCRVRIKRPCSKPRPLQNFTIHGLWPSNFSNPTKPSNCNGSKYEDRKVYPKLRSKLKRSWPDVESGNDTRFWEDEWNKHGT

SEQ ID NO: 8019 - protein, 276 aa, Streptomyces cinnamonensis
MNKTVAPEPSDIGHYYDHKVFDLMTQLGDGNLHYGYWFDGGEQQATFDEAMVQMTDEMIRRLDPAPGDRVLDIGCGNGTPAMQLARARDVEVVGISVSARQVERGNRRAREAGLADRVRFEQVDAMNLPFDDGSFDHCWALESMLHMPDKQQVLTEAHRVVKPGARMPIADMVYLNPDPSRPRTATVSDTTIYAALTDIGDYPDIFRAAGWTVLELTDITRETAKTYDGYVEWIRAHRDEYVDIIGVEGYELFLHNQAALGKMPELGYIFATAQRP

SEQ ID NO: 8020 - protein, 662 aa, Rubrobacter xylanophilus DSM 9941
MGIAGDIALILIAALLGGIVAQRLGLPLILGYILAGIFVGPNSPGPTVGNVHEIELLAEIGVALLLFTIGLHFSLDELAPVRKVALIGTPIQLGLTALFGYGLGRLLDLGWQESVWLGAILSMSSTAVALKTLGEQGVMGTLSSRVMVGMLLVQDLAIVPIIILLPELGSLGEGLSELGVAAVEAALFLVGMSVFGIRVFPWLMSRIVQWGSRELFLISVVAIGLGVGYGTYLFGLSFAFGAFVAGMVLSQSEYSHQALADVGPLRDVFTMLFFVSVGMLIEPAFLVERAGTVALVVVLVALVKGLIFAGVTRAFGYGNIVPFAAGLGLFQVGEFSFVIARVGVNEEAVSQATYSMVLSVAVITMALTPFAARLAPVVYGRWRERFPRELMSTFNLPREGLHDHVVIAGYGRVGTFVAHLISRLGKEFVVVENNPSRADEARKAGFPTVYGDAVADPVLEAAGVGRARLVILTVPDALTTRLAVERVRALNPEVRIVARSESVEELEELARLGVYEVVQPEFEAGLELGRQALVQLGAGPEEVQRFYDQVRRELYAPLSGRRAGGEELLDRLRGASRMIETEWVRIDEESGLAGRSLQEAGVRARTGASVVAVIRGEEAMPSPEPSTVLEAGDVVGVLGTPRQREAFRELAAARQDEPMREP

SEQ ID NO: 8021 - protein, 105 aa, Triticum aestivum
  misc_feature (87)..(87): Xaa can be any naturally occurring amino acid
  unsure (1)..(105): unsure at all Xaa locations
MAGAAKASWMVAMSVGAVEALKDQAGLCRWNYALRSIHRTAKARANVHGAVSQGSKQLPASAAAVAEKQRAEKAEEGLRTVMYLSCXGAKLAAAAWYSRLQLGTS

SEQ ID NO: 8022 - protein, 745 aa, Zea mays
MSGAVLVAIVASIGNLLQGWDNATIAAAVLYIKKEFQLQNEPTVEGLIVSMSLIGATIVTTFSGPLSDSIGRRPMLILSSILYFFSGLIMLWSPNVYVLLLARFVDGFGIGLAVTLVPLYISEIAPSEIRGLLNTLPQFSGSGGMFLSYCMVFGMSLSPSPDWRIMLGVLAIPSLFFFGLTIFYLPESPRWLVSKGRMAEAKKVLQKLRGKDDVSGELSLLLEGLEVGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSEVAAKGSRWKDLFEPGVRRALLVGVGIQILQQFAGINGVLYYTPQILEQAGVAVILSKFGLSSASASILISSLTTLLMLPCIGFAMLLMDLSGRRFLLLGTIPILIASLVILVVSNLIDLGTLAHALLSTVSVIVYFCCFVMGFGPIPNILCAEIFPTRVRGLCIAICAFTFWIGDIIVTYSLPVMLNAIGLAGVFSIYAVVCLISFVFVFLKVPETKGMPLEVITEFFAVGAKQAAAKA

SEQ ID NO: 8023 - protein, 195 aa, Glycine max
  misc_feature (189)..(189): Xaa can be any naturally occurring amino acid
  unsure (1)..(195): unsure at all Xaa locations
MGNAQSPPNNDPRYVSATRAFTQKELEDLRSLFINLANQSQSNGKYISPSVFQSYFGLHGPLGERMFDLVTQERKDQRLTFEDLVDAKATYEKGTKDEIEEFIFRLLDVSGDNFVGRSDLETVMIAIFNDILRIKGSDDRSSSHEDIVNIFLNAANFSKQDGGGTEETMSFEDFRSWCTHLPSVRKLLXSLLLPP

SEQ ID NO: 8024 - protein, 336 aa, Antirrhinum majus
APIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 8025 - protein, 328 aa, Trichodesmium erythraeum IMS101
MANYAPAIETMTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 8026 - protein, 627 aa, Oryza sativa
  misc_feature (138)..(138): Xaa can be any naturally occurring amino acid
  unsure (1)..(627): unsure at all Xaa locations
MLPRRRAGPLRLLRLLLVLVVAFAAVVAFCPAAAAAAGEGVGVVEEEEVRVGEAAAAVARGEGDDAVVAAAVAGGEVAGEAGAGLGEGAAAANATGKEGSLAEMIDRALEKEFPESEGEQGGGEKDPGSFNNTVAEKXGVLETVARRVTKKNETKDNKSFPFKEVFLDRPEQEDVPTLIDRKDNVFIISNPKSKYPVLQLDLRLISDLVVVIVSATFGGIAFACLGQPVITGYLLAGSIIGPGGFSFVSEMVQVETVAQFGVIFLLFALGLEFSTAKLRVVRAVAVVGGLLQIILFMLLCGISATLCGGKTKEGVFVGVLLSMSSTAVVLKFLMERNSINALHGQVTVGTLILQDCAVGLLFALLPILSGASGLLQGVASMAKSLVVLITFLTILSILSRTGVPWFLKLMISLSSQTNELYQLAAVAFCLLFAWCSDKLGLSLELGSFAAGVMISTTDLAQHTLEQIEPIRNFFAALFLASIGMLINVHFLWNHVDILLAAVILVITVKTFIVAVVVKGFGYSNKTSLLVGMSLAQIGEFAFVLLSRASSIHLIEGKLYLLLLGTTALSLVTTPLLFKMIPAVVHLGVLLRWFSVDSNQVELGLKSDGLRIDSGKRINLIVQGSHDS

SEQ ID NO: 8027 - protein, 251 aa, Dehalococcoides ethenogenes 195
MRQIIIAGNWKMNTTLSEACTLVQGMKYELDQISGIQKIVCPPFISLAPVKTILDGSSIHLGAQNLFYEEKGAYTGEISPLMLQDICPYVIIGHSERRAYFGETGQVVNRKIKAALQAGIMPIVCVGEKLEENENGQTRQILETQMKEALAGINPSSIIIAYEPIWAIGTGKAATAAEANNTISYIRKVLGDIWGNTASRITPILYGGSVNEKNTAELLCQSDIDGALVGGASLKAESFVSICRQAADVRK

SEQ ID NO: 8028 - protein, 101 aa, Arabidopsis thaliana
  misc_feature (35)..(35): Xaa can be any naturally occurring amino acid
  misc_feature (73)..(73): Xaa can be any naturally occurring amino acid
  unsure (1)..(101): unsure at all Xaa locations
SRDTLGGRILSSMLSSTGGATYPAHATMGAKYTGXKSSAFIPGTRKGNIDITGITITGGRDSLLKVGPPIAKXQAETLDHLPGLSGVEQNNEDDDPLHSKW

SEQ ID NO: 8029 - protein, 411 aa, Sinorhizobium meliloti 1021
MKGRAARPVLFFFFQRSTRSSDVKALTWHGKGDIRCESVPDPKIEDDRDAVIKVTACAICGSDVHIFHGLIPSMENGDILGHETMGEVVEVGKGARGLEVGDRVVVPFTIACGECFFCRKGFYSACERTNPDREKAAKLWGNSPAGLFGYSHLLGGYSGGQAEYLRVPHADVGPIKVPDELTDEQALFLSDIFPTGYMAAEFCNIEPGQTIAIWGCGPVGQMAIRSAFLLGAERVIAIDSIPERLRLAESAGAMTLDYMAEDIYDRIMEITHGRGADACIDAVGTEADSRASLDSLVDRVKVATFMGTDRPHVLRQAIHCCRNFGTVSVVGVYGGYLDKVPLGSAINRGLTLRMAQTPVQRYLPSLLDRIRKGEIDPSFVVTHRGGLDDGPELYKTFAERKDGCIKVVLRP

SEQ ID NO: 8030 - protein, 374 aa, Leptospira interrogans serovar Lai str. 56601
MSFHFQTFYGIFSLEFTDPQKNSVGIIFLEESMSVHPTQTLSLSQYLIEEQLKLPQATGDFTALMSHLVYAAKIVSREVRKAGLLENILGATETVNVQGETQMKLDEYADKVFNHTLTRSGHLCILGSEEHEETVPVPNGYKIGKYTIAIDPLDGSSNIDANVSIGTIFSVHLRKSPAGTPGTLSDLLQQGSGQRAAGYVLYGSSTMLILCTGKGVSGFTLDPSCGEFILSHPDMQIPETGGIYSINEGNYNYWSDEVKNYIRDIKSIEGGRKPQSGRYIGSLVADFHRNLLKGGIFLYPNDTKSTKYPNGKLRLLYEAAPMAFIAEQAGGMAVTVYGERILDLTPKELHERTTLVVGSKKEVEHFLKFAPKKS

SEQ ID NO: 8031 - protein, 157 aa, Triticum aestivum
  misc_feature (59)..(59): Xaa can be any naturally occurring amino acid
  unsure (1)..(157): unsure at all Xaa locations
MEASGAAAKGKKGAAGRKAGGPRKKSVTRSVKAGIQFPVGRIGRYLKKGRYAQRVGTGXAPVYLAAVLEYLAAELLELAGNAAKDNKKSRIIPRHLLLAVRNDEELGKLLAGVTIAHGGVIPKINPVLLPKRTAEKEGKEPKSPKKATKSPKKATKA

SEQ ID NO: 8032 - protein, 286 aa, Synechococcus sp. WH 5701
MSFGGHHTRKRFGQHWLTDAAVLERIVAAAELQPGERVLEVGPGRGALTERLLATALGELHAIELDRDLVAGLRQHFAGDERFQLLEGDVLRLNLPPADKVVANIPYNITGPLLERLVGRLDRPLASPYRRLVLLVQQEVGERIRAVAGSSAFSALSVRLQLLAHCRSVCAVPPRCFQPSPKVMSEVIVIDPLPPSERLEPELAGRLEGLLKRCFAARRKMLRNSLAGLWPEDELSERAERAGVSLRQRPQELSPQRWVELTRQLCPRPQFPRESSSPIPEKTAHG

SEQ ID NO: 8033 - protein, 88 aa, Prunus mume
FVQQWPPTTCRVRKRPCTKPRPLQIFTIHGLWPSNYSDPWKPSNCSGSQFKDGKVYPQLRSKLKKSWPDVESGNDTKFWEGEWNKHGR

SEQ ID NO: 8034 - protein, 266 aa, Listeria monocytogenes
MNRIGFIGAGNMGTAMIRGLAQANLVKREEIIVGGRNLEKLKPLEAEFTGLQITTDTEKLVEQADIIILAVKPYTIPEILTSVKEKLTPDKIIISVAAGVTIQDLEELTSAKTKIVRVMPNTPALVGEAMSSVSPNTNVTSEELKEVTAIFTSFGEAEVVSENLMDAVIGVSGSSPAYVYMFIEALADGAVLSGMPRDKAYKFAAQAVLGAAKTVLETGEHPGKLKDMVTSPGGTTIEAVKSLENDGFRSAVINAVQAAAKKNSSM

SEQ ID NO: 8035 - protein, 87 aa, Prunus mume
FVQQWPPTTCRVRGKCSNPRPIQIFTIHGLWPSNYSNPTTPSNCIGSQFKESMVSPRLRSKLKRSWPNVEGSNDTRFWEGEWNKHGT

SEQ ID NO: 8036 - protein, 696 aa, Arabidopsis thaliana
MRITFFASLLLFTNTIFISFSFAIAGINKESPLSIGQTLSSSNGVYELGFFSFNNSENHYLGIWFKGIIPRVVVWVANRENPVTDSTANLAISSNASLLLYNGKHGVAWSSGETLASNGSRAELSDTGNLIVIDNFSGRTLWQSFDHLGDTMLPFSALMYNLATGEKQVLTSWKSYTNPAVGDFVLQITTQVPTQALTMRGSKPYWRSGPWAKTRNFKLPRIVITSKGSLEISRHSGTDWVLNFVAPAHSCDYYGVCGPFGICVKSVCKCFKGFIPKYIEEWKRGNWTDGCVRRTKLHCQENSTKKDANFFHPVANIKPPDFYEFASAVDAEGCYKICLHNCSCLAFSYIHGIGCLIWNQDFMDTVQFSAGGEILSIRLARSELGSYLFEMNTIQTATNNFSLSNKLGQGGFGSVYKGKLQDGKEIAVKRLSSSSGQGKEEFMNEIVLISKLQHKNLVRILGCCIEGEERLLIYEFMLNKSLDTFLFDSRKRLEIDWPKRFDIIQGIARGIHYLHRDSCLKVIHRDLKVSNILLDEKMNPKISDFGLARMYQGTEYQDNTRRVVGTLGYMSPEDILEIISGEKISRFSYGKEEKTLIAYAWESWCETGGVDLLDKDVADSCRPLEVERCIQIGLLCVQHQPADRPNTLELMSMLTTTSDLPSPKQPTFVVHWRDDESSSKDLITVNEMTKSVILGR

SEQ ID NO: 8037 - protein, 619 aa, Bradyrhizobium japonicum USDA 110
MERRYGGCTHLRVGASLHVEPCDDARLRIDRRTAEVKGAGIRQFFRNSRSFVLGAGIGSGMTARAAERAGADFVLALNAGRFRAMGGASPASILPIRNSNEFVASFGRTEILPSTKLPVFFGTCTFDPELDVDRWLDRIIKWGFAGVTNFPSVIHIDDERRSLLEKCGLGYSREIELLVKAAKRGLMTIAYTRSQSEARRMVEAGAEAICINFNLNRAIESGADPSVSLSELAARTSAVARVAQSVNKSTICLLGGGPITKPDELLDICRETGIQGFIGGSSLDRVPLEMSVLEVTSGFKTIHLLREKVDLLERQLQLSGFRHGVIAQSSAMKRILEITRRVAATPRPVLIWGEAGSGKRRIATLVHAFSDRRHAKTALFHCRPGPAMDILGPLFGAERLESGRRQLSLLEASSDGAVVLLHVDQLSRDGQERLADYLETGGFTPLNGVTVMRSNARIIATATVARGAGLETVLCARLLDLFTGLDVQLPSLPDRLEDLPQLVQHFTVEAKGDSSAQTLTIENSAFLALAGHDWPGNLRELRQVVNQLVTLPSSHITGEVLKPLLEPPFGARPAASLSERDWIIEGLKRNRLHRGKTARSLGLSRKTLYNKIKKLRILE

SEQ ID NO: 8038 - protein, 88 aa, Prunus mume
FVQQWPPTTCKLSSRPSCKHRPLQIFTIHGLWPSNYSNPTRPSNCIGSKYNDSKLYPKLRSKLKRSWPNVETDNDTKFWEGEWNKHGR

SEQ ID NO: 8039 - protein, 340 aa, Magnetospirillum magnetotacticum MS-1
MVSEYHQYLSSIEDIIEEARQGRMFILVDDEDRENEGDLVIPADMANADAINFMARFGRGLICLSLTRGRCEHLGLKPMSSDNGTRMETAFTVSIEAREGVTTGISAADRATTIKAAIDVDKNRYDIVSPGHVFPLMAREGGVLVRAGHTEAAVDISRLAGLNPSGVICEIMNDDGTMARMPDLVKFAQHHGLKIATIADLIAYRRRNDKIVAREVETPFHSKWGGDWTMVVYTNTVAYAEHIALVKGDLNAAGPVMVRVHAVNILDDVLGDQGVGQGGRASFRHGNDCGSRQWRGGSNPRAAPHQPVGHGARPSGTPPGGSGFARLRRRRSDPAGSWGP

SEQ ID NO: 8040 - protein, 488 aa, Listeria monocytogenes
MSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATEKGAKVLTGGGRLTGSDYDKGNFYKPTVLDNVTRKMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 8041 - protein, 878 aa, Zea mays
MRRRRCPLLAAVLFLLPLFHRHHAASGTDTDTVTLAAPLMGNRTLVSAGSAKYVLGFFAPDPDATGSGRAYLGIWFNGIPARTVVWVANRESPVLGSVGAAALRVLANGSLAIVVVDETDYDHDQQPVVWATPPPATSSGSNATAQLLDNGNLVLRVPGAGVVWQSFDHPTDTLLPGMKLGIDFRTGLDRRMVSWRAAGDPSPGEYSFRLDPSGSPELFLYRGSARVYGSGPWNGYQFTGVPNLKSNSLLTFRFVSAADEAYYSYGVVDSAAVLTRFVLDSSGQIQRLMWIDMTRSWSLFWSYPLDECDGYRACGPYGVCSVERSPICGCAPGFDPRFPKEWALRDGSGGCRRRTDLACAGDGFAALTNMKLPESANATVDMSLTLDQCREACLRNCACRAYAGANVSAPGATGCFLWTGDLLDMRQFGKGGQNLFVRLAASDLPLSSSSPADTDGRTKRLVEIIVPSVAAPALLLLAGLCICAVRTRRRRTKEKEAIPLALLRDAQRQSAPFGRRNQIAASTDAQDESLHDGQQGGSQDCDLPSFDVETIQAATGNFSAHSKIGQGGFGPVYMGKLDSGQDIAVKRLSRRSTQGLREFKNEVKLIAKLQHRNLVRLLGCCIDGSERMLVYEYMHNRSLNTFLFNEEKQPMLSWEKRFSIINGIARGILYLHQDSALRIIHRDLKASNILLDKDMNPKISDFGVARIFGTDQTAAYTKKVVGTYGYMSPEYAMDGVFSTKSDVFSFGVLVLEIVSGKKNRGFYHTELDLNLLRYAWRLWKDGESLEFMDQSIADTSNAAEVLKCIQIGLLCVQEQPKRRPTMSAVTTMLTCENPTLPEPCEPAFSTGRNHDDDDEDPEAKACRSNSASSWTCTVVEGR

SEQ ID NO: 8042 - protein, 335 aa, Debaryomyces hansenii CBS767
MAITIGINGFGRIGRLVLRIALQRSDIKVVAVNDPFIAPEYAAYMFKYDSTHGRYKGEVTSKDDSLVIDGQSIKVFGEKDPASIPWGKAGVDYVIESTGVFTTTEGAQKHIDGGAKKVIITAPSSDAPMFVVGVNEQKYTPDLKIVSNASCTTNCLAPLAKVINDKFGIEEGLMTTVHSITATQKTVDGPSHKDWRGGRTASGNIIPSSTGAAKAVGKVIPELNGKLTGMSLRVPTVDVSVVDLTVRLKKSATYEEISEAIKAASNGELKGILGYTEDAVVSTDFLGSDYSSIFDQKAGILLSPTFVKLISWYDNEFGYSTRVVDLLEHVAKASN

SEQ ID NO: 8043 - protein, 288 aa, Bordetella pertussis Tohama I
MGAITIAPMSAEVRSLSLPEPAALARAIAARLPAFRDISWVGSTGSTNADLLARARAGGGARPCLLGAHLQETGRGRAGRPWQNRVGAALMFSCAFDVDLPPSQLPALSPLAGMAACEALRQLVGQPAGLLVKWPNDVQWHDAKLAGVLVESVRNPAGTGHAVVIGMGLNLHGGDALSQALQRSVADWNDVAGPGEKGPDAAADLVAAVARAWQDAAHTLQQEGFGAFGARFARVDALAGRPVNVIDRGEILYTGAASGVDDHGRLLVQAADGMRPVSVGEISIRPQA

SEQ ID NO: 8044 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 8045 - protein, 523 aa, Methanococcoides burtonii DSM 6242
MKVLVSDSLSEEGVSKLSEHFDVDVSTGLSEDELVEKIGIFDALVIRSGTHVTKRVIEAADNLKIIGRAGVGVDNVDVDAATEKGIIVVNAPEGNMLSAAEHTIAMMMSMARNIPQANASLKAKKWERKNFMGVEVNGKTLGVIGLGRIGAEVAKRAQGLEMSILAYDPFVTEDRAKDMGVELTTVDDIAQRADFITVHTPLIKETRNILDKAQFDMMKSSTRVINCARGGIINEEALADAARNGKIAGAAIDVFTSEPPFDCPFIGLDNVIVTPHLGASTEEAQVNVAVSVAEEIISVLNGGSARNTINIPAVKPEVMAILAPYIGLAETLGSVAAQLLDANYNKIEISYNGEIADKDTRAVTVAALKGILEDAVGSAVNYVNAPSLAKSRNVEVVESKSETSGDHASTIRITLFQGTNTKSVSGAVVGREPKIVMIDGQYVDLVPNGFMIVSNHVNRPNVIGPCCIVLGENNINISGMQVGRVEVGGNTIMALNVDNEVSEGILDEIRAINGILDAKLVTL

SEQ ID NO: 8046 - protein, 101 aa, Arabidopsis thaliana
  misc_feature (10)..(10): Xaa can be any naturally occurring amino acid
  misc_feature (18)..(18): Xaa can be any naturally occurring amino acid
  misc_feature (37)..(37): Xaa can be any naturally occurring amino acid
  misc_feature (46)..(46): Xaa can be any naturally occurring amino acid
  misc_feature (55)..(55): Xaa can be any naturally occurring amino acid
  misc_feature (58)..(58): Xaa can be any naturally occurring amino acid
  misc_feature (63)..(63): Xaa can be any naturally occurring amino acid
  misc_feature (69)..(69): Xaa can be any naturally occurring amino acid
  misc_feature (72)..(72): Xaa can be any naturally occurring amino acid
  unsure (1)..(101): unsure at all Xaa locations
MASSMLSSTXVVTSPAQXTMVAPFTGLKSSASFPGTXKANNDLTSXTSNGGRVSXMKXVWPPXLVKKKXGTXFLTDLGGGWKTLKFAEFGLWPLLCSHLKL

SEQ ID NO: 8047 - protein, 373 aa, Ashbya gossypii ATCC 10895
MSEQDQELRNRQAQFAKELHGESVERSGLTALLGKNREAQQEAVAKYLRHWDGATDAEAEERRLADYNESTHSYYNVVTDFYEYGWGASFHFSRFYTGESFAMSMARHEHYLAHRAGITSGDLVLDVGCGVGGPAREIARFTGCRVVGLNNNDYQIMKGKHYSRKLGLGDQVSYVKGDFMNMDFPDATFDKVYAIEATCHAPSFEGVYGEIYRVLKPGGVFAVYEWVMTENYDETNPEHRRIAYDIELGDGIPKMYSVKVARDALAKVGFEILVDEDRADNDDPVPWYYPLTGEWAYIQTIADLGTFVRTSALGRRVTSAFVSLMETLRLAPRGSSEVVNALESAAAGLVAGGKSKLFTPMMLFVARKPETAE

SEQ ID NO: 8048 - protein, 290 aa, Triticum aestivum
  misc_feature (125)..(125): Xaa can be any naturally occurring amino acid
  unsure (1)..(290): unsure at all Xaa locations
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFXSMGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASQVKEGKEAWKAPAEDHVVVINVGKADKSSCAEVRPVTEMAGAVDVPRRCAAEAAAAPGVDFARSVNVV

SEQ ID NO: 8049 - protein, 441 aa, Nostoc commune
MLERMYNQGAVEGAANTELGSRIFLYEVVGLRQSEETDQTNYPIRKSGSVFIRVPYNRMNQEMRRITRLGGTIVSIQPATALQPVNGKASLGNATSEVSELATSGETANTEGNGKATPVNAHSAEEQNKDKKGNTMTQAKAKKDHGDVPVNTYRPNAPFIGKVISNEPLVKEGGIGIVQHLKFDLSGSNLKYIEGQSIGIIPPGLDKNGKPEKLRLYSIASTRHGDDVDDKTVSLCVRQLEYKHPETSETVYGVCSTHLCFLKPGEEVKITGPVGKEMLLPNDPDANVIMMATGTGIAPMRAYLWRQFKDAERAANPEYQFKGFSWLIFGVPTTPNLLYKEELEEIQQKYPDNFRLTAAISREQKNPQGGRMYIQDRVAEHADELWQLIKNEKTHTYICGLRGMEEGIDAALTAAAVKEGVTWSVYQKELKKAGRWHVETY

SEQ ID NO: 8050 - protein, 411 aa, Karlodinium micrum
GTRPRAEFGTRIQKASEQEDPAETLATFLLALGPSVGVSSMGNSRPSAAVQMSTNPDAPIKLGVNGFGRIGRQVVRIAMDKDDFVVKHINSPMSPEYMKYLLEHDTVHGRFKGTVQLSDDGLIINGLPVSLSATRDPTEIPWKDAGVEYVCESTGAFTTTEGCMKHIEGGAKKVIISAPAKDADTPTIVVGVNTDDYETSMKVVSCASCTTNGLAPIVKVINEKFGIKQGLMTTVHAATASQLTVDGSMKGADWRAGRAASANIIPSSTGAAKAVAKAYPVMKGKLTGMAFRVPTVDVSVVDLTCELETETTYDDIKAEVKLASETYAKGIVGYTEDQVVSSDFVGETCSTVFDAGAGIMLTPTFVKLVSWYDNEWGYSTRLVDLVGTMAKVDGIEVKDESAVYFTARKVE

SEQ ID NO: 8051 - protein, 409 aa, Pseudomonas fluorescens
MLEEEAARFKPEDWGMKRSGANEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQKAYTVIEAITGFRLHPAWYRIGGVAHDLPRGWEKLVKDFVEWMPKRLDEYTKAALQNSILKGRTIGVAAYNTKEALEWGVTGAGLRSTGCDFDLRKARPYSGYENFEFEVPLAANGDAYDRCMVRVEEMRQSIKIIDQCMRNMPEGPYKADHPLTTPPPKERTLQHIETLITHFLQVSWGPVMPANESFQMIEATKGINSYYLTSDGGTMSYRTRIRTPSYPHLQQIPSVIKGSMVADLIAYLGSIDFVMADVDR

SEQ ID NO: 8052 - protein, 594 aa, Mesorhizobium loti MAFF303099
MPHDTPLIATIVAGLGLAFVFGALANRFRIPPLVGYLVAGVLVGPNTPGFVADAGLANELAEIGVILLMFGVGLHFSLKDLLSVRAIAVPGAIVQIGFATALGAGLSWMLGWSMGAGLVFGLALSVASTVVLLRALQERRLIETERGRIAVGWLIVEDLAMVLALVLLPALAGVLGGQEQADVQLSGLLSLPASYGIWGVVGITLAKVAAFVVVMLVVGRRVIPWILHYVAHTGSRELFRLSVLAIALGVAFGAAKLFGVSLALGAFFAGMIMSESELSHRAAEESLPLRDAFSVLFFVSVGMLFDPFSLLSNGLPILATLAIIVIGKSLAAFVIVVAFGYPLATALMISASLAQIGEFSFILAELGVGLKLLPEQGRDLILAGAILSIVLNPLMFLVVDWMKPWLEARAARSAPPADAKPVGPATEPGQVASVAAAAKKEDGPPPKTALTGHAILIGYGRVGGLVGAALKEAALPFLVIEDADKTLAKLKADGVETVAGNAANAEVFAAANPEDASRLILAIPNAFEAGQIVLRARAANPGINVVARAHSDAEVEHLKGLGADTVIMGEREIARGIVEEVLGRKPSATEPSAA

SEQ ID NO: 8053 - protein, 413 aa, Zea mays
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFLLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 8054 - protein, 335 aa, Chromobacterium violaceum ATCC 12472
MSRITLSRFLIEQQRKAGTLPPELRLLIETVGRACKAISYSVNKGALADVLGEAGTGNIQGEAQKKLDVIANDFLLDANEWGGSLAAMASEEMELPYHIPGEYPKGEYLLMFDPLDGSSNIDVNISVGTIFSILRCPEGVTQPTETDFLQPGTHQVAAGYTVYGPQTMLVLTFGSGVHGFTLDREHGSFVLTHPDMKVPERTAEFAINMSNMRHWEAPVRRYVEEMLAGKTGPRGRDFNMRWVASMVAEVHRIITRGGIFMYPKDARDPSKAGKLRLMYEGNPMAFIIEQAGGAATNGHQRILDIVPTKLHERVAVFLGSKEEVELVTRYHSEQQ

SEQ ID NO: 8055 - protein, 445 aa, Vibrio sp. Ex25
MRSTWSEQSKEDNPMTKSSELYQKAQQTIPGGVNSPVRAFNGVGGSPLFIERADGPLIFDADGKAYIDYVGSWGPMILGHNHAVIREAVIDAAQRGLSFGAPTELEIAMAELVSELVPSMEQIRMVSSGTEATMSAIRLARGFTGRDKIMKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYVAPTGPVYQAGTLSGNPVAMAAGYACLNLLKEEGNEKRLASKTKQLADGFKSLAEKHGIPLVVNQVGGMFGFFFTDQEKVTCYEDVTKCDVERFKRFFHLMLKHGVYLAPSAFEASFTSLAHGSKEIDATLEAADRCFATLAEEAK

SEQ ID NO: 8056 - protein, 242 aa, Anaplasma marginale str. St. Maries
MHGFVIHHTSVSRSTNLEAIELAQSGAPDGTVIIADEQTSGTGRYGREWHSPKGNLYCSIITRRSAQVAALSFLSSLAVGVTLEQVFEAHNCSTKNALIRYKWPNDVMVDGKKISGVLIKTKMIGGEIDWAVCGIGVNMYAPPPYAASLHDYIPELKLSNLELLDLMLQNFAKLLDVLETMGFAQLRSLWMRRGHTPGDKIRVITNNNMIIEGKFVNIDTHGAMVLESDGGIPTAVDYGEML

SEQ ID NO: 8057 - protein, 472 aa, Pseudomonas syringae pv. phaseolicola 1448A
MFTPVILAGGNGSRLWPLSRQSFPKQFLALDGQDQGTMFQRTLARLNGLEHTPAVVVSNENHRFIVAEQLRVAKMASRRVILEPLARNTAPAIALAALEATADGTDPILLVLASDHHIHDEEAFRQAVKIAQVHAEAGRLVTFGITPTHAETGFGYIHCGDAIAEGGFAIEAFKEKPSPEMAAEYLSSGAYLWNSGMFMFRASVFLAELRKHRSDILSACRIALENSEADSYFLHVSSEKFALCPDESVDYAVMEHTTAGLVVPLDAGWNDLGSWAAIWDVGPHDANSNRLEGDVMVIDTRNCLVQSHHRLVATVGVEDLIVIETKDAVLVANKHNSQQVKDVVKRLQAEERPEFVTHPLVNRPWGHYDTIDLGERYQVKRISVLPGECLSLQMHYHRAEHWIVVSGTAKVICDDQELILSENQSTYIPLGVKHSLANPGKVPLELIEVQSGSYLGEDDIVRFEDRYGRLKK

SEQ ID NO: 8058 - protein, 290 aa, Helicobacter pylori 26695
MDYKCFKGKHANIVIEIISLLEKGVKKAQEILEKPDAGSYTKLENSSGDTPIKADLALDKFLEENFLSLENIKSVFSEEKETPVTKENGSYLIAYDPLDGSSVMEANFLVGTIIGIYEKDYKAQNLAASLYVVFGHKIELVVALEEVYRYSFYQNKFHFIETIVLENKGKIVASGGNQKDFSLGLKKALEGFFAENYRLRYSGSMVADVHHVLVKKGGMFSYPQKKLRKLFEVFPLALMVEKAKGEAFYFDKGVKKRLLEQSVENYHEKSECYLASQHEAHILEKYLKGE

SEQ ID NO: 8059 - protein, 261 aa, Rickettsiella grylli
MNVLEFVKKKIIQEKIVILTCYDYSSAKILNSSSLDALLVGDSLAMTMHGFKNTVMATVPMMELHTAAVARGAPSKFIISDLPFLSYRLSMNRNVITAQKLIRAGASAVKLEGSAGNLSLITHLVESGIPVMGHIGLTPQFIHCLGGYKVQGKTFAQSERLKQEAIALEQAGCFALVLECVPSQLAKEITASLKIATIGIGAGVDTDGQVLVLQDLLGLNLDFKPKFVHPFLDGKQLFLDAVNQYSDSVKYKEFPKHEHSY

SEQ ID NO: 8060 - protein, 273 aa, Colwellia psychrerythraea 34H
MNKIAFIGAGNMARAIIIGLVNSGITPQDIIVANPSETKRLNLATEFGVLQTNDNIKASEFADVIVLCVKPHFITDVCFQISQAIDIAGKLFISVAAGTTVAQIQSALSKDDTLNLAPVVRVMPNTPSQLGLGMSGLFASKEVAVEQKANAEKITNAVGKSIWLDTEDKINNIIAVAGSAPAYYFLFMEAMEQQAKQYGFSAEESRMLVQQTALGAAQMVAHNSAPISELRANVTSKGGTTHAAIERFKADGIEEIVKNAMNAAIARAVEMAK

SEQ ID NO: 8061 - protein, 272 aa, Brassica napus
  misc_feature (88)..(88): Xaa can be any naturally occurring amino acid
  unsure (1)..(272): unsure at all Xaa locations
VDPRVRNWLGIGLERKMKSSLVTVNRMFAKIISTRREEISRGEGEQLMDALTYYIKAAPASDRLLKPSNDTFIRDVAFSLLLAGRDTXTSSVLTWFFWLLSKHPHVLTKIRQEINTKFDPTYLEKLVYLHAALYETMRLYPPVPFNHKSPLKSDVLPSGHKVKAESKIVICIYALGRMRSVWGEDALDFKPERWISESGELKHEPSYKFMAFNAGPRACLGKHLALQQMKIVAVELIQNYDFKFTEGHKIEAVPSIVLRIKHGLSVTVTKKM

SEQ ID NO: 8062 - protein, 443 aa, Ashbya gossypii ATCC 10895
MPNKKHLFVLVHGLWGTHSHMNSIKTAFSEALGDDAVFYVPRSNGYVKTLHGIELVGYQTVVELTEFVQARDPQKFDRISFIGYSMGGLVSRFVIGTIFTECRVIFGHMRPVLFMTFATPHLGVQFYQPRNPQAKSTVMGAVLPVARFVGSHFLGRSGRQLFLAYENDDTLVRMTEGVYLEQLARFRHRVCLANVKNDRTVAFYTAFITDCDPFLETNNQLLYKFETALPTQDDLAVCPRVIDLAALDPVKSAPTHARKWHMGAMWLLLLLPFSFTLLPLLVFVNVLATMYSYMVTLTEQSRISRGDGHMIIKRRLKVAEGLNETVREAVGDIVNADFAVEPAQQAAPPAPSDRAMSWAKFLAKYSVNRPASDRFPRLPLDPKRQQMLRNLDSLAWIRVPVYIRALNAHDGIVARQGLKRSCESAVASVRFAALLARHLVSEA

SEQ ID NO: 8063 - protein, 544 aa, Sinorhizobium meliloti 1021; identical to SEQ ID NO: 316

SEQ ID NO: 8064 - protein, 418 aa, Karlodinium micrum
MNAIASVLVCLAYIGHARKPQKSSEQEDPAKTLATFLLALNGGIPSSSGTSISRPAVQMSTNPDAPIKLGVNGFGRIGRQVVRIAMDKDDFVVKHINSPMSPEYMKYLLEHDTVHGRFPGTVALSDNGLIINGLPVSLSATRDPTEIPWKDAGVEYVCESTGAFTTTEGCMKHIEGGAKKVIISAPAKDADTPTIVVGVNTDDYETSMKVVSCASCTTNGLAPIVKVINEKFGIKQGLMTTVHAATASQLTVDGSMKGADWRAGRAASANIIPSSTGAAKAVAKAYPVMKGKLTGMAFRVPTVDVSVVDLTCELEKETTYDDIKAEVKLASETYAKGIVGYTEDQVVSSDFVGETCSTVFDAGAGIMLTPTFVKLVSWYDNEWGYSTRLVDLVGTMAKVDGLEIKDESAVYFTARKVD

SEQ ID NO: 8065 - protein, 460 aa, Bacillus licheniformis ATCC 14580
MTEDVTDNDIHEQKLSRGLKNRHIQLIAIGGAIGTGLFLGSGKSIHFAGPSILFAYLITGIICFFIMRSLGELLLSNLEYHSFVDFVRDYLGDMAAFITGWTYWFCWISLAMADLTAVGLYTQYWLPDVPQWLPGLIALIILLIMNLATVKLFGELEFWFALIKVIAILALIAIGLFMIFKGFSTHSGTAAFHNLWSHGGMFPNGLHGFLLSFQMVVFAFVGIELVGLTAGETKDPEKVIPKAINNIPVRVLLFYIGALLVIMSIYPWNVINPNESPFVQVFAAVGIIAAASIINFVVLTSAASASNSAVFSTSRMIYSLAKEHNAPGAMTKLTSRKVPGNALFFSAVVILIGIMLNYIMPEQVFTLITSISTICFIFIWGITVICHLKYRRTRPDLAKRNKFKMPLYPFSNYVVLGFLAFILIVLALAQDTRVSLFVTPVWFIMLIAIYKLRKPKSRQV

SEQ ID NO: 8066 - protein, 270 aa, Campylobacter coli RM2228
MISFLEKKAKNEKITMVSAYDYHSARILDNSDIDIILVGDSLAMTVLGMQDTLSVTMDEMLIFTKAVSRGAKKSFVLADMPFMSYQSSDRDAILNASRFIKESHANGVKVEGGIEIASKIKLISQSGIPVVAHLGLTPQAVNMLGGYRVQGKDLQSAQKIIDDAKAVQDAGACMLVLECVPVKLAQKISSILEIPTIGIGSGKYCDGQVLVYHDLLGLNKDFKAKFVKHFDKIDPQVGVEKYRDEVKSGIFPSQEHSFDYLDDELLDKLY

SEQ ID NO: 8067 - protein, 344 aa, Mesorhizobium sp. BNC1
MPVPSSMPSAPNSKHGGTSAQAPTFRPAPDHESRRTMKTYKLVNRDVSAPGRDSAADADGSGVEMPMIGLGVFQTPPDETTAAVEEALRLGYRHIDTAAAYGNEREVGEGIRRAGIARDEVFIETKIWISDYGYDETLHAFDKSAGKLGVDQIDLLLLHQPLPSAFDRTLGAYRALEKLLADGKVRAIGVSNFMPEHLTRLLTETSIVPAVNQIEVHPYFQQRALQRLHAEHGILTQAWSPIGGITFYRGGEKSTLEDPVLLEIAQQHGKSAAQVMLRWHLQEGRSVIPKSTKPARIAENFDVFDFELSGEQIAAIDALDTGVRSGPEPDSITLESYGRPIPEA

SEQ ID NO: 8068 - protein, 305 aa, Desulfovibrio desulfuricans G20
MKIAITTSSFARFSEAPLQLLRQEHIDYVLNPLGRKLTENETIDLLQDCVAVAAGTEPLTARVMDALPGLKVISRCGTGMDNVDMEAARARGIAVRNTPDGPTQAVAELTLGLALDLMRQVSRMDRELRSGVWKKRMGNLLGGKRLGIVGMGRIGRAVADIFTPLGVQVAFNDPVSCCGDYPCMPVEELLGWADILSLHCSMTGGECSLFTAEHLRRMKRGSWVINVARGGLIDEQALYEALADGHLAGAAVDVFGNEPYTGPLSSLDNVILTPHIGSYAKEARIRMETDTIANLIDALRAAGVK

SEQ ID NO: 8069 - protein, 473 aa, Synechococcus sp. WH 5701
MANPAQDLLRRIRDEGIELIDLKFADLHGQWQHLTVCTDLLNEESFQSGLAFDGSSIRGWKAINESDMVMVPDPATAWIDPFLRHKTLSLICSIQEPRSGEAYGRCPRSLAQRALAHLAGTGLADTAYFGPELEFFLFEDVRYGSSEGGSFYSVDSIEAPWNSGRLEEGGNLAYKMNAKEGYSPVPPSDTFQDIRSEMLLTMGQLGVPIEKHHHEVAASGQQELGIRFAELISAADNVMIYKYVVRNVARKYGRSATFMPKPVFADNGSGMHVHQSLWRDGQPLFFGLGTYADLSQTARWYIGGLLRHAPSFLAFTNPTTNSYKRLVPGFEAPVNLVYSQGNRSAAVRIPLSGENPRAKRLEFRSGDAMANPYLAFSAMLLAGLDGIRQQIDPGDGMDLDLFELPPEDLEQIATLPSSLEGVLAALEADHEYLLAGEVFSEDFISNWIALKSEELQQLRQRPHPYEFSLYYDG

SEQ ID NO: 8070 - protein, 477 aa, Pseudomonas aeruginosa PAO1
MTADKKAKILATLGPATRSRDDIRALVEAGANLLRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNCHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 8071 - protein, 494 aa, Geobacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGASRRSARPL

SEQ ID NO: 8072 - protein, 334 aa, Arabidopsis thaliana
MSDAPSSSPDATASHWCYHCNKRVVVETLDDFVVCCECNKGFVESIQPTPAAYSSPAPPQPLSPDLNVEDSSIGSHFLQMLRLLAHAPSQRSPPRHLDVLSYEDDFFRLELNSRNEIDDDEDEDEDDGDEEEEDEEENLTVNDEEDEEDDLRRRNRFPLTTTQSRTGRNRILDWAEILMGIEDNSIEFRMESDRYAGNPADYIDDAAGYEALLQNLAEGDGGGGGGRRGAPPAAKSAIEALETFEVSSSEGEMVMVCAVCKDGMVMGETGKKLPCGHCYHGDCIVPWLGTRNSCPVCRFQLETDDAEYEEERKKRTSTVSDSAAASSSSSTSRY

SEQ ID NO: 8073 - protein, 167 aa, Triticum aestivum
MATGGGGGGGAADFGAAGGAGGRMPTWRERENNKRRERRRRAIAAKIFSGLRAHGGYKLPKHCDNNEVLKALCNEAGWVVEPDGTTYRKGCRPAERMDGIGCSVSPSPCSSYHPSPRASYNASPTSSSFPSGASSPFLPHSNNMVNGVDATPILPWLQTFSNSTASN

SEQ ID NO: 8074 - protein, 393 aa, Rhodococcus sp. RHA1
MRAVTWQGKRKVSVDTVADPKIEHPTDAIIKVTTTNICGSDLHLYETLGPFMGEGDILGHEPMGIVEEVGTAAGNLKVGDRVVIPFQISCGDCFMCNLQLYTQCETTQVREQGMGAALFGFSKLYGEVPGGQAEYLRVPQAQFTHITVPEGPPDSRFVYLSDVLPTAWQSVEYAAIPEGGSVTVLGLGPIGDMAARVAHHKGARVIAVDNVPERLARAKARGIETLNLDEHGGDLADVIRDATDGRGTDSVIDAVGMEAHGSPIGKLAQQIVGYLPDAVAAPLMQKAGVDRLGALYSAIDIVRRGGTISIIGVYGGMADPIPMLTLFDKQIQLRMGQANIKKWVDDIMPLLGDDDPLGVDTFATHELPLEQAPHAYEIFQKKQDGAVKIQLKP

SEQ ID NO: 8075 - protein, 101 aa, Streptococcus thermophilus
TKQAEGLGIPLKSVDDIDSIDVTVDGADEVDPQLNGIKGGGGALLMEKIVATPTKKYIWVVDESKMVDQLGAFKLPVELFNMALIACISTLNLRAISHHSE

SEQ ID NO: 8076 - protein, 468 aa, Pseudomonas syringae pv. phaseolicola 1448A
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMPKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 8077 - protein, 367 aa, Rhodococcus sp. RHA1
MPTSTTAAVVETGGAKFTVSTVDLDEPRSDEILVRLVAAGLCHTDLGVASGALPFPLPGVLGHEGAGIVEKVGAGVTTVDVGDHVLLSFSSCGSCGNCRDGHPAYCATWLPLNLIGGGRADGTSPVSRGGEAIGGHFFGQSSFAHHAVVDARSAVKVDPDDPLDILAPLGCGVQTGVGAVWNVLKPRPGQTVLVTGAGAVGLSAVMAAALTPASKVIVVDRVPARLDLARELGATQVINAAEVDTAEELAKILPDGVDGAVETTGNVGVLRTAIDALAPRGTAVIVGAPAFGTEVPVDVNAMIPGRTLVGLTLGDSETQTLIPVLVDLVKSGRLPIDRLITHYGFDDINTAVADMTSGASIKPVLRF

SEQ ID NO: 8078 - protein, 367 aa, Thermoplasma acidophilum DSM 1728
MNSKIIQDPVHGPIRASDAILEMIDTPEFQRLRYIKNLGLCYLVFPSANHSRFEHSIGTFHLAGMYLDHLGIKSEETAMAALLHDVGHFPFSHTIEDFYRKNRGVDHLEEGIKIIRGERESNIPSILEKYSIDVKKVVSILEGRENVLSEIVSGPIDADELDYLRRDSFYCGVSIGFVNPARVISVSGIYDGRMIIEEKGLSDIESLLISRFLMYQAVYFHKTCRIANRMLERAAIMSEAYDTYRLSDQEFTHLLMSDPRSEDMMRNILDRRLMKVLYKVKYDESLAHDILNAVSEKFIVDIIPPLSFRGKDRLKTQVGVLLENRIATGEESSPLVNALNSAIDRRYIYVYGYHEDERDLKRDLAGI

SEQ ID NO: 8079 - protein, 402 aa, Rhodococcus sp. RHA1
MSTFVPAARVDQMRESPSVAAAQRVRELRASGREILDLTVGEPDFDTPDHIKAAAVAAMESGLTKYTPVNGIPALRDAISKRMLDRTGVEFTDNEITVGGGAKQVIFLALMATVEEGTEVIVPAPYWVSYPDMVTVHGGTPVVVDCQESDRFLLTADTLAAAITPSTKWVILNAPSNPTGAVYSERELAELAAVLDRNPHVNVLCDEIYDEIVFTDSPVPNLLSAAPHLRDRILVTNGVSKAYAMTGWRLGYGVGNKGLIAAINKLQSQSSSCPSSISQAAAAEALTGDQSFVATSVASYRARRDLIFELSSRIEGLEPVLPQGAFYLFVGCAGLVGKRTPDGTLLENDQDVVLFLLDHASVATIQGSAYGAESYFRVSFATSEDVLRNAAAAVEKAVASLS

SEQ ID NO: 8080 - protein, 292 aa, Bradyrhizobium japonicum
MSHSSEQPLERVTIPALQQWKDKGRRVVMTTAYDAVAARIADPIVDIILVGDSVGNVCLGFDNTLPVSVAMMNHHLEAVARTRPHALLVADMPFLSFHVGSEDTIRNAGGFLQRGADAVKLEGGAKRIEMVRALVDCDIPVMGHLGLTPQSVNVMGGFKVQGRTTDTALRLLDDAHRLQEAGCFALVLEGIPAELAARATESLTIPTIGIGAGADCSGQVLVFHDVLGLTEGHRPKFVRAYTNGFQLFQEALSRWAADIRKGAFPGSEECYRLPDQLRHAVANWVPSSSTSR

SEQ ID NO: 8081 - protein, 97 aa, Oryza sativa
MASGGGKAKASSWAAAMSVGTVEALKDQAGLCRWNYAFRTLQQRGRQQAVAGTSGAKSGGGARALQPAAAAAARRKAQQQEEELRTVMYLSNWGPNN

SEQ ID NO: 8082 - protein, 469 aa, Vibrio vulnificus YJ016
MILPIIMAGGSGTRLWPLSRDNYPKQFLKLHGENTMLQETILRLNGLEHSPAMLICNEEHRFIAAEQVRQIGVAHSGIFLEPVGRNTAPAIALAAFKAVENNQDALLLVLAADHVIENQAAFQESVNNAKLLAEQGKLVTFGIVGNTPETAYGYIKRGKEVEHGFVVDSFVEKPDLQTAQEYIASGNYFWNSGMFLFKASRYLEELKAYRPDIYEACEKAVQVQNNDIDFVRVDKDAFEACPDESVDYAVMEHTQDAVVVPMNANWNDVGGFAALWEVSDQDENGNAFVGDVKSVDTKNTLVFAKDKLVTTVGVEDLVIVNTKDAVLVAHKDESQKVKEIVSQLKADERSEVTFHREVYRPWGKYDSVDNGERFQVKRITVKPGAKLSVQMHHHRAEHWIVVSGTAKVQIDDTEQFVTENESVYIPITAVHALENPGKVDLELIEVQSGSYLGEDDIVRFEDRYGRVKD

SEQ ID NO: 8083 - protein, 530 aa, Vibrio vulnificus YJ016
MEIILITTAFVAGFLALKCNLPPLVGFLLAGFALHAFGFESNLTITTLADLGVTLLLFTIGLKLEIKTLLSKEIWAGATAHNLLSTLLFTAAFVGLKFLGISSLAEMETGHLVLLAFALSFSSTVFAVKSLQEKGEMNATYGTLAIGILIMQDIFAVVFLTASTGKLPHWYAIALFALPLLRPLFYKILDWVGHGEMLVLFGIFFALVAGAGLFELVGMKPDLGALVLGMLLAGHRKSSELAKSLFNMKELFLVCFFLNIGLSASLSLTGVSLALLILLLLPLKGLLYFLTINHFKFRVRTSLLASLTLFNYSEFGLIVGGLAYKMGWMPSDILVALAVAVSLSFILAAPLSKMGHQIYQHSGKWLQETAAEKLNQRDQLINPGNAQVLILGMGRIGTGAYDELRARYGKISLGVEVREEAAQHHREEGRNVIAGDATDPDFWERILDTANVKLVLLAMPHHQGNQTALEQLKRRNYQGQIAAIAEYTDQLEMLTNSGVHAAFNIYNEAGSGFARHVCEQLQPQFAPPSN

SEQ ID NO: 8084 - protein, 964 aa, Prochlorococcus marinus subsp. marinus str. CCMP1375
MRNTKASKFSDRHLGLIEEAQVEILNALGHADINDFISSVVPEEILDAQPPDELLPKALNEIEALEELRSIAKKNQIKRSLIGLGYYGTYTPAVIQRHVFENPAWYTSYTPYQAEIAQGRLEALFNFQTLITELTGLPIANASLLDEGTAAAEAMSLSFAVNKQTKARKFIVDDQVLPQTLAVLKTRAEPLELDIEVVNLTDLVINETVFGLLIQLPGKSGQLWDPSSLIAQAHEFNALVTVAIDPLAQVLIAPMGQLGVDIAIGSSQRFGVPIGFGGPHAAFFAIKEEYKRLVPGRLVGQSIDSKGHSALRLALQTREQHIRRDKATSNICTAQALLATIASFYAVYHGPHGLEEIAKNIIYLRSQLELYLKEFGYTFAPDCRFDTLEIHCLEAPEIHRLSILSGFNLRILPLGASIEKSKGFAVSFDELSTTKELYKLCKIFADVKDKNFEPRENTNFNFKESLTSLPLRTTPWLKQQVFNNYRTETELMRYIQKLASRDFSLVNGMIPLGSCTMKLNATAELLPITWKEFSSIHPFVPSDQAKGYGYLSEQLEGWLCALTGFDGVSLQPNAGSQGEFAGLLVIRAWHKAINQADRNICLIPKSAHGTNPASAVMAGFKVVAVECDEYGNIDFEDLVLKVETYSSELGALMITYPSTHGVFEPNIRQICDQVHLHGGQVYLDGANLNAQVGLCRPGAFGADVCHLNLHKTFCIPHGGGGPGIGPIAVAKHLVAFLPSKNFHASDNNAAIGAISASPLGSASILPISWMYIRMMGADGLRQASSLAILSANYIANKLDPYFQVLFKAPNGKVAHECILDLRSIKRITGIEVDDVAKRLMDYGFHAPTISWPVAGTLMIEPTESESFEEINRFCEAMISIRSEIDAIESGITDLSNNPLRLAPHTMETVTAEIWDRPYTRQQAAFPLKDQFMNKFWPAVSRIDNAFGDRNLVCSCSTLEELSET

SEQ ID NO: 8085 - protein, 202 aa, Vibrio vulnificus CMCP6
MRKEHVVKLHLLKRLADGQFHSGETLGHELGISRAAISKHINALQDWGVDVYRIQGRGYQLAQPMTLLDEHQLVEQSANNVEVIPVIDSTNQYLLERIENLQTGHVCLAEYQSQGRGRRGRQWFSPFGSNLYMSMYWRLDAGMAAAMGLSLVVGIAAVEALETLGVQGVKLKWPNDVYYQDKKLAGNFGLDDWPSRRRCSSW

SEQ ID NO: 8086 - protein, 118 aa, Vibrio vulnificus CMCP6
MGLNMQMQADCHSIDQPCTALSQIEFGARLDRTELALTLMAKWREALSEYEQCGLNGFIERWNRLDNFKGRQVKLLIGPREIHGEVQGIDSQGGVILKTVEGIQTFVGGEISLRANDQ

SEQ ID NO: 8087 - protein, 656 aa, Ustilago maydis 521
MVKVKKRASKRVKIAQREKIKKKVKEHRRKTRRDERRSTQWKSKARKDPGIPNSFPYKEQLLNEIEQKRRIQEEEKLAKKAQKLAQHDGTELEGAETSDAEAAEDDEEDEMDEDDVLQDMPLTAPLYRGTLSELLASDEIKTIVLALDARDPQSFRCPWLEAEISNTKSKKLAFALGRADMVPLETVAAWTAYLSTTAGVATFPISSPPDQLAENTGAEALVQQLDLKGVGKGDIAVVGLAHSGRSTVADAILNAIGLPEDEDVEDEDNETTDWPAVLDTSALIPVKSSEAAEASDEEEEDGEDEDEDGDAEDGEDEHKFMARMELKSMQTLMRNQGHVQRIKEPLPLTWALLSRVSHPEDLMLIYNVPAFGSFQPDRASLADEELDADEKEKIKANSRRQKVHADTQEFLIALARATGRMKKRNIPDEVGASRVLLRDWSHQMLGYYTQAPKLATEAAKLSDQVKQRVSTSLPLVLARKEWRKKFQTRELRLRPISMVLGREALVLDQVEMLPPPPEQGSDEDEDEIDEALLEEDQSSFEDDEQDEPEELVTSKKGPQLKSILKKSASTKRDFVDDDRLPEDDQEQDDDVEEQSLSHKERRLQKKARVVVPSKSKPAASKRSNAKASKLTGAAAKAALAATGPAPGEKYDFGAFF

SEQ ID NO: 8088 - protein, 148 aa, Brassica napus
  misc_feature (6)..(6): Xaa can be any naturally occurring amino acid
  misc_feature (12)..(12): Xaa can be any naturally occurring amino acid
  misc_feature (14)..(14): Xaa can be any naturally occurring amino acid
  misc_feature (17)..(20): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (47)..(48): Xaa can be any naturally occurring amino acid
  misc_feature (53)..(56): Xaa can be any naturally occurring amino acid
  misc_feature (59)..(59): Xaa can be any naturally occurring amino acid
  misc_feature (68)..(68): Xaa can be any naturally occurring amino acid
  misc_feature (71)..(71): Xaa can be any naturally occurring amino acid
  misc_feature (73)..(73): Xaa can be any naturally occurring amino acid
  misc_feature (77)..(77): Xaa can be any naturally occurring amino acid
  misc_feature (99)..(99): Xaa can be any naturally occurring amino acid
  misc_feature (102)..(102): Xaa can be any naturally occurring amino acid
  misc_feature (105)..(105): Xaa can be any naturally occurring amino acid
  misc_feature (107)..(107): Xaa can be any naturally occurring amino acid
  misc_feature (109)..(109): Xaa can be any naturally occurring amino acid
  misc_feature (111)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(131): Xaa can be any naturally occurring amino acid
  misc_feature (139)..(139): Xaa can be any naturally occurring amino acid
  misc_feature (144)..(144): Xaa can be any naturally occurring amino acid
  unsure (1)..(148): unsure at all Xaa locations
KREQVXASSMFXSXAVXXXXAQATMVAPFTGXLKSSXAXPVXRKANXXITSIXXXXGRXSCMKVWPPXGKXKXESLXYLPDLTEVELGKEVDYLLRNKXIPXVEXEXEXGXXYXEXGSXPGYYDGXYXTMXNLPLVGCXDSAQXLEGS

SEQ ID NO: 8089 - protein, 382 aa, Karlodinium micrum
  misc_feature (62)..(62): Xaa can be any naturally occurring amino acid
  unsure (1)..(382): unsure at all Xaa locations
HKARTSTWEDTGSVKELATFLLAMQPSSHIGGMSGSRPSVVMQYGGGQTKWAPSWKKAPAAXASGTSSTSGGGKQDFLEFSPYYDKSTMPDNTYRPKSPFEAKIVSVKRIVGPKATGETCDVVINHGGDMPYIEGQSYGVIPPGVNPKNGKPNKVQFGSIASSRYGDDMTGKTTTLCVRRATYWCPELKAEDPAKKGVCSNYLCDANPGDMVKLTGPSGKVMLLPEDKPETDIIMVATGTGIAPMRSFIQRMFVEQTPYAKDFKGLAWLFLGVANTDALLYDDDWKAIQAASPDQFRYDVALSREQTNKDGGKMYIQDKVEEYSDEIFDRLTKGAHIYFCGLKGMMPGIQDMLKKVAAAKGLDYDEFTKGLKKNGQWHVEVY

SEQ ID NO: 8090 - protein, 649 aa, Vibrio vulnificus CMCP6
MTQIFLQAFIYLIAAVIAVPLAKRFGLGSVLGYLIAGVVIGPIVGLVGEETTTIQHFAEFGVVMMLFLVGLELEPKMLWAMRNRLLGLGGLQVAGTAGIIVAIAVYFGQVWTTALAIGLIFALSSTAIVLQTFNEKRLSKTEGGKNAFSVLLFQDIAVIPMLAFIPLLALPELVEQAQQSIQSASEHHEQLSLVAGLPGWAYGIVITLSIGVVIVGGHYLSRPIFRYVADSGLREIFTAAALMLVIGIAALMSLVGLSPALGTFLAGVMLANSEFRHELESNIEPFKGLLLGLFFITVGAGIDFTILFNKFGTIIGLTLAVMLLKALVLLALSFIFRIKGSDRWLFALSLAQAGEFGFVLLSFSVQNHVISTPLSQQLSLVVAISMFLTPGLFILFDRVILPKFATKFNERADDDIDEKGTVIIAGIGRFGQIVNRLLLSNGIKTVALDYQANQVDVMRQIGTQAYFGDVTRPDILHTAGIEEAAAIVVAIDNRDASVELVKQVKHAYPSVKVIARAFDRGHGYRLRQAGADVIESETYHSALEVGGQTMKLLGVHPFFVEQQKMRYKRVENRKSDSLYSAWLDDSEGERFDNNYRKLFMQLEEKMMLEMQKDRHTNLSRSERGWTPPPKDYADDLQELNNEVNDLNFK

SEQ ID NO: 8091 - protein, 149 aa, Zea mays
SDFVLVCVHSILLGFFQIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPWIYEK

SEQ ID NO: 8092 - protein, 641 aa, Cryptococcus neoformans var. neoformans
MASPATQTANAIAAINNRSNLVIPEIDFTQHQLENGEIVSTTERVIKDVQAPAMYVPTDDQFWSTTDKTKPDIAFLKNHFYREGRLTEEQALYILEKGGELLRSEPNLLEVDAPITVCGDIHGQYYDLMKLFEVGGNPADTRYLFLGDYVDRGYFSIECVLYLWSLKMWYPDTLFLLRGNHECRHLTDYFTFKLECKHKYSETVYNACMESFCNLPLAAVMNKQFLCIHGGLSPELHTLDDLRSINRFREPPTQGLMCDILWADPLEDFGSEKTNENFLHNHVRGCSYFFTYNAACQFLERNNLLSVIRAHEAQDAGYRMYRKTKTTGFPSVMTIFSAPNYLDVYSNKAAVLKYESNVMNIRQFNCTPHPYWLPNFMDVFTWSLPFVGEKITDMLIAILNCCTKEELEEEEEEFPLHAPEPTDAESAAERRQIIKNKILAVGRMSRVFSLLREESERVSELKSISGSNALPAGMLASGAEGIKEAIQGFEDARKSDIENERLPPDIIDPDEDKPASPSASPIMPATPEEIPSEIPYDSPITGTPRTPISGAIAFGSPGSPGTPTSPSIGGPPLTAWRPGHGRRTSLGTTKTSPSTRRRSLENTMHLIRDVVGGKDAQGDGQLERLAEVISSPTKGGQGERE

SEQ ID NO: 8093 - protein, 327 aa, Arabidopsis thaliana
MSSGTVRRVSRQDIQLVQNLIERCLQLYMNQKEVVDTLLEQAKIEPGFTELVWQKLEEENREFFKAYYLRLMVKHQIMEFNKLLEQQVHHMRQMHPTGVASVQNTNGSHLQSSKILNQKQLCYPSEHTDQSLKSESAHHPMASSLSNAFLNGSSTLNTNVPSSINISTHARRVDASPNMLSSQTTNMPMMQGMNGGMIKSETAFTNPASFMYGGERNALEGHSAVGDTSIPNFSNESNNQPLSDPLLEAEASTFGFLGQIPRNFSLSDLTADFSQSSEILESYDRSPFLVPNAENFLDSRDRGEYQGDNKRLDTISEGFSYDNIGSE

SEQ ID NO: 8094 - protein, 638 aa, Magnaporthe grisea 70-15
MLPLISCLLALCPLAVLAGPAPELQKRSITCLKIGDNATATWKNAAGQTCTFTGVVGSNFGTNPAGTGDYSCNGRCGAGCSGSSLGNAYTQDCFSHDMCSFFNNASGGESDPNCGAAFKDAVDDTAFGTLRGCGESNPNPPNPQGVGGQIVMSWMFRMYKFADSERANSEKSQFFKVGWAKVMDDSGPGAHDRRGREEHRRLDLWYLGSSTGTCPDWKPPMTPSKDDVYMCLPKKNHCSLSQHRPKVAQTTRAHIAAVELIQGREAASLADYSVSELIPPSYFPKMAGESTGTRPKVLLLGTIDQLTRRPLHPIASADEAWSKLSAKADIVTPTSTDRASFLAECASGAFAGVVAAYRTFVSGRTTGRIDAELLAALPPTLRFICHNGAGYDQIDVAACTAAGVRVSNTPSAVDDATADAGIFLMLGALRNFGPGMQSCRNGEWIGKPAPALGHDPRGKVLGILGMGGIGRNMAKKAAVFGMKIRYYNRTRLSAELEADCGAEYVDFDTLLVTSDVLSLNLPLNPKTRHTISHAEFAKMKTGVVVVNTARGAVMDEAALVAALDSGRVASAGLDVYEEEPKVHPGLLANHRCLLVPHMGTYTEETQTKMEEVAISNVVAALEKGQLVTGVPEQSGLTF

SEQ ID NO: 8095 - protein, 387 aa, Thermosynechococcus elongatus BP-1
MDWATRVMRVTPSVTLAIDAKAKAMRAAGEDVCSFSAGEPDFDTPAHIREAVKTALDQGKTRYGPAAGEPALRQAIATKLNRDNHLPYRAENILVTNGGKQALFNLMLALINPGDEVIIPAPYWVSYPEMVHLASGTPVIVATTPETGYRITPAQLEDAITPKTRLVVLNSPSNPTGMVYTPEEIRELAAVIVRHQLWVVSDEIYEKILYDGAEHLSIGAVSGAAFERTIVCSGFAKAYAMTGWRVGYLAGTTEIVKVATKIQSHSTSNVCTFAQYGALAALEGSQDCVAEMVAAFRERRAYMYAGICEIPRLRCLKPKGAFYLFVDIGDTGIGSVEFCDRLLEEEKVAAVPGKAFGMDDHIRLSYATDLATIEKGLTRLAKFVQRL

SEQ ID NO: 8096 - protein, 316 aa, Bacillus clausii KSM-K16
MKVICTSPSFAKHSNEPIIRLQQEGIELVRVPPDISQSAFVLEARGAQAAIVAFNEIHDAVLAQLPDLKIIAKHGVGVDNIDVDAAKKHGVTVTNVPNANKHAVADFAFSLLLSLARQIPTGNEKTKKGKWPSLFGADVYQQTLGIIGLGAIGKEVARRASGFSMTVLAYDPYIDRTYARKNGIEAVSLDALLQQSDFVTIHIPLLPETRHLIGERELQLMKKSAYLVNASRGGIVDETALYEALQTQQLAGAALDVFEEEPLHMSPLFSLDSFIAMPHVAGYTPGAINTLSHTCVDQIIAVLKGKGDLIHVVSGP

SEQ ID NO: 8097 - protein, 175 aa, Brassica napus
MSAFVGKYADELIKTAKYIATPGKGILAADESTGTIGKRFSSINVENIESNRQALRELLFTSPGALPCLSGVILFEETLYQKTSDGKPFVEFLQENGVIPGIKVDKGVVDLAGTNGETTTQGLDSLGARCQEYYKAGARFAKWRAVLKIGATEPSELSIQENAKGLARYAIICQE

SEQ ID NO: 8098 - protein, 354 aa, Rubrobacter xylanophilus DSM 9941
MFLQASFPGCMERVSATRKALKSAILIAALLLLAGCEAAQTEANLPSGAQKVAVFEGGEVTQGQVQEQLDLLGRQSGLGEITPDSPQYQSAIAQIMPQLVTQEIAQAYAREHGITVTEREVEREIGRIKDQLVRQARAQGQDIGREEAFRRALEQAGITEAQLREQIREQLPVQKVQERVAGDARPTEEEVRDYYEENREAQFTTPAQRCVRHILFNPDQRERAEEVKRRLEEGADFAELAREYSQDPGSREKGGDLGCIGRGETVPNFEEAAFGAEEGEVVGPVKTQFGYHVIKVYDVRRESTEPLSEVEDRIREQLAATAQAEKFQRWVERQEELRDIRYLPGYDPNPSSRE

SEQ ID NO: 8099 - protein, 432 aa, Geobacillus kaustophilus HTA426
MYSGGQLDEEKVFKDPVHRYIHVRDKVIWDLIGTKEFQRLRRIKQLGTTYLTFHGAEHSRFNHSLGVYEIIRRIIDDVFVGRDHWDHSERLLCLCAALLHDLGHGPFSHSFEKVFRLDHEDFTQAIILGDTEVNAALREVGDDFPQKVAEVIAKTYPNKLVVSLISSQIDADRMDYLLRDAYYTGVSYGYFDMERILRVMRPREDQVVIKRSGMHAVEDYIMSRYQMYWQVYFHPVTRSAEVILTKILHRAKKLYEDEYTFATKPTHFLSFFAGHVTLGDYLALDEAIILFYFQQWQYERDPILSDLCRRFVHRRLFKYTEFHPTNEQMAKLIELTGLFKKAGIDPDYYLVVDSSSDLPYDFYRPGEEGERLPIYLLMPNGELRELSRESVLVDAISGKRRTDHKLYFPADFLEDLSTKRTVKKKIMEILKG

SEQ ID NO: 8100 - protein, 553 aa, Thermotoga maritima
MKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 8101 - protein, 149 aa, Zea mays
  misc_feature (41)..(41): Xaa can be any naturally occurring amino acid
  misc_feature (95)..(95): Xaa can be any naturally occurring amino acid
  misc_feature (114)..(114): Xaa can be any naturally occurring amino acid
  misc_feature (120)..(120): Xaa can be any naturally occurring amino acid
  misc_feature (126)..(126): Xaa can be any naturally occurring amino acid
  misc_feature (133)..(133): Xaa can be any naturally occurring amino acid
  misc_feature (137)..(138): Xaa can be any naturally occurring amino acid
  misc_feature (140)..(140): Xaa can be any naturally occurring amino acid
  misc_feature (147)..(147): Xaa can be any naturally occurring amino acid
  unsure (1)..(149): unsure at all Xaa locations
MQLQTQSFALNLLPSPNFAKPIERRELISLKRGPSRPISLXRCSVSTTLDTPATASTHKPFPAEVSRSIMELSSVGTLSTLTHDGWPLGVGVRFXAVDKDGTPVLCLNRSVSPXKRSALXVQLEQXGLRTPQXTIQXXIXRPGDDTXLK

SEQ ID NO: 8102 - protein, 472 aa, Triticum aestivum
  misc_feature (30)..(30): Xaa can be any naturally occurring amino acid
  unsure (1)..(472): unsure at all Xaa locations
TRPVVVLGITVAVLSILMLPADVANRQACXRRAVYSGACALTLPMKTLWLVVYIIDAVLVFLVIPFAMFYYEGDQDKSVGKRLKSALIWVVASAVVCGLVLGILYALIGKVDFTVRHLSSSVQAFPNPNQFSAFTSGQPCIAPLTRQCSANTAPPNSQTTWTMRATFPEYVVALATIVGSVLFTIFGGVGIACLPLSLIFSFVRRPKAVITRSQYIKEATELGKKAKELKKAAEALHQEERSGNKGRKWRKNVKAVEKELLLLENDMNALEEMYPQGEKAEATWAFTVLAYIGKLIFGIVGLIVSIAWVAHIIIYLLVDPPLSSFLNEIFIKLDSVWGLLGTAAFAFFCFYLLIAVIAGEMMLGLKLVFITIHPMKWGGTLMNSFLFNVGLILLCSISVIQFCATAFAYYAQATAAQEIFGHTLQSLRGIKYLYKYNVFQYGFVALAILTLFYYALFGWRKRKPTGRFQLSN

SEQ ID NO: 8103 - protein, 477 aa, Rubrobacter xylanophilus DSM 9941
MRVRRTKIVATLGPATSSEESIGALVRAGVDVMRLNFSHGTHDMHLDNARTVREAAAEAGRNVAIMQDLQGPKIRTGEVEGGTELVEGSRVVIAPGDFVGDASRLSTSYDRLAQDVKPGHRLLIDDGLIGLRVESIKENGEIVCEVLEGGPVSSHKGLNFPDSSLSISGLTEKDLEDLRFGLEELRPDWVAISFVRTGEEVLDVKERIRELGGDVPVISKIEKHEAIDNIEEVIEASDGVMVARGDLAVELSAERVPIEQKRIVARCRRRGRPVIVATQMLDSMMRNPRPTRAEVSDVANAIFDRTDAVMLSGETAVGRYPTQSVMEMDRICRAAEGAIDYGRDIAASTAWGRGDRYDAVTHAACELAEVLEAQAILTSTQTGLSCIRVARFRPPNRILAVSPIEATVRRLALVWGVTAVRGEQAGSIEERFRESVEAAEARGHLKKGDRLVFTGGTAGSLPGSTNLLQVHTVGENG

SEQ ID NO: 8104 - protein, 133 aa, Glycine max
MKTESPRHLRNPLLALLFLAAAAASAAQIAMAAEPEQQAAVHIVYVDRPEDADPEEFHIRTLAPVLGSEEKARGAVLYHYKHAASGFSAKLTTEQVEDLKKQPGVLQVVPSQTYQLHGHEGGHASTTRTMGLM

SEQ ID NO: 8105 - protein, 315 aa, Gibberella zeae PH-1
MAPKSLDLVADDYHFLGSQFTKPVPLPKDLSLTESTIIITGANTGIGYATAEKLLSLNLKRLIIAVRTLSKGESAAAKLRTQYSKAEILVWQVDMLSHKSVQDFANKCKTLDRIDLAILNAGSQWTRFELSPEGHESSFQVNYLSTVLLATLLLPTLKQKAPAGQPGRLTIVNSGTSLMAEFPNIDDDNVLAHYDDETKFSGGMNPMPSYAKHKGLAHFWVYKLAERLSSDDVIVNLVDPGLVRNTGLQQQGNFVVRQVLAVMKWLIARNLEQGASTLVQASVVMGKESHGSYIMDWRIHQELSFVHVDGILKSL

SEQ ID NO: 8106 - protein, 327 aa, Hypocrea lixii
MDTNMEDVGRVPADVSPVQTEPATRSTLEQWIENLMNCKQLSEADVQRLCDMGREVVQEESNVQPVKCPVTVCGDIHGQFHDLMELFKIGGPSPDTNYLFMGDYVDRGYYSVETVSLLVALKIRYPQRITILRGNHESRQITQVYGFYDECLRKYGNANVWKIFTDFFDYLPLTALIENQIFCLHGGLSPSIDTLDNIRALDRVQEVPHEGPMCDLLWSDPDDRCGWGISPRGAGYTFGQDISEAFNHNNGLTLVARAHQLVMEGYNWSQDRNVVTIFSAPNYCYRCGNQAAIMEIDEHLKYTFLQFDPCPRAGEPMVSRRTPDYFL

SEQ ID NO: 8107 - protein, 145 aa, Oryza sativa
  misc_feature (60)..(60): Xaa can be any naturally occurring amino acid
  unsure (1)..(145): unsure at all Xaa locations
MASPTTMVGVATSCASPHPPPPACLSCACAPPTRGTRRRRLAVAVRVRVRVRASASEAMXNPPESRLSELGVREWPKWGCEKSKFPWTYSAKETCYLLQGKVKVFPDGAGEDFVEIAAGDLVVFPKGMSCTWDVAEAVDKHYKFE

SEQ ID NO: 8108 - protein, 423 aa, Schizosaccharomyces pombe
MEYLTNLKTNIMDKQLGHREVSEGSTQPKPDPSGATMKACVWDGPLNVKIAEVPKPTITHPKDVIVKTTACTICSGSDSHIFSGEMPGIEKGAILGHESCGIVAEKGDEVNNLEIGDRVVIAFDLACGQCSFCKRHEYAACDTTNDSKLMDVNYGSHHSAIFGYTKLLGDVPGCQAEYIRVPFAEINCCKLPDDIPDSEGLFMSDVLCTSLHACTLGEVKKGDTVAIWGMGPIGLYAGRWAQILGASKVIGIEVVPERIELARQKFGFTVIDRNEVSDVPKKIMELVSNGVDCAIEASGFRFSTSILHKVERAVGLETDSPDMITECLNAVRKYGHVSIIADYVGTSNQFPIGHVVMKHLTIRSGQCPCQNYFGYVIDNIRSGKIDPRWMVTNKIKFDDLPDAYNKLFYKEDGYVKVYCDMTE

SEQ ID NO: 8109 - protein, 180 aa, Stellaria longipes
MASSIMSSAAVATRSNGAQASMVAPFTGLKSNASFPVSRKTNLDITSIASNGGRVRCMQVWPPINMKKYETLSYLPDLSSEQLLSEIEYLLKNGWVPCLEFETEHGFVYREHTSSPGYYDGRYWTMWKLPMFGCTDATQVAAEVQEAKKAYPDAHIRIIGFDNVRQVQCISFIAYKPEAF

SEQ ID NO: 8110 - protein, 543 aa, Oryza sativa (japonica cultivar-group)
MAMSATSSNLIVYLVHKYNVKAIHAAQISNVVRGCMQLAPVLAAALSDAFFGPYPIAVAGLVFSLLSFVLFTLTAALPSLLPPPCQRGAGGGGATATSCEPPNAAQSAVLYAALCLLAAGNGGTRYNMAALGADQFAGEGQPRRRRQGGGFFSCYFAFLYASYATGDTVLVYVQDGVSWALGFGVCVATTGLALAALLLGSRHYRRPVPKGSPFTAMARVAVAAARKATVDLGSRVQYYHGCNRDDAVPRADQAPSDRFRFLNRAAMVVAGETREEDGSVAKPWRLCTVQQVEDVKSVVRVLPLWSSGILVSVTVNAQVSLTVLQALTMDRAVGPRFAVPAASITVTVLAAFVLAAALFDRVAAPLCAAAGKLAITPLRRVGLGHALNVASMAVAALVERRRIGAARGRAAAAAAVVPMSVLWLVPQLALTGAEEALHLPGNTALFYGELPASLRGTATAMPPLFIAAGSYLSAAAVDAVKRGTTWLPDDLNASRLDCVYWTLAVLAAVNLGYFLLCATTYKYNNYGGDDGNVKAQTQTDDVS

SEQ ID NO: 8111 - protein, 1737 aa, Ustilago maydis 521
MDAVALTTLLSDSTQKLVQLHSQIGHPAEALQAALDALHQALKTAVDDQIGRVEREAHNLCAECSQIEADNADIKRALGDKSLVSSPSLQNAIGKRMVSAASTPSSTSEPSSPDSKPLLQRRAQLQIDQTRLKATYSAKEAQLDRLSAKLQTYVPLLGSFVKVPRDGSQDSVNTEAVPSVTFRDVSQPRIALFEAEIIRCSKEVNARAERLQTSLLEIVQLWSELNFEPAQPVAPCDEHVFQPDQAGDQADCGGGTLEFDRAILSHLQLEPMHDQETRTFIGEFISTEQPQRRDAASSRSDSRAIDDLLEQTPTRASLGGQPVRDSGDLALQLSSASKTASEPLPPSHLLEPTEANLARAATKLQWLEAEKQRREMLIQELYDELSELWAKFDVPEEEMDAFVMDHRGSTMDVIQAYQAELDKMKQLKAQHMSLFITKTRERIATLWDSLFLTDHERQASFPPFFIDVSADADPNLDEPLPTDDILASHEQMIDLLTEQVRVKAPVLKVIGRYKELLDEARQLDESASDGSRLLGRSNRGDPGRLLREEKMRKRVKVQKPKIEAELLKVIPAWEEEHGEPFTINGVRYLDELLEQVEGSKENANRKRTRTTSGAQTPAPPVSAPASARRGPLAPSTTSNRGVTATPMRSMTPHQGTIKKPRIAAAPATVAAPSTRTPSVRQAAAPASISRIASARAPMSAAPKAQYGGGAGSISRPASSMAGAYRTVSTASYAAGTSSPSRIPGPSPHLVSRPFGAPPSVPGYASVYGARSVTTTASAGLAARTVKAQRESFRPRPSIVAKVPRNATVVGGVASTKDAAAGISPGRASKWGEMGPPRWPVAGQPSHAHRDVSCVSASSSNHTDITTLIHPGIPQMTRTAEPVRRARRAPSMSLEACLANLAAASSQGKSRLGDAARDLGISSIRSVSSSDDIVNQAGEVADHGHDKTARVRGWKDGLRIAGAGLDDEVDLDADAAPTLARSGSSNWELVGEAEPEPTYFADQHAALAAPQKCSTSSAAMCPCATTKCTNPISDRIRLLSLPIVVWRSSAHLVFTSILLIFTRRADSASCTMTGVVCLRAEARSIAIRASASVTAAATRTSPPAQQGEYASRSAALSARRSYSYHAISGKGRVLSVSAFEPSQLSCFRQSQRPRSDVRLLSSLVTPTRLGMDSEADLGRHFYLNKVLEQWAAKPATRMTLRQLIFFGRTLGRDREKILKSANYVRTELPVRIAHRIRDLQALPFVVMTNQHLEDVYQKYWSAFETFRRFPHIKTMDDNERFCNLLRRLLDDHLTIIPSLTIGIVESSHHLGAKQLDKFMERMLRSRISRRVLAEQHIALSEALDDPFHFFNEPVRRTEGEEDSESHASTDEVGDHVGIIYTRLSVASVVNKGIKLLTQMFTNVQGVGKHRIPEVKVDGDLKARFAYIPEHLEYIVFELLKNAIRATIRKHAPEQQTGVVRVTIVEGPPEEDLIIRISDSGGGLPDLMTQLSSPSRSGAAAAMKPTAATPMFASGAAGGVANNVAAEPSLQMDAQYPIPFPDTGHIGGYPPRGSRARLLHRDDETIPVTLSDDTMAGTMQVDVSSFYAEPWAQDSLPSSRTWSARGGVGSAGGTGGSTPPNEFGTVGTSTTSTQGYSDPLIDALCSFSNVRKRLEIEARLRGASQDSTASANYGLSSTAPHASCSSATTSAAADLNSAGLGTRDRFDALKSIGKFKGTVTEQASDCPWPKCTATSLAGA

SEQ ID NO: 8112 - protein, 458 aa, Acinetobacter sp. ADP1
MTDQHAHELKKGLSNRHVQLIALGGAIGTGLFLGISHTIQLAGPAVLLGYAIAGMIAFLIMRQLGEMVVEEPVSGSFSYFAHKYWSSMAGFMSGWNYWVLYVLVSMAELSAIGIFVQFWWPQIPTWLTALVFFVLINAINLINVRFFGELEFWFSCIKIIAIISMIGFGAYLLLSGTAGAHAGIANLWQHGGFMPNGWTGLIIAMAFIMFAFGGLELVGIAAAETKNPTQTIPKATNQIVYRILIFYIGAIAILLSLYPWNQVAQGGSPFVMIFQSLNNTGVAHVLNMVVLIAAISVYNSCVYSNSRMLLGLAEQGNAPKLLKRVNARGIPVYAVYASVMVTALCVLLNYVMPEKAFNLLMMLVVAALVINWLMISITHLKFRQYMLEAGRKPIFRSLGAPFTNYITIAFVFFILLIMSYTSEMRIAVFLVPVWLGILYIFYRFKAPASKMTESVLDQ

SEQ ID NO: 8113 - protein, 134 aa, Arabidopsis thaliana
  misc_feature (26)..(26): Xaa can be any naturally occurring amino acid
  misc_feature (90)..(90): Xaa can be any naturally occurring amino acid
  misc_feature (97)..(97): Xaa can be any naturally occurring amino acid
  misc_feature (99)..(99): Xaa can be any naturally occurring amino acid
  misc_feature (106)..(106): Xaa can be any naturally occurring amino acid
  misc_feature (108)..(108): Xaa can be any naturally occurring amino acid
  misc_feature (111)..(112): Xaa can be any naturally occurring amino acid
  misc_feature (120)..(120): Xaa can be any naturally occurring amino acid
  unsure (1)..(134): unsure at all Xaa locations
MASSMLSSAAVVTSPAQATMVAPFTXLKSSAAFPVTRKTNKDITSIASNGGRVSCMKVWPPIGKKKFETLSYLPDLSDVELAKEVDYLLXNKWVPCXEXFELEHGXFXTRXXRETIPGYXGWPVLGFKFIFGLS

SEQ ID NO: 8114 - protein, 248 aa, Porphyromonas gingivalis W83
MKRIVLIRHGESLWNKENRFTGWTDVDLSEKGIEEAKKAGELMKKEGFQFTKAYTSYLKRAVKTLNGVLDVMDLDWIPVEKTWRLNEKHYGMLQGLNKAETAEKYGDEQVLIWRRSYDVPPTPMEKEDPRSPFMDPRYKGVCEKDLPLTEALCDTVNRILPYWNETIFPTLKEHDEVLVAAHGNSLRGIIKVLKNISDEDIISLNLPTAVPYVFEFDDNLRLVKDYFLGDPEEIKKLMEAVANQGKKK

SEQ ID NO: 8115 - protein, 434 aa, Candida albicans SC5314
MSNYHLIILVHGVWGNSSHLAYVEKQIHENIHSYDGTILYTHKTGSHSGYLTYDGIDVNGKRISDEVWEQTKLIEQEKGGKVTKFSVVGYSLGGLISRYCIGYLSSQGYFDNIEPINFTTFCTPHVGVSVPQSHNFSARLYNRIAPLFLADTGSQFFLRDKVGEFGKPLLVWMADPRSKFYKALAKFKYKSLYANVVNDKRCSWYTASISPDDKVNSSYNKRPENINCKYIKGYQPNVIDVTKPFYYEKVDNLRESSNHRFKWFWKTLNWIKLIGTITVYSPIFIITSIVQRIYNRKRVSEFFQNESNDLLHMYEHEHEVGGEEEEEQQQQYHSSVFADISNKVDDEQETLVEDIYDAMNWKVSHSSTFPPIRLDHNQSYIVEKLNTIGWKKYPIIIRHTKGTHGAAIIKHYDPNFDEGEVIVRHFVKEVFKLD

SEQ ID NO: 8116 - protein, 158 aa, Karlodinium micrum
HEAQVTECHSFNAMSRFAQSFGRNLLHFPAGAACCALATGYSVHKPVELSGASQDELKKQVGYKAVDDHVRSGMVIGLGTGSTAYFAVERVGQKLKSGELKGIVAIPTSTRTEKQAASWGIPLETLDTRPCLDVSIDGADAVDPFLNLVKGGGGAHFR

SEQ ID NO: 8117 - protein, 337 aa, Ustilago maydis 521
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 8118 - protein, 394 aa, Staphylococcus epidermidis RP62A
MKLSLNSSSKFLRAPSIRQFSNRIKAIDDCVNLTIGQPDFPMPDVVKNAYIKAIKNDKTSYSHNKGLFETREAISQYFKRKYNFLYSEEEIIVTNGASEALDTSLRSIIEPGDDILIPGPIYAGYIPLVETLGGNPVYIDTTQSDFKVTPELIESHLTHKTKAILLNYPTNPTGVILERSEVKNIVDTLVNKHIFIISDEIYAENTFKGQHTSFAEFPEIRDQLLLIGGLSKSHSATGIRIGFLLGPEYLIEKLTFMHAYNCICANVPAQIACTTALNEGINAPLYMNRDYIERRNYLKEKLESLGFELTAQPEGAFYIFPSIKRFTENDFEFCVDVLEKAHLAMVPGSSFTDIGKGYIRISYAYDMETLKKGMHRLENYLQQHYPEQMTTPTK

SEQ ID NO: 8119 - protein, 399 aa, Alkaliphilus metalliredigenes QYMF
MMNLSKRITSMQESPIRKLVPYAQAAKANGKKVYHLNIGQPDIETPSSFMEAIRNFDEKVLAYSLSQGMPELIDSMIDYYKKYDMHFENDEILITNGGSEALLFAMIAVADAGDEVLVPEPFYTNYNGFTSAVDVKVVPITCKAEEGFHLPNRKSIEDIINPKTKAIMLSNPGNPTGVVYTKEEIHMLADLAKEYNLFILADEVYREFVYDGLEYTSFGNIKEIQDRVVIIDSVSKRYSACGARIGSVACKNKELIKEVLKLCQGRLCVPTLEQVGAIELYKTPESYFKTVNKEYEKRRDIVYTELNKMPGVLCKKPTGAFYVAAKLPVDDAEKFVIWMLKDFDIDGETLMMAPAEGFYATPGLGKDEVRIAYVLNEDDLMKSMNLLKVALELYPNKTI

SEQ ID NO: 8120 - protein, 541 aa, Prochlorococcus marinus str. MIT 9211
MPQIPSSSNIKKPGGVAPVVLAILDGWGHSEKFEDNAIKNADTPIMDALWQAYPHTLIEASGADVGLPDRQMGNSEVGHLTIGAGRIIQQELVRITNTVRSNKLFEIDALKDLAELLKANKKTLHIIGLCSDGGVHSHINHLCGLLDWSSNQGIQKVAVHAFTDGRDTPAQSAKKYLEIITEKLNSSDIGELTSLCGRYWAMDRDNRWERTSKAYELLTNPNFPICDSSPEELIANSYQEGVTDEFLEPVRFKRSYIENGDGVIMFNFRPDRARQLIKAISLPDFDQFAREYTPKPNVLTFTQYEANLPVSVAFPPESLEDLLGEVISKHGLLQYRTAETEKYPHVTYFLNGGIEKPLPGEHRHLVPSPRVATYDMTPAMSADILTESCLKAIESGLYSLIVINYANPDMVGHTGVMEAAKEAINKVDTCIGRILDSTGKMSGTLLITADHGNAEVMKGADGQPWTAHTTNPVPVIIIEGEKRKLSGEGNSIQLRQGGGLADIAPTVLQLLSLPKPKVMTGSSLIENIETPTIPSRVTQTA

SEQ ID NO: 8121 - protein, 280 aa, Arabidopsis thaliana
  misc_feature (14)..(14): Xaa can be any naturally occurring amino acid
  misc_feature (26)..(26): Xaa can be any naturally occurring amino acid
  misc_feature (41)..(41): Xaa can be any naturally occurring amino acid
  misc_feature (79)..(79): Xaa can be any naturally occurring amino acid
  misc_feature (208)..(208): Xaa can be any naturally occurring amino acid
  unsure (1)..(280): unsure at all Xaa locations
MEILPIPAESFRGXGFIGAGKMAESXIARGVVASGVLPPNXRICTAVHSNLNRRDVFESFGVNVFSNSEEVVKESDVVXIFSVKPQVVKKAVTELKSKLSKNKILVSVAAGIKLNDLQEWSGQDRFIRVMPNTPAAVGEAASVMSLGTGATEEDGAIVAMLFGAVGKILKADEKMFDAVTGLSGSGPAYIFLAIEALADGGVAAGLPXELALSLASQTVLGAATMVSKTGKHPGVLKDDVTSPGGTTIAGVHELENGSFRATLMNAVVAAAKRSRELSQS

SEQ ID NO: 8122 - protein, 238 aa, Methanococcoides burtonii DSM 6242
MTNENYTDNIKKAIKAAQNGEMFFIYDSDSREGETDFVITASSVTPDDVRWMRRDGGGLICVAIDSENSKKLGLPFISDVLRDEAKANPALGNTVEKGGDLAYDTRSSFSIWVNHRKTRTGIPDNDRALTINELSNITEKCMKGEDVIFGSEFRTPGHVALLRAADHLVHDRKGQTELSIAIAKMADVTPAMVVCEMLDDSNGRALSKKDAKEYAELHGLVFLEGQEIVDAYEQWEQA

SEQ ID NO: 8123 - protein, 362 aa, Lycopersicon esculentum
MGSQCYSAYSIQSLNPTCPSSSSSSVIFTLLKPQIHRRRIITCCNSSRRRRRMASVAAMNAVSSSSVEVGIQNQQELKKGIADLYDESSGIWEDIWGDHMHHGYYEPKSSVELSDHRAAQIRMIEQALSFAAISEDPAKKPTSIVDVGCGIGGSSRYLAKKYGATAKGITLSPVQAERAQALADAQGLGDKVSFQVADALNQPFPDGQFDLVWSMESGEHMPNKEKFVGELARVAAPGGTIILVTWCHRDLSPSEESLTPEEKELLNKICKAFYLPAWCSTADYVKLLQSNSLQDIKAEDWSENVAPFWPAVIKSALTWKGFTSVLRSGWKTIKAALAMPLMIEGYKKGLIKFAIITCRKPE

SEQ ID NO: 8124 - protein, 368 aa, Solanum tuberosum
MGSPCYSACTIQSLNPTCPSSSSSSVIFALHKPQIHSNIIQNYTRRRIITCSSNSRRRMASVTAMNAGSSSSVEVGIQNQQELKKGIADLYDESSGIWEDIWGDHMHHGYYEPQSSVELSDHRAAQIRMIEKALSFAAISEDPAKKPTSIVDVGCGIGGSSRYLAKKYGATAKGITLSPVQAERAQALADAQGLGDKVSFQVADALNQPFPDGQFDLVWSMESGEHMPNKEKFVGELARVAAPGGTIILVTWCHRDLSPSEESLTPEEKELLNKICKAFYLPAWCSAADYVKLLQSNSLQDIKAEDWSENVAPFWPAVIKSALTWKGFTSVLRSGWKTIKAALAMPLMIEGYKKGLIKFAIITCRKPE

SEQ ID NO: 8125 - protein, 432 aa, Listeria monocytogenes str. 4b H7858
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLASFKEALAVWSDQVAAVLVEPIVGNFGMVAPEDGFLEAVNELAHANGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAALKHGIAVTVNQIVGALTVYFTEDPVTNYAEAGATNGELFGRFFKGMLEEGINLAPSKYEAWFITSAHSEADILETIQAVDTVFGKMVQDN

SEQ ID NO: 8126 - protein, 235 aa, Brassica napus
  misc_feature (153)..(153): Xaa can be any naturally occurring amino acid
  unsure (1)..(235): unsure at all Xaa locations
VDPRVRQFGFFGSLLNCGAKLKAFSMVNCLGIRDLATGLPASSHRSGLRSLSVRNCPGFGDANLAALGKLCPQLEDIELCGLKGVTESGFLHLLQNSLVKVNFSGCSGLTDRVVSAISARNGLTLEVLNMDGCSKISDASLVSIAANCQILSXDLDLSKCSVSDFGIQALASSEKLKLQILSMAGCAMVTDKSLPSIVKSGLPTLLGLNLQQCRSVSCSTVDFLLERLYKCDILS

SEQ ID NO: 8127 - protein, 449 aa, Solibacter usitatus Ellin6076
MRYLPKSESERRQMLEACGVSTPEELFAHLPDAVRLNRPLNLAPGISEYEIVQYFRERAEQNANGYASFLGAGVYNHYRPVLVDTVVSRGEFLTSYTPYQAEIAQGTLTTIFEFQTMICQLTGMDVANASMYDGSTAVPEAAMMAVRATGKGRVLISRTVHPEYREVLGTYAKHQGMPVQEFGYVAESGGLDLEDLERKMDDLTGAVIIQTPNFFGIVEQVKAAAEIAHKRGALLVVIFTEAVSLGLLEPPADADIVAGELQSFAISPSYGGPYAGIIAVKEKYIRQVPGRLVGQSLDSRGNRAFCLTLSTREQHIRREKATSNICTNQALIALMATVFMTVYGKQGLRELAEQNLAKAHYLASKLKPRFTGKFFNEFVVRAEGQTPEELNKQLLKKKIIGGLPLGRFYPELADSYLVCATEMTRRADMDALVAATTAQPATETVEVTA

SEQ ID NO: 8128 - protein, 91 aa, Arabidopsis thaliana
MPSLQTSLPPELANNVVRLYRECLRRAKFIGKQQHNTELVVGMVRQQFKKHMNETDPEKIQKLKDDAARGLINHMLFESAKLTGGKVSQRS

SEQ ID NO: 8129 - protein, 349 aa, Bacillus clausii KSM-K16
MRAAVWYKEKDIRVEEREPAKLGARDVKVRVAWAGICGSDLHEYLHGPVIIPKGEPDPITGGESPLTLGHEFAGVIEEVGTEVKSFQKGDRVVINPLFTYGNKPASVDLYDGFSFAGLATDGGFADFAVLPEKNVYKLPDNLTLEEGALVEPMAVAVQAVKEADFKFGQSVAVFGAGPIGLFTIIAAKAAGASKIIVFDLSEERLEKARLVGATHTFNSGAVDPVEKVKSLVPDGVDVSFEVAGVNATFNQSIQVAKSRGVVVVVSIFAKPIEFNPMDLTGSGVKITSTLAYEPEVFQTTIDLMAEGALNPKGVITDRIELENIVESGFEVLTNDKRQAKILVKLSGEK

SEQ ID NO: 8130 - protein, 1004 aa, Arabidopsis thaliana
  misc_feature (595)..(595): Xaa can be any naturally occurring amino acid
  unsure (1)..(1004): unsure at all Xaa locations
MMKLFLLLLFLLHISHTFTASRPISEFRALLSLKTSLTGAGDDKNSPLSSWKVSTSFCTWIGVTCDVSRRHVTSLDLSGLNLSGTLSPDVSHLRLLQNLSLAENLISGPIPPEISSLSGLRHLNLSNNVFNGSFPDEISSGLVNLRVLDVYNNNLTGDLPVSVTNLTQLRHLHLGGNYFAGKIPPSYGSWPVIEYLAVSGNELVGKIPPEIGNLTTLRELYIGYYNAFEDGLPPEIGNLSELVRFDGANCGLTGEIPPEIGKLQKLDTLFLQVNVFSGPLTWELGTLSSLKSMDLSNNMFTGEIPASFAELKNLTLLNLFRNKLHGEIPEFIGDLPELEVLQLWENNFTGSIPQKLGENGKLNLVDLSSNKLTGTLPPNMCSGNKLETLITLGNFLFGSIPDSLGKCESLTRIRMGENFLNGSIPKGLFGLPKLTQVELQDNYLSGELPVAGGVSVNLGQISLSNNQLSGPLPPAIGNFTGVQKLLLDGNKFQGPIPSEVGKLQQLSKIDFSHNLFSGRIAPEISRCKLLTFVDLSRNELSGEIPNEITAMKILNYLNLSRNHLVGSIPGSFSSMQSLTSLDFSYNNLSGLVPGXGQFSYFNYTSFLGNPDLCGPYLGPCKDGVAKGGHQSHSKGPLSASMKLLLVLGLLVCSIAFAVVAIIKARSLKKASESRAWRLTAFQRLDFTCDDVLDSLKEDNIIGKGGAGIVYKGVMPNGDLVAVKRLAAMSRGSSHDHGFNAEIQTLGRIRHRHIVRLLGFCSNHETNLLVYEYMPNGSLGEVLHGKKGGHLHWDTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELVTGRKPVGEFGDGVDIVQWVRKMTDSNKDSVLKVLDPRLSSIPIHEVTHVFYVAMLCVEEQAVERPTMREVVQILTEIPKLPPSKDQPMTESAPESELSPKSGVQSPPDLLNL

SEQ ID NO: 8131 - protein, 767 aa, Sinorhizobium meliloti 1021
MPERISCFVMSGGVGSRLWPLSREDNPKQFHDLAGHGSMLVNTVRRLKARPAGDTPVHVIASERHSERVRADLAGIDLAGGHAIFEPVGRNTAAAVAVAALETIATHGDGLVLVVPSDHEISTEEQFWNTVEKGVPAAEAGRLVVFGIPPDSPETGYGYIESVGKGNVRDVARFVEKPGLEMAKAYVASGTFFWNAGIFLFRAGAMRAAFREHQAAIWQKTECAFAAAATEVSGTYLPIEQYSTIPSASIDYAIMEHASGIAMVPASFYWSDLGSWQSLLDISPTDGNGNVVIGDVVAIDCERSYLRSQGRLLSVIGLRDVAIVSTADATFVAPVAKSQEVKRIVEQLEKSGRLETKFTPAHARVLQPGAWRERVAHWLFEETLPLWSTAGVDERHGGFHEALSFEAAPLIKPKRMRTMARQVYAFSVAKLRGWDGDADGLIGHGIAFMEKGRTQRGGWARVLQEDGTIADACEDAYDHACVLLMLAHAYQAGNPDALRLGQETFAFLDEHLEDDRLTGFLETSDGTELRRSNPHMHLLEAFLAWYAATGERGYLRRAARIIDLFRSHFFDTESWTLGEYFDEAWNPAVGPKGQWTEPGHHFEWASLLVEFAAKSRQTDLIAFARKLYASAIATGLNRSTGLAYGAVSRAALPLDLISRSWPQAEAVKAALALEGTGGPDLKPEIEARVGRLFRWHIDPAPLGMWIDRVDEKGSAVATEVPASIFYHLVTALMQYLDKTEEAVYRSPSFPQSINAAEPLAALNRETV

SEQ ID NO: 8132 - protein, 318 aa, Plantago major
EIEDPKLYHYAIFSDNVIAASVVVNSAVKNSKDPTKHVFHVVTDKMNLGAMQVMFKMRDYSGAHIEVKAVEDYKFLNSSYVPVLKQLESANLQKFYFKNDIGNATKDTANMKFRNPKYLSILNHLRFYLPEMYPKLHKILFLDDDIVVQKDLTGLWKIDMDGKVNGAVETCFGSFHRYAQYMNFSHPLIKAKFSPKACAWAYGMNFFDLDAWRREKCTEEYHYWQNLNENRTLWKLGTLPPGLITYYSTTKPLHKSWHVLGLGYNPSISMDEINNAAVIHFNGNMKPWLDIAISQFRPLWAKYVDYENEYVQTCNFGL

SEQ ID NO: 8133 - protein, 344 aa, Schizosaccharomyces pombe
DLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 8134 - protein, 413 aa, Xylella fastidiosa Ann-1
MPPTKTSFPKQDIRILLLEGVSHSGIETFRAAGYSQIKIHTTSLPEEALQAEIAEAHIIGIRSRTQLNAAVLGHAKRLMAIGCFCIGTNQVDLDTAELSGIPVFNAPYSNTRSVAELIIAEAILLLRKIPQKNAECHRGGWSKSAINSHEARGKVLGIVGYGHIGTQVSVLAEAMGMQVIFYDIESKLSLGNARPAASLDELLGIADVVTLHVPETAATKNMLGHAELARMKPGAHLINASRGTVVEIDALDAALVSGHLGGAAVDVFPSEPKGNSDPFISPLSRHDNVILTPHIGGSTLEAQDNIGIEVAAKLIRYSDNGSTLSAVNFPEVSLPEHVGSMRLLHIHRNVPGVLSHINELFSRHNVNIDGQFLRTDATLGYVVIDIGASQTQALALKEALTQVPGTLRTRLLY

SEQ ID NO: 8135 - protein, 352 aa, Zea mays
MAHAALLHCSQSSRSLAACRRGSHYRAPSHVPRHSRRLRRAVVSLRPMASSTAQAPATAPPGLKEGIAGLYDESSGLWENIWGDHMHHGFYDSSEAASMADHRRAQIRMIEEALAFAGVPASDDPEKTPKTIVDVGCGIGGSSRYLAKKYGAQCTGITLSPVQAERGNALAAAQGLSDQVTLQVADALEQPFPDGQFDLVWSMESGEHMPDKRKFVSELARVAAPGGTIIIVTWCHRNLDPSETSLKPDELSLLRRICDAYYLPDWCSPSDYVNIAKSLSLEDIKTADWSENVAPFWPAVIKSALTWKGFTSLLTTGWKTIRGAMVMPLMIQGYKKGLIKFTIITCRKPGAA

SEQ ID NO: 8136 - protein, 622 aa, Debaryomyces hansenii CBS767
MSEQQGSDNRHHHHHHHHNNHHGDHSGQHDGHNNKVHQPQPIDPKANPANRIGKYQVLKTLGEGSFGKVKLAQHTTTGQKVALKIINRKTLAKSDMQGRVEREISYLRLLRHPHIIKLYDVIKSKDEIIMVIEYAGKELFDYIVQRGKMPEDEARRFFQQIIAAVEYCHRHKIVHRDLKPENLLLDEQLNVKIADFGLSNIMTDGNFLKTSCGSPNYAAPEVISGKLYAGPEVDVWSSGVILYVMLCGRLPFDDEFIPALFKKISNGVYTLPNYLSQGAKDILTRMLVVNPLNRITIHEIIEDEWFKQNIEEYLLPPDLSKTKHKKIEVDEDVITALQSTMGYDRDEIVNVINKCNQHNAPQQQSNEIIDAYLLMRENRTLVKDLKNSKLNNMDTFLSQSPPPSWTNNANNNSNMNINVNHSTKAPGVQQSLTYQTLAAVPDLSTLPNSTIAILPSSLPSIHRAYMMESNMDTQLKIAPVSHKKLKTRWHFGIRSRSYPLDVMGEIYRALKNLGAEWSKPTEEELWTIRVRWKYGPCILPNEKSQEEQQKDIPDMMKMQIQLFQLEPNNYLVDFKFDGWENSSNKDVSIKQDVDEMSSFSAYPFLHLATRLIMELAVNSQTN

SEQ ID NO: 8137 - protein, 344 aa, Gossypium hirsutum
MAAALQLQTHPCFHGTCQLSPPPRPSVSFPSSSRSFPSSRRSLSAHVKAAASSLSTTTLQEGIAEFYDQSSGIWEDIWGDHMHHGYYDPDSNVSGSDHPAAQIRMIEESLRFAGITEDPANKPKTIVDVGCGIGGSSRYLARKYGAKCQGITLSPVQAGRANALAKDQGLADKVSFQVADALNQPFPDDQFDLVWSMESGEHMPDKPKFVKELARVAAPGGTIIIVTWCHRDLGPSEEDLQPWEKKLLNRICNAYYLPEWCSTSDYVKLLQSLSLQDIKAADWTENVAPFWPAVIRSALTWKGFTSLLRSGLKTIKGALVMPLMIQGYQKGVIKFAIITCRKPE

SEQ ID NO: 8138 - protein, 469 aa, Stenotrophomonas maltophilia
MLPILPVILSGGSGTRLWPLSREAYPKQFLPLVGDATMLQATWNRVAAIAGKAPIVVANQEHRFMAAEQLRECNVTPQALILEPIGRNTAPAIAIAALQALAAGEDALLLVLPSDHVVRDDAAFHAAVQQAAVAADAGKLVTFGIVPTSPETGYGYIKAQAGAGVHAVDRFVEKPDLATAQQYVASGEYYWNSGMFLFKASRYLQELEALQPAILAACRTALERASRDSDFIRLDADAFATSPSDSIDYAVMEKTADAAVVPLDAGWNDVGSWSALWEVSDKDADGNAWHGDVIALDCSNSYAYGNRLIAMVGLEDVVVVETDDAVFVGHKDRVQDVKEIVGRIKRDGRSEAAAHRKVYRPWGAYDSIDNGARFQVKRITVKPGATLSLQMHHHRAEHWIVVSGTAEVTRGEEVILLTENQSTYIPLGVTHRLKNPGKLPLELIEVQSGSYLGEDDIVRFEDQYGRAPA

SEQ ID NO: 8139 - protein, 102 aa, Brassica napus
MASGSLKSLVTSAVTVGVTEARARIFGHMLNPTGQRSSHKILRKKLFGDKVAEWYPYDIKNEDSNVLARGEKERLSKLEMLKRRDKGPPKKGHGRRAAKRNK

SEQ ID NO: 8140 - protein, 507 aa, Glycine max
WRDMEVNNWHKELTYDEWVPITVSGARPAARYKHATAVVDEKLYIAGGSRNGRYLSDVQVFDLRSLMWSSLKLKANVGKDDDDSSQEILPATSGHNMIRWGEKLLLLGGNSRESSAELTVRYIDIETCQFGVIKTSGDVPVARVGQSATMVGSRVILFGGEDMSRKLLNDVHVLDLESMTWEMIKTTQTPPSPRYDHSAAIQGERYLLIFGGCSHSIFFNDLHLLDMQTMEWSQPQTQGDLVSPRAGHTGITIDESWLIVGGGDNRSGCPETLVLDMSKLVWSVLTVVKQKDPLSSEGLSVCSATIGGEKYLLAFGGYNGRYSNEVFVMRPKAKDTMRPKIFQSPAAAAAAASVTSAYALSKSEKLDFMQLDDINSKLSVNGHHKDDVTDKVEAIKEEKRLLELSIAEVRAENSKLGGEIEEINNTHAELTKELQSVQAQLVAERSRCFNLEAKIAELQKLLESMQSVEDEVQALREKKSALDQEMELAATAERKSSGWRWFGGSET

SEQ ID NO: 8141 - protein, 491 aa, Solibacter usitatus Ellin6076
MIEKVSQHLSQNEPLIFERSSPGKKAYQLPELDVPPVDAAEALGAENVRREIDGFPEVSEVEAIRHFTRLSTWNYAIDYGMYPLGSCTMKYNPRINEQVARTEGLAWAHPYQPEALSQGCMEIMWSLEQALAEICGMDAVTLQPAAGAHGELTGILLIRALLEKRGNPRKKILIPDSAHGTNPATAAIAGYAVENIKSSETGGVDLATLEQLVTDDVAALMVTNPNTLGVFENNIARVAEILHQKGAMLYMDGANMNALVGIARPGDFGVDVMHLNLHKTFSTPHGGGGPGAGPVAVKKVLEPFLPTPRLKRSGKKLAFDYKRKQSIGRVKAYYGNFGVLIRALAYTLAHGGPGLKNATMDAVLNAIYIRKALEPYFDLPYTSPSMHEVVFSDDRQAKLGVRTGEIAKRLIDYGFHPYTVSFPMIVHGALMIEPTETESKDEIDLFINAMISIAKEIETDPQMVKGAPYNTRTSKVDEVTAARKPVLRWKP

SEQ ID NO: 8142 - protein, 275 aa, Debaryomyces hansenii CBS767
MEDYTIAVLGCGVMGTAVTSAILKAKFEPYPSKIICCTNSEKLSTELKSKLDSDVIETSYGSESNNKAVSKADIVILGCKPFMFKDVYEQVKGSLSGDQLIISLLAGTTIEELSIMSPYVAKVMTNTPAQFGCGMAVVSFSDEAESKYSDLVMKLIDPVGKAMKLPEKNMDAATALVGSGPAFCLLIMEALVDGGVRMGLPYAVAKESAAKVMEGTAKMVLETGEHPAALRSKICTPGGTTIGGLLKMEDAGVRGGIARAVEEAANISASFAKKK

SEQ ID NO: 8143 - protein, 338 aa, Pisum sativum
MGAKIKIGINGFGRIGRLVARVALKRDDVELVAVNDPFITTDYMTYMFKYDSVHGQWKNDELTVKDSNTLLFGQKPVTVFAHRNPEEIPWASTGADIIVESTGVFTDKDKAAAHLKGGAKKVIISAPSKDAPMFVVGVNENEYKPEFDIISNASCTTNCLAPLAKVINDRFGIVEGLMTTVHSITATQKTVDGPSSKDWRGGRAASFNIIPSSTGAAKAVGKVLPALNGKLTGMSFRVPTVDVSVVDLTVRLEKAATYDEIKAAIKEESEGKLKGILGYTEDDVVSTDFIGDTRSSIFDAKAGIALNDKFVKLVSWYDNELGYSTRVVDLIVHIAKQL

SEQ ID NO: 8144 - protein, 480 aa, Desulfotalea psychrophila LSv54
MIVPVIMAGGSGTRLWPLSRALYPKQFLPLVGEETMLQATLNRLAGLDVTAPITVCNEEHRFIVAEQLRFLDQLGKIILEPAGRNTAPAVALAASIALEKGEDPLLLVLAADHVIEDSAGFVQAIQQALPLAEEGCLVTFGIVPTSAHTGYGYIRRGGPAAVGFRVEEFVEKPDAAVAKQYFEGGEFYWNSGMFLFRASTYLAELRKHRADIADACLASLVSTCHDGDFIRVDKDYFLACPEESIDYAVMEKTEDAVVVPLDVGWNDIGSWSALWEVGDKDAQGNRVRGDVFLQETTNSLVHGGDRLIATIGLDNVVVVDTKDALLVATKDRVQEVKQIVQRLKDEGRSEARLHREVYRPWGKYDSIDAGGRYQVKRISVKPDAKLSVQMHHHRAEHWIVVSGTARVTKGEDVFLVTENESTFIPVGVLHALENPGKVDLELIEVQSGPYLGEDDIVRFEDLYGRIESCSDAQSKKKREV

SEQ ID NO: 8145 - protein, 341 aa, Solibacter usitatus Ellin6076
MKALVKSKSQPGLWLEEIPEPAIGINDVLIRVLRTGICGTDVHIYKWDEWARETIHVPMAIGHEFVGRIEAVGSNVADFFPGDIVSGEGHVVCGRCRNCFAGRRHLCAKTMGVGVNRPGAFAEYIALPMTNIWRHHEGIDLDVAAIFDPFGNAVHTALSFPVLGEDVLITGAGPIGIMAAAVARHAAARYTVITDLNPYRLELAAKLGVTRAVNVREQKLGDVQKELGMTEGFDVGLEMSGNPAGFRDMLANMSHGAKIAMLGIPAGEMAIDWRTVIFNMLTIKGIYGREMYETWYKMSVMLQSGLDISPVITHRYHYTDFEKGFEVMSSGNSGKVILSWD

SEQ ID NO: 8146 - protein, 134 aa, Zea mays
QGLKVIACVGETLEQREAGSTMDVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 8147 - protein, 198 aa, Platanus x acerifolia
LGALLEEREGRLSDEEIVDYLVALLVGGYETTSTTMTLAVKFLTDTPLALAQLKKEHDEIMARKQNEALQWSDYKSMPFTQCVINETLRVANIVSGVFRRAIKDVNIKGYTIPKGWKVFASFRAVHMDQHHYKEARTFNPWRWQQEASPTTPAENVFTPFGGGPRLCPGYELAGVEISIFLHHLVTMFSWVPAGEDRL

SEQ ID NO: 8148 - protein, 413 aa, Listeria monocytogenes str. 4b H7858
MLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 8149 - protein, 475 aa, Pseudomonas aeruginosa UCBPP-PA14
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQVSGQPIEFRMWLYPWLTWAVILFIVAALSIMLIMPEHRHEVFATALLTIFTVCLGLLNARRKPRLGEDYAGKTARV

SEQ ID NO: 8150 - protein, 137 aa, Campylobacter coli RM2228
MEKTLSIIKPDAVKKGVIGKILDRFESNGLRIAAMKKVQLSKEQAEAFYAVHKERPFFKDLVEFMISGPVVVSVLEGEGAVLKNRDLMGATNPKEAQPGTIRADFAESIDANAVHGSDSLENAKIEIEFFFKSNEIC

SEQ ID NO: 8151 - protein, 333 aa, Enterococcus faecalis V583
MLKKQKIAIVNSSSFGQIFPEHLTRLEKIGTVKHFTVDSEIGGKELAERLQGYTIIIASVTPFFTKEFFEHKDELLLISRHGIGYNNIDLDAAKQHDTIVSIIPALVERDAVAENNVTNLLAVLRQTVAADASVKADQWEKRANFIGRTLFNKTVGVIGVGNTGSCVVETLRNGFRCDVLAYDPYKSATYLQSYGAKKVDLDTLLASADIICLCANLTEESYHMIGSAEIAKMKDGVYLSNSARGALIDEEAMIAGLQSGKIAGLGTDVLEEEPGRKNHPYLAFENVVMTPHTSAYTMECLQAMGEKCVQDVEDVVQGILPQRAVQEVSRYVS

SEQ ID NO: 8152 - protein, 384 aa, Triticum aestivum
  misc_feature (306)..(306): Xaa can be any naturally occurring amino acid
  unsure (1)..(384): unsure at all Xaa locations
MGEYCAPAAAAEAEGERPVAVSVLPLPPVAAAGRYLYGDYDRCSTKQVFDNLHGNISLDPLAREFVDTEEFQRLRDLKQLGLTYLMFPGAVHARFEHSLGVYRLAGEAMNNLQKYQGNELGIDRIDVQTVKLAGLLHDIGHGPFSHLFEHEFLPRVHPGSTWSHEHMSALLLDSIVDKHSIDIEPDYLKVIKEMIVASSDVSTAEGVKEKRFLYDIVANGRNGIDVDKFDYIDRDCRACGIGSNFQHWRLLEGMRVMGDEICYPAKDYLSIHKLFTTRADLHRTVYTHAKVKAVELMLGGALAQAXKSIETAPNDELKKAKEIIQRIRRRELYKVAVLSSRNTVLLFCLLFCYMLLSSHSYLCSNCGSYGYARAILFECFSMCS

SEQ ID NO: 8153 - protein, 352 aa, Haemophilus somnus 129PT
MSINFVKEGNIMSKYVRSVCLVEPKKVDIKTVLYPKKGECDVLIKVESIGICGSDIGAFRGTNPLVTYPRILGHEIVGTVIESGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 8154 - protein, 796 aa, Escherichia coli
SQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNHTAGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRDQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 8155 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 8156 - protein, 377 aa, Zea mays
  misc_feature (85)..(85): Xaa can be any naturally occurring amino acid
  misc_feature (140)..(140): Xaa can be any naturally occurring amino acid
  unsure (1)..(377): unsure at all Xaa locations
MDHAADAHRTDLMTITRHVLNEQSRNPEPRGDFTILLSHIVLGCKFVASAVNKAGLAQLIGLAGETNVQASALSSLFFSFLRRDXSRCDDAAAMVARRARQGEEQKKLDVLSNEVFVKALVSSGRTCVLVSDAWADAWAXRVGLRGGYCVCFDPLEGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLIPTKIHDRSPIFLGSYDDVEEIKALYAEQAKSSSASS

SEQ ID NO: 8157 - protein, 472 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 8158 - protein, 380 aa, Clostridium perfringens str. 13
MNKNVIGIEISGIRKFYNEVVKFPEAISLTLGQPDFPVPEKVKEAMIRAIEEGKTTYTANAGIVELREEISSLLKNNFDIDFSKDEIIITVGGSEGLYAAMTALLNPGEKVLVPSIAYPAYESISKIIGCEVINYDLNEDFSVNIESLKEGIKEGGKLLVLSYPCNPTGALLSKKSRDELIEIIKENDILVLTDEIYSSLCFEEEYYSVAQCKDIKEKIIYVSGFSKMFSMTGLRIGYVACPKKIYDQIIKVHQYNSSCATSISQWGALEGLKSCMNDVENMKESFKERMNFTYKRLKSMGLEVEKPKGAFYIYPNISKFGLTSEEFCHRLLKEGKVACVPGDAFGKGGEGYIRISYCYSKDELERALDKLEAFVKTLKK

SEQ ID NO: 8159 - protein, 140 aa, Zea mays
MTSPMVATPVQFHTTGRLSFCSFSFPSASGRRRFAAVRASAETMATEKLGIKVERNPPESRLSELGVRQWPKWGCEKSKFPWTYSAKETCYLLQGKVKVYPEGHGEEFVEIGAGDLVVFPKGMSCTWDVAEAVDKHYNFE

SEQ ID NO: 8160 - protein, 394 aa, Methanosarcina acetivorans C2A
MKAVVYKGPRNVDVEEVKKPEIEKPTDVIIKVTSSGICGSDLHLYDGHGPDGLGTILGHEPMGVVEEVGDAVELVKPGDRVVIPFNVACGSCLNCIRGLTNMCLTMNPDAAIANYGYPGAGPYAGGQAEYLRVPYGDWACLKLPGEPGDEFEDDFVMLADIFPTAYYAAELAKVKTGKTVAVFGAGPVGLLAAYSSMLMGASEVYVVDKSDKRLKLAESIGAVPINFTDGDPVEMIMQIRQNNKNLMSSLRPGEEKVLGVDCAIDAVGYQALDRNNSEEFKPNQVLMDIARIIAPGGSIGVIGVYSPDPAGKDENEKQGYLTLPWAELWFKGVSIGTGPTPVKQMHGFLRNLIFNGKAKPSFIVSDRISIDEAPEAYKQFDKRDDVVKPIIKFH

SEQ ID NO: 8161 - protein, 150 aa, Sordaria macrospora
PFCADLRCGDWREALHPAGMKTLILLEIFTFEASASALMASILLLEPRISLSEYVPLSLTHYRLRLLTCLIQVWDIQSRTIRNTFHGHEQDIYSLDFSRDGRTIASGSGDRTVRLWDIETGQNTSVLSIEDGVTTVAISPDKQFVAAGSL

SEQ ID NO: 8162 - protein, 369 aa, Vibrio parahaemolyticus RIMD 2210633
MPISTPQEIIDDIRAGKMVILMDDEDRENEGDLIMAAEHITPEAINFMATYGRGLICLTMTKARCENLGLPPMVQDNNAQYTTNFTVSIEAAEGVTTGISAADRARTVQAAVAPNAKAADLVQPGHIFPLAAQDGGVLTRAGHTEAGCDLARLAGLEPASVIVEILNDDGTMARRPDLEIFAEKHGLKLGTIADLIEYRNNTETTIERVAECKLPTEHGEFTLVTYKDTIDSQVHYAMCKGDLAGEAPLVRVHLQDVFTDVLRSDRNAERSWTLDKAMKRIGEEGGVLVVLGNEESTELLIHRVKMFEAQDKGEAPTLAKKQGTSRRVGVGSQILADLGVHDMRLLSSTNKKYHALGGFGLNVVEYVCE

SEQ ID NO: 8163 - protein, 355 aa, Pyrococcus horikoshii OT3
MKQKKAWAIVKEVIEEADIVVEVVDARDPIGTRNKKLERMVLESGKKLLLVMNKADLVPKEWAEEYKRKSEIPVVFISARERKGTGILRRELKKIAKMINKERVKVALIGYPNVGKSTIINVLKGKHSVGTAPIPGYTKGKQMIRLTKKIWLLDTPGVVPIDDFDELVIKGGFPADKIREPVKPALKLIRRILETRKEALTEKFNITEFEDEEDILRKIGERRGIIREGGVVDIEETARWFLREWQTGRFTLFSTEEKREEEYIESFDEILEIIKEQNLTDPRMIIWKFGNILEDYLGAERRFGAIKVGEFMIAIATGFKKCPNAIKFVERITRKNAVAAECFGKKWKGIVAILE

SEQ ID NO: 8164 - protein, 472 aa, Triticum aestivum
  misc_feature (298)..(298): Xaa can be any naturally occurring amino acid
  unsure (1)..(472): unsure at all Xaa locations
RLQDNADHVDKSEETTPRPKLKPLHWDKVRASSDRAMVWDQLKSSSFQVNEEMIETLFICNPANAAPKEATKRPALPTPKAENKVLLDPKKAQNIAILLRALNVTKEEVCEALCEGNTQNFGADLLETLLKMAPTKEEEIKLREFKEETSPIKLGPSEKFLKAVLDVPFAFKRVDAMLYIANFESEVKYLKNNFEILEAACDELRNSRLFLKLLEAILKTGNRMNVGTNRGDAHAFKLDTLLKLADVKGTDGKTTLLHFVVQEIIRTEGSRLSASNQSTPRTLANPLRDELECKKLGXLQWWLGLGNELSSVKEAAAMDSDVLSSYVAKLAGGIEKITEVLRLNEELNTRDDAWRFHDTMQKFLKKADDEILRVQAQESVALSLVKEITEYFHGDSAKEEAHPFRIFMVVRDFLSVLTQVCREVGRINDRTIASSVRHFPVPVNPMMPQLFPRIHALRAGISDDESSVASSP

SEQ ID NO: 8165 - protein, 311 aa, Triticum aestivum
HSITSLYKKAGWYRSGIPGISSTHGFDTQTISELVTVITRINYGQSTSISGLAGAVSLAGSESGLWSIKGGNWQLAAGLLKTANATLHLQEGIESISDAGDYYVLKSNKGHEYNCTVTVVATPLDEVNITFIPPISIPPRKMQHTHTTFVRGLLDPKFFGLSSVSDIPELIGTMELPDIPFSCISVRKKHGEHDMTYKIFSRAKLEDALLDQMFSTREETIRIDWPAYPHYQAPEDFAPIILDGRHLYYVNTFESAASAMETGAVAAENVARLVISRLPLGLRAGLSSAAAPEPHIESSAGEEEGPRRVDL

SEQ ID NO: 8166 - protein, 391 aa, Lactococcus lactis subsp. cremoris
MDLLKKFNPNLDKIEISLIRQFDQQVSSIPDIIKLTLGEPDFYTPEHVKQAGIAAIENNQSHYTGMAGLLELRQAASEFLLKKYGLSYAAEDEILVTVGVTEAISSVLLSILVAGDEVLIPAPAYPGYEPLITLAGGSLVEIDTRANDFVLTPEMLDQAIIEREGKVKAVILNYPANPTGVTYNREQIKDLAEVLKKHEVFVIADEVYSELNYTDQPHVSIAEYAPEQTIVLNGLSKSHAMTGWRIGLIFAARELVAQIIKTHQYLVTSASTQSQFAAIEALKNGADDALPMKKEYLKRRDYIIEKMSALGFKIIEPDGAFYIFAKIPADLEQDSFKFAVDFAKENAVAIIPGIAFGQYGEGFVRLSYAASMDVIEQAMARLTDYVTKKRG

SEQ ID NO: 8167 - protein, 220 aa, Spinacia oleracea
RNLLSVAYKNVVGARRASWRIISSIEQKEESRGNEDHVSVIRDYRSRIEKELSDNCDGILKLLDTKLVPAASSGDSKVFYLKMKGDYHRYLAEFKTGAQRKEAAESTLTAYKAAQDIANAELAPTHPIRLGLALNFSVFYYEILNSPDRACNLAKQAFVEAIAELDTLGEDSYKDSTLIMQLLRDNLTLWTSDMQDEAADEITEEAAKQQKAVNNNKIAY

SEQ ID NO: 8168 - protein, 482 aa, Rhodococcus sp. RHA1
MLEEAAIASVQTGLFIGGKWRDSARTMPVHDPSNGQILCTVADADAAEAREALDAAVAAQPSWAATTPRERSTILMNAHRLLLENVDRLALVMTLEMGKPLTEARGEIAYAAEFFRWFAEEAVRIDGGYMTAPGGGSRFLVTRQPVGPSLLITPWNFPMAMGTRKIGPAIAAGCTSVIKPAAQTPLSILALADILTEAGLPDGVVNVVTTSSPDEVITPLILDGRARKLSFTGSTKVGKHLLELCARTVMRTSMELGGNAPFLVFDDANLDDAVDGAMAAKMRNIGQACTAANRILVHSSVAEEFTRKLTQRMEALPVGRGTEDGVVVGPLIDEAAVAKVSSLVADAVERGASVLTGGEALDRPGNFYPATVLTGVPDDAEMCHNEIFGPVAAISTFETEAEAVERANDTPYGLVAYVYTDSLKRGIRVCEALESGMVGLNQGVVSNPAAPFGGVKESGLGREGGTTGIDEFLETKYIGVAV

SEQ ID NO: 8169 - protein, 1380 aa, Burkholderia thailandensis E264
MSKHRQAPGPRGSLVMGNLAAYKRNPITMLLRLHQQYGDVARNRLGPFVTHALAHPDHIQYVLQENHRNYVRGRFYDNFKMFFGDGLLTTDGEFWRRHRRAVQPLFHKKQVDAHTAAVGDAALALAHRWSALPPGKAVDVVEEMMHLSLRMLGLMVFNTDVSSHAEAVGPAVRFGIEAMMPQGNMNDFIPRWAPTRFNRRIAHARRAIDTIIAKIIADHREARCEPSDVISLLLNARDPDTGAPMTQQEVHDEVMTVFLAGHETTGAGLAWALYALAQHPAVLRQLRDELDARLGGRAPTVQDFEQLPYLSQVVDEVLRVYPPIWGFTRDLVEDDEIGGYRIPARSSVFMSPYVTHRHPAFWRNPDAFDPENFASDAPARHRFVYFPFGGGMRKCIGFQTALLQMRVLVAVVAQHFDLNALPGHPIELGAAISLRPVHGIRLIVKPRERQQSHLARVREHESARALRPLGDTAEAAGAVCPMTDAAHEICVSADAAMVEAGAPGDANAGGAAAAVERAAARQHEPAAAAPLPFATSAATGAPPAASPVAAAAAGASARSVPAWRFTWRPVPVDPVPDEPSPALSGKRIALVNGRGGTIERVAAALARTCAKVSVFAPAANADHAEAARAFVNEAGPLDGIVDLGLEAPFALDDASAWEAPMRRTVELLKACYGDWAAEDDTSRLFYVALTWMDGQMGYGDDAGAQPLGGLWAGLAKTLPQELPNCNVRVLDIAPDETGRVDRLVVNELYRWGLFEVGYRNGVRYTLHAKRDELPPLAVDARAALGPGDTVLFSGGARGIGLLCARALAERHGCTVLVTGRETPPDGGEPWMALDEAGFKRYGLEQLRAATPERPPKAIRASLQRLKHRRELKAALDEMAALGLPVHYRVCDVTDRAAVRALCDELGDSLRIVIHNAGVDQPVRLIQKRADDFAHTVRTKVLGFANLCDAVRARPRLAQFCNVGSLTGRWGGMTGETDYAAANEALARLGLWAAKHALPPACGVKTLVWPTWEGVGMITNFAVTQRYVSPMNVEEGVRHWLRELASPGGGEVMFMGAVGRAPTPVQIKGFQPIRELPNIGELVTRRHHVGEPVRFRPFKRFEGRYAIDPAVAPYARAFRFNGRAVLPASLVLEHACAVGDWVMPPTGEPRELSEMTNVVLRLDALPDVPAGDAPVEIASEAAGYMIGDVWCVDVRCSDARTQAELLSMTLVYRPQPEQIGAAYARAPDTKPEPAPLTSAPHAAWDGELLPAGDWSVPDDASAGIVRIGRVPPAAVLSLWTLPFPLELRLPVNHVEHVLRVLLAEWGAAQTDAPSVWRIGAAKLARLPAASADGVVEYATGRFAVLDARGYVLLRVDDTRVDSDAAHAAPAETVALADPLTA

SEQ ID NO: 8170 - protein, 267 aa, Sulfolobus solfataricus P2
MKKVTIRDFIKKKSMKEKITMLTAYDYPTAKIISNTTLDSILVGDSLGMVVLGYTNTLNVTMRDMISHTRAVARANPPQLIVSDMPFLSYEIDVKSAVKNAGLLVKAGSDAVKLEGGEEIKDIIRAIVKAGIPVMGHIGLTPQRFLRLGGFRTIGKTKQEEEQLIKDSLELEDAGVFSIVIENTYVDIAKRITEKLNVPTICIGAGPYCDGQVLVIHDLLGLSEVTPYFAKSYVNLKEIISSAINQYIIDVKTNKFPEKQHYKERES

SEQ ID NO: 8171 - protein, 296 aa, Zea mays
VAVVTGGNKGIGLEVCRQLASRGVAVILTARDEKKGTEAVATLRGSGLPDVQFHRLDVSNPTGTARLAEFIKEKFGRLDILLVGKNAMERLQWLVQHSTESYEEARECLKINYFGTKYVTEALLPILISSSDGRLINVSSNYGLLQALILRWNGTTIFVIQFFVFVFQHFSGEDLKQELNDIDNLTVERLDEMPELFLKDYRSGQLKSHGWPADSEYLAYKVSKALTNGYTRILAKAHPELRINCVHPGFCKTDINFDTGEYTAEDGASCIVAVALLPEGGPTGVFFFRREEVPFV

SEQ ID NO: 8172 - protein, 510 aa, Triticum aestivum
MASGFAPDIWQWIRSLPGQWRADESHSLQICSSPSTNQSLNLVVTRQSEETHPFSLSFSICDGSRDHDPVSLWSSHYSKLKPANTTDVAAQFLLEIVCGVLRYGPYSSSRAIFRLPAVHVSEGSGKILSLSVLALAFLVCIYEAPSTPRREFIGAITARLTRDEMRHAARELMLALGSDLEEQWMRSLNLGVTNWAMEALRSGAGASSPLRFAVFSYALSASRLWKVQLYCPVVAMTMEHHPSHHHHHQQQHQLVKDERLLFSLNYQQLESVIQFTYRVAFQENWIDVAVNVDNIRCDVIQLVSETLMARQGHGSDEKHFPSRISLQLTPLAQSDILSLSVSRSTDNPVQEVGTDKGIDTTLAAAPASMGISVSAHETVTRTMKPWKFEHSVHGNTASLSWFLHGSGGGGREVFSSDPPKLELFQPRSWFRNRYTSPTRPFTRSGGVIFAGDEYGEGVCWRMGAAAAGKTMEWEIKGRIWVTYWPNKKRTLHTETRRLEFRELLHLTIGE

SEQ ID NO: 8173 - protein, 447 aa, Pseudomonas syringae pv. phaseolicola 1448A
MTRNDPHPLAQLLMGIDEVECVTPDLNGVPRGKVMTAAGFLEGRRLQLARGVLLQCIMGGYPPSRFYGSDDGDLALLSDPQQVHRLPWSEQPRALAVCDAEELSGERCMLSTRSQLKAVIARYAARGLAPVVATELEFFVFAPNPEPLYPFVPPTGLDGRREQGHSAFSVSSNNGLRPFFAEVYACMAALGLPRDTVMHEMGVSQFEINLLHGDPLLLADQTFLFKHLLKEVALKHGLIVVCMAKPLAHTAGSSMHLHQSVVATDSRVNVFSGADGQPTDTFRHFIAGQQACMADFTALFAPNVNSYQRLCQPYASPNNACWSYDNRAAGLRIPSSAAAARRVENRLPGADANPYLAIAASLAAGLHGIEQKLEPTPPMQGAIEVPEELSLPCTLHAALERLKSSQLAKELFGHEFIEGYIASKTLELTSFFDEITPWERRVLAAQV

SEQ ID NO: 8174 - protein, 1043 aa, Arabidopsis thaliana
MTRWSMSMHCTLFLLFLLRLTCIFSDSDYLMGLGSYDITGPAADVNMMGYANMEQVASGVHFRLRARAFIVAEPYKKRIAFVNLDAGMASQLVTIKVIERLKQRYGELYTEENVAISGTHTHAGPGGYLQYILYLVTSLGFVHQSFNALVDGIEQSIIQAHENLRPGSILINKDISFGAELAGELLDAGVNRSPSAYLNNPAHERSKYEYDVDKEMTLVKFVDDQWGPVGSFNCGDNKGTAARIMEDWFERENGCRSVDVESPRRVSSIISDPYDQDLMEMASSLLSTGGKTVTRMSSVARRVRSRFRHADKPRFVSAFCQTNCGDVSPNVLGAFCIDTGLPCEFNQSTCGGKNEQCYGRGPGYPDEFESTRIIGERQFKKAADLFTKASEEIQGKVDYRHAYVDFSQLEVTINGQNGGSEVVKTCPAAMGFGFAAGTTDGPGAFDFKQGDDQGNPFWRLVRNLLKNPTEEQVRCQRPKPILLDTGEMKQPYDWAPSILPVQILRIGQLVILCVPGEFTTMAGRRLRDAVKTVLKEGSNGREFSVVIAGLTNSYSQYIATFEEYQVQRYEGASTLYGPHTLSGYIQEFKKLANDLLSAQTTDPGPQPPDLLHKQISLLTPVVADMTPIGTAFGDVTSDVPRLSKFRKGADIVRVQFRSANPRNDLMTEGTFALVERWLEGRETWVPVYDDDDFCLRFKWSRPFKLSTQSTATIEWRIPETASPGVYRITHFGSAKTPISSIHHFSGSSSAFVLCTIPLDTAKVRLQLQRKIPTGDGENLPKYRGSIGTLATIAREEGISGLWKGVIAGLHRQCIYGGLRIGLYEPVKTLLVGSDFIGDIPLYQKILAALLTGAIAIIVANPTDLVKVRLQSEGKLPAGVPRRYAGAVDAYFTIVKLEGVSALWTGLGPNIARNAIVNAAELASYDQIKETIMKIPFFRDSVLTHLLAGLAAGFFAVCIGSPIDVSRYLSQNISLKDKVKSRMMGDSTYRNTVDCFIKTMKTEGIMAFYKGFLPNFTRLGTWNAIMFLTLEQVKKVFLREVLYD

SEQ ID NO: 8175 - protein, 184 aa, Arabidopsis thaliana
  misc_feature (13)..(13): Xaa can be any naturally occurring amino acid
  misc_feature (112)..(112): Xaa can be any naturally occurring amino acid
  misc_feature (134)..(134): Xaa can be any naturally occurring amino acid
  misc_feature (147)..(147): Xaa can be any naturally occurring amino acid
  misc_feature (152)..(152): Xaa can be any naturally occurring amino acid
  unsure (1)..(184): unsure at all Xaa locations
MASSMFSSTAVVXSPAQATMVAPFTGLKSSASFPVTRKANNDITSITSNGGRVSCMKVWPPIGKKKFETLSYLPDLSDVELAKEVDYLFRNKWIPCVEFELEHGFVYREHGXNTPGYYDGRYWTMWKLPLFGCXTDSAQVLKEVERXAKREXPGAFIRIIGFDNTRQVQCISFIAYKPPRFTEA

SEQ ID NO: 8176 - protein, 478 aa, Bacillus anthracis str. Sterne
MRKTMSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 8177 - protein, 492 aa, Wolinella succinogenes
MAQKTLLIITDGIGHKPSSPHNAFTQAKKPTYDSLFASAPHALLSTHGLSVGLPEGQMGNSEVGHMCIGAGRILYQDLVKISLALKDGSLEKNPTLLGFSSRAKRIHLAGLASDGGVHSHMEHLLGLAQIFSRLGHEVLLHLITDGRDVSPTSSKEFIAQALALESDLIKIATISGRYYAMDRDKRWDRIKRAFGVIARGDSPTSLTPQEYIQAQYQAGITDEFIEPAALGGYQGFEPSDGFVFANFRSDRAREIVSALGGASFEGFDRGAYQPPKTLAMTSYDDSFPFPILFPKEKVEPTLAQVISEAGLSQLHVAETEKYAHVTFFFNGGIETPWENESRVLIPSPSVATYDLKPEMSAPEVAEATLSGMRQGYDFIVVNFANGDMVGHTGNTEAAISAVESVDRELGRLLEEAKKSGYAVILTSDHGNCEEMRDERGSMLTNHTVGEVWCFILAQGVTEIREGGLNQVAPTVLKIMGLPTPKEMDSPLF

SEQ ID NO: 8178 - protein, 428 aa, Clostridium acetobutylicum ATCC 824
MKMSSLYERSLKVIPPVAGRATKLGVVRGEGAYLYTEDGRKVLDFASGVAVCNLGHNNPAVIKAAKEQMDKLIHGGHNVVYYESYVKLAEKIVELTGNKTMVYFSNSGAEANEGAIKLAKYITKRQAIISFKGSFHGRTLATTSITGSSSKYRKNYEGLLPSVYFAEYPYCFRCPYKQNKESCNMECISQFEDMFKKLIEPESVAAIIMEPVQGEGGYIVPPKKFLKAVREICDKYGICLIFDEVQCGFGRTGKIFAHENFEVEPDIFTCAKAIASGFPLSAVIGKKELMEKWPAGAHGGTFGGNPVACAASLATIKELESGVLDNANNMGNYLKEELLKLKDKYACIGDIRGIGLMIGMEFCKENNNPDGDIVTFIREVAVNNNLILLGCGTEHNVLRFIAPLTVEKSEIDMAISIVEKGIVEYLNK

SEQ ID NO: 8179 - protein, 282 aa, Tropheryma whipplei TW08/27
MVFVLTYVPSVLLGDGVSIPQFGLGTYELPPNETSSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHINKIKEAGFPLPSVNQIELHPWLQQRELVLSCRNYGIQIESWGPFARFSKDLDAFPELTRPAKEYGKTPAQVILRWHIQKGYVVFPKTVHAERLRQNIDIFDFDLTPDEISGIDSLDAGFRTGPDPSSFRAGLD

SEQ ID NO: 8180 - protein, 348 aa, Pyrococcus horikoshii OT3
MSEKMVAIMKTKPGYGAELVEVDVPKPGPGEVLIKVLATSICGTDLHIYEWNEWAQSRIKPPQIMGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELMRAGKTGKVVFMLK

SEQ ID NO: 8181 - protein, 448 aa, Pseudomonas fluorescens Pf-5
MRLSSECKTTSLDQLSRLPEAHGYRLGSLCFPIVFAGTKMTSSEATAVRFSLSQRALGLSAPGTSSMRSKANALKESGIKVINFAAGELSFDACEDMRAGAIEAIANARNRYTPPIGLPALREKLAQRVSQRTGVEFAANEVAVTAGAKQALYNACMVLLNPGDEVIVPTPYWETFPTQIRLAGATPVCVQTRADHYRLTVDAVCGALTERTRMIVINTPNNPTGTVYEREQLLAIAQLAQERQLWVMFDECYRGLVREGHEHHNILALCPALKGQTVLIDSFSKSQAVTGWRVGYACAPAPVIAAMHNLQGHTTSNPSSLSQYAALNTLNADSSHFADLVNPFLQRQLHAARTYLDRLEGVSYAPPEGAFYLYIDVSSRLGGYYQGEAVRDVDHLADLLLTEAHIAVVPGSGCGDPHCIRISYAVEYEELIEGLGRFAQFISAIVID

SEQ ID NO: 8182 - protein, 324 aa, Candida parapsilosis
MSTATASPAVKLNSGYEIPLVGFGCWKLTNDVASDQIYRAIKSGYRLFDGAEDYANEQEVGEGIKRAIKEGIVKREELFITSKLWNSFHDKKNVEVALMKTLSDLNLDYVDLFYIHFPIAQKPVPIEKKYPPGFYCGDGDKWSIEEVPLLDTWRALEKLVDQGLAKSIGISNFSAQLIYDLIRGCTIKPVALQIEHHPYLTQPKLVEYVQLHDIQITGYSSFGPQSFLEMDLKRALDTPVLLEEPTVKSIADKHGKSPAQVLLRYQTQRGIAVIPRSNSPDRMAQNLSVIDFELTQDDLQAIAELDCNLRFNEPWDFSNIPVFV

SEQ ID NO: 8183 - protein, 517 aa, Methanosarcina barkeri str. fusaro
MLHMTQAKKPLMLIILDGWGYREAREGNAILAARTPNLDHLIEEYPWCFLEASGEAVGLPEGQMGNSEVGHLNIGAGRIVYQDLTRINFSIRKGDFFKNPAFLGAISNAKANDSSLHLMGLVSYGGVHSYMAHIHALIKLAQQEGVKKVYIHAFLDGRDVPPKAALKDIEELDAFCKENGNAKIATISGRYYAMDRDKRWDRTKLAYDALTMGVAPYKTPDAETAVSEAYKRGETDEFVKPTVITDSEGKPEAVIKDNDSIIFFNFRPDRARQLTWAFVNKDFENFPREKHPKVYYVCMAQYDETLDLPIAFPPEELENVLGEVLSKQGLAQLRIAETEKYAHVTFFLNGGQEKCYEGEDRCLIPSPKIATYDLKPEMSAYEVTEEVIGRIRSGKYDVIVLNFANMDMVGHTGIFEAAVKAVEAVDSCVGKIATVLKEVGGVAIITADHGNAEQMENPTTEEPHTAHTSNPVKCIYFGNDEVKGLKNGKLCDLAPTLLELLKIRKPEEMTGESLIIK

SEQ ID NO: 8184 - protein, 823 aa, Desulfovibrio desulfuricans G20
MSRVCKMSKNVREVFRLDELKDDIRRNMVALLGNDPRSKRKFSYYNALAYSVRERLVDLWMRTQSDYYDSMAKRVYYLSMEFLPGRFLMNYLTNMGIVDECREIVAELGFSLEELEEEEWDAGLGNGGLGRLASCYLDSMVSQNIPGYGYGILYDYGIFYQSIVNGNQEERCDNWRRHGCPWEITRLDTLYEVKFYGRSETYYDSDGNVRFRWVDTENVMAMPCDILIPGYGCSHVSNMRLWTAQSSREFNLSDFNRGDYIGAMHGKVMSENITKVLYPNDQFLQGMELRLKQQYFLVSATFQDILRRYLKQHTSLAALPEAVAVQLNDTHPAIAIPELMRLLMDVYGMGWDVAWDICTRTFAYTNHTVLPEALETWPVDLLGRLLPRHMQIIYEINRRFLEGVAATFPGDTERLSRMSVIQEEGGQRVRMANLAIVGSHTVNGVAALHSNILQTGLFRDFHEYYPRKIRNVTNGVTPRRWLMQCNPALSRLITQSIGPEWCCNLEKLRELVPLAEDSAFRDAWARAKLENKRLLSRYVLRKVQMGINPNTLFDMQFKRMHEYKRQLLNVMHVISLFNRIKDNPSADITPRTVLFGGKAAPGYYQAKLIIRLINEVARVVNADADVAGRLRVAFLPNYCISQAEKVVPAADLSEQISTAGMEASGTGNMKFALNGALTIGTLDGANVEIMEEVGAENIFIFGLKAHEVAEKRRSGYNPREFYENDAELRRVMDMIGSGFFSPDERGLFSPVYDSLMHHGDYYMLMADYRPYMEAQAAVDALYLDQDQWVRKSILNAANMGKFSSDRSVMEYARGIWHVEPLGK

SEQ ID NO: 8185 - protein, 467 aa, Xanthomonas campestris pv. vesicatoria str. 85-10
MSDVLPIILSGGSGTRLWPLSRESYPKQFLPLVGDKSMLQSTWLRAAPVAGHAPIVVANEEHRFMAAEQLQQLGVKPSAILLEPKGRNTAPAIAVAALEATRDGADPLLLVLPSDHVIQNEAAFQAAVTLAATAAEQGKLVTFGIKPTAPETGYGYIKAGAGTGASAVERFVEKPDLATAQSYLASGEYYWNSGMFLFRASRYLEELRKFHPAIADACQKAWENGKRDADFTRLDKDAFAASPSDSIDYAVMEKTADAVVVPLDAGWNDVGSWSSLRDVSKQDAQGNAHHGDVIQLDCQNTYAYGSRLIAMVGLEDVVVVETPDAVLVGHRDRIQEVKDIVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 8186 - protein, 100 aa, Zea mays
MGPLGPTVSFSIMVMAKLSGAAQQQPEDERERKEGVRCGGVGGCGFRMPLHYPRYKKADYEAMPEWRVDCLLREYGLPADGDLDSKRRFAMGAFLWPDQY

SEQ ID NO: 8187 - protein, 392 aa, Legionella pneumophila str. Paris
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQNELKELGDVLKKHPQILIATDDMYEHIIWSQAFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 8188 - protein, 740 aa, Vitis vinifera
MNGAVLVAIAAAIGNFLQGWDNATIAGAIVYIKKELDLESTVEGLVVAMSLIGATLVTTCSGAISDWIGRRPMLIVSSMLYFISGLIMLWSPNVYVLLIARLLDGFGIGLAVTLVPIYISETAPADIRGSLNTLPQFTGSGGMFLSYCMVFGMSLLSSPSWRLMLGILSIPSLLYFALTVFYLPESPRWLVSKGRMVEAKKVLQRLRGREDVSAEMALLVEGLGIGGETSIEEYIIGPTGELTEDQDPDAVKDQIKLYGPEAGLSWVAKPVPGGQSTLSLVSRQGSLATQTLPLMDPLVTLFGSVHEKLPETGSMRSMLFPNFGSMFSTADPQIKTEQWDEESLQREGEDYASDGGGDSDHDLQSPLISRQTSSMEKDMVPPPSHSSIMSMRRHSSLMQGTAGEAAGGMGIGGGWQLAWKWSEREGEDGKKEGGFKRIYLHEEGVPGSRRGSLVSLPGGDVPAEGDYIQAAALVSQPALYSKELMDQDPVGPAMVHPAETASRGPMWAALLEPGVKHALFVGAGIQILQQFSGINGVLYYTPQILEEAGVEVLLESLGLGTESASFLISAFTTLLMLPCIVVAMKLMDIVGRRRLLLTTIPVLIVTLLVLVIGDLVTTTTVIHAAISTACVIIYFCCFVTAYGPIPNILCSEIFPTRVRGLCIAICALVYWIGDIIVTYTLPVMLTSIGLTGIFGIYAVVCVISWVFVFLKVPETKGMPLEVIAEFFAVGARQVTAAKND

SEQ ID NO: 8189 - protein, 96 aa, Glycine max
  misc_feature (32)..(32): Xaa can be any naturally occurring amino acid
  unsure (1)..(96): unsure at all Xaa locations
PAPKPQQEEEFEIPFYAYLLASAITAIAAIGXIFEYVNQGPVFEVLSSDSVFYAPLLGFFVFTGIPSSVIIEKFKVKLMKSIQHFRTSYSSLLIMS

SEQ ID NO: 8190 - protein, 82 aa, Brassica napus
  misc_feature (75)..(75): Xaa can be any naturally occurring amino acid
  unsure (1)..(82): unsure at all Xaa locations
MQASRARLFKEYKEVQREKSADPDIQLICDDSNIFKWTAVIKGPSETPFEGGVFQLAFSIPEQYPLLPPQVRFIXKIFHPNV

SEQ ID NO: 8191 - protein, 344 aa, Zea mays
MSKSGALDLASGLGGKINKVEVKSAVDEYEKYHGYYGGKEEARKSNYTDMVNKYYDLATSFYEYGWGESFHFAHRWNGESLRESIKRHEHFLALQLGLKPGMKVLDVGCGIGGPLREIARFSSTSVTGLNNNEYQITRGKELNRLAGISGTCDFVKADFMKMPFDDNTFDAVYAIEATCHAPDPVGCYKEIYRVLKPGQCFAVYEWCITDHYDPNNATHKRIKDEIELGNGLPDIRSTRQCLQAVKDAGFEVVWDKDLAEDSPLPWYLPLDPSRFSLSSFRLTSVGRMITRTMVKALEYVGLAPQGSERVSNFLEKAAEGLVEGGKKEIFTPMYFFLVRKPLLE

SEQ ID NO: 8192 - protein, 386 aa, Clostridium acetobutylicum ATCC 824
MSCTINPLVKKIELSPIREISDAALKYSDAINLTVGQPDFTTPEHIKLSAKKAIDNNHTSYTANSGICELRKAASNFINKKYNLNYNSDKEIIVTNGATEAIDISLRTILEKDDEVLLPAPIYVGYEPVINFCGAKPVYMDTSSNNFILNAEILEKYLTPKTKCLILCYPCNPTGSAMDKNALTEIVNLLKNKDIFVISDEIYSELTFKKRHFSIAGFEDMRNKTILLNGVSKSHSMTGWRIGFIFAPEYLTSEIFKLHQYGSTCSCSISQYAALEALTNGFNDSEYMKKEYIKRRDFIYKELVSMDFDVVKPEGAFYIFPSIKKFNMTSLNFSLKLLEKEHLAVVPGSAFSHYGEGYIRISYAASMKDLKEGMIRLRRFIQSVKL

SEQ ID NO: 8193 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGGAKKVIISAPSADAPMFVCGVNLDAYDSKYKVISNASCTTNCLAPLAKVIHDKFGIVQGLMTTVHATTATQKTVDGPSNKDWRGGRSVGNNIIPSSTGAAKAVGKVIPSLNGKLNGLAFRVPTVDVSVVDLVVRLEKPASYDEIKQAIKEASETTHKGILGYTEEKVVSTDFTGNDNSSIFDRDAGIALNKTFVKLISWYDNEWGYSRRCCDLLGYAAKVDGAL

SEQ ID NO: 8194 - protein, 248 aa, Tropheryma whipplei TW08/27
MFPCVFLDTVGSTNLYLLELLKAKDLDDFFAVFTTNQTAGRGRMARSWECKKGIALSVFLKHNLPGAYINWLPLVIGLAVVKAVNKMLEDATLPHRADIKWPNDVLINGKKLSGILIETPSDGNGLIVGIGLNVAVAPIATSICLRQVGLQASPKEVVSALLAEMHTIYQQLIALAAKDISFKDSECFGEIMRLCSTINKTVRVTGTKTFVGVAQGLDSLGRLVIRHSGDTSIVSAGDIEHLRAIDSL

SEQ ID NO: 8195 - protein, 472 aa, Rhodococcus sp. RHA1
MASDLTRTTAPSQHADAPGRHSHRLGIIAVVATFGGLLFGYDTGVINGALEPLEEDLHLTSFTEGLVVSILIFGAAIGALVGGRMSDRFGRRHNILVLAIIFMIGTIGCVLSPTWEVLALFRFILGLAVGGASATVPVYLSEISPTERRGSVVSRNEVMIVVGQFAAFVINAVIFNIWGEHENVWRFMLLVAVIPAIFLFAGMLRMPESPRWLMSQDRHDEALAVLLQVRSPERARAELEEVRALAEEEKLSQTGGAADLSVKWIRRLIFIGVGLGVFQQATGINSVMYYGTQLLGDAGFSSNAAIVANTLNGLFSVLGVLTGVALINRIDRRKMLIGGFTLTTTFHVLVGLSAFLLPDGTLKAYLILTFVVLFVFSMQATIGPLVWLMLSEIFPLKIRSFAIGVCIFALWIANAVVALLFPPVVTALGIGATFFIFAGLGVLALVFIKTQVPETRGRSLEELEDQFRHDYS

SEQ ID NO: 8196 - protein, 280 aa, Campylobacter coli RM2228
MQELISYIQKAVIEISNALKFPDTSYSQNQNSTGDTQLKFDVLSDEIITNTLSQCPSIKAIISEEKDEILNINENAKFIVAYDPLDGSSLMDVNFAIGSIFAIYEEKASAKNLKAALYSMYGARLELVICEDKPKLYRLDKNNEFVFVKDLQMQEKGKINATGGTQKFWEEKHAKFIKKLFDEGYRLRYSGAMVSDINQILLKGGGIFSYPATSDAPKGKLRAFFEVFPLAFIIEKAGGKTTNGKNHSLLELDFDEIHATTPCFFGSKYEISELLKAYNE

SEQ ID NO: 8197 - protein, 525 aa, Brassica rapa subsp. pekinensis
  misc_feature (6)..(6): Xaa can be any naturally occurring amino acid
  unsure (1)..(525): unsure at all Xaa locations
MPLTEXIYNHLSLFDLSLALLGLFVFCCLREKLTNKHGPMLWPVFGITLEFFIHKNDVYAWVTKSLKKSRNTFLYRGFWLDGSHGAVTCSPANVEYMLKTNFKNFPKGTFFKDRFKDLLEEGIFNADDESWKEQRRVIITEMHSTRFMEHSFQTTQRLVRKKLLKVMESFARSQEAFDLQDVLLRLTFDIICIAGLGDDPETPAQDLPQVPFAKAFDEATESTLFRFMIPPFIWKPMRFLDIGYEKGLRKAIDVVHGFVNKMIMDRICMVNDDETLDNRSVLTRIIQIESHKKGNEIGPSTIRFFRQFCTSFILAGRDTSSVAISWFFWVIQRHPQVENKIIQEIREILKQRGDPSDSSLFTVRELNNMVYLQAAISETLRLYPPIPMEMKQAIEDDMFPDGTFIKKGSRVYFSIYAMGRMESVWGKDCEDFGPERWIHAGKFVSGDQSKYVVFNAGPRLCLGKTFAYLQMKMIAASVLLRYSIKVAQDHVVVPRVTTNLYMKYGLKVTITPRSLEEKILESFHM

SEQ ID NO: 8198 - protein, 116 aa, Brassica napus
FEVEDRENIGGSAYGGQRAVCCTSDLAKLGVCSHGEIIHHPSSKDSSWPQVFGVSFVENDLSATLLTRSIQITRTGMYNLYFIHCDPALKDLVVEGKTIWKNPGGYLPGRMAPLMY

SEQ ID NO: 8199 - protein, 267 aa, Geobacter metallireducens GS-15
MNRKKTIIDIQKMKAAGEKITVLTSYDYPFTRVMDECGIDMILIGDSVGVVFSGYDNTLPVTMDEMIYHTRAVVRARPKALVVADMPFLSYQTDLRDARLNAGRLVKDGGAEAVKLEGGSHVADTIRAIVDMDIPVMAHIGLTPQSIHRMGGYKVQGKKEEQSQRLLDDAKAIEEAGAFAVVLEGIPLKLAEKITEELSIPTIGIGAGPHCDGQVLVIHDILGLCEKYSPKFVKRYGDANALITSAVSSYIAEVKKGEFPDEGHSFS

SEQ ID NO: 8200 - protein, 133 aa, Arabidopsis thaliana
  misc_feature (108)..(108): Xaa can be any naturally occurring amino acid
  unsure (1)..(133): unsure at all Xaa locations
RPKEEEIQHDEVTAYSLLSSTAVVTCAGQATMVAPLTGLNSSGSFPATRKAHNDITYITSNRRRVSCMKVRPPIGKKKGETLSYLPDLSGVESAKVVDYLLRNKWIPXVEFESEHGFVYREHRNTTRFYDGRY

SEQ ID NO: 8201 - protein, 165 aa, Triticum aestivum
MNLLQNLRAGQKILRGEGKTGQEHAERPKQGGTSRTQPTQPHAAAAAASAAPAVQIAMAAEPEQAPAAQEAAVHIVYVDRPEDADPEEFHIRTLAPVLGSEEKARGAVLYHYKHAASGFSAKLTTEQVEDLKKQPGVLQVVPSQTYQLHGNEGGHASTTRTMGLM

SEQ ID NO: 8202 - protein, 322 aa, Neisseria meningitidis Z2491
MGIEIMNHKKIVVLDADTLPGRVFHFDFPHELAVYGTTGADETAERVRDAHIVITNKVMISADIIAANPQLELIAVSATGVNNVDIGAAKAAGVAVCNVRAYGNESVAEHAFMLMIALMRNLPAYQRDVAAGLWEKSPFFCHYGAPIRDLNGKTLAVFGRGNIGRTLARYAQAFGMRVVFAEHKHAHAVREGYVSFEDAVQTADVLSLHCPLNAQTENMIGENELRQMKPGAVLINCGRGGLVDENALLAALKYGQIGGAGVDVLTEEPPRGGNPLLNARLPNLIVTPHTAWASREALDRLFDILLANIHSFVKGEAQNRVV

SEQ ID NO: 8203 - protein, 347 aa, Acidovorax sp. JS42
MPRHAAGAQARLGAAGPGTPTSHRKSREGPKDPQGRGSQRQRQSRQARQIRETPPGPQERPAVSPAATPVRWPAEALWEAIAPLLPGFTVEVLPSIDSTNSELMRRARDGRLEPTLLVTEEQTAGRGRLGRDWHSAATYRDTGVVPALTFSLGLPLAPHDWSGLSLAVGVSVAQALQPVLPPEGSGHPRVLLKWPNDLWLQDGRKLGGILVETATLTAPGAAVPPLVAGQSRYVVVGIGLNVLPVLADGLRTPPACLREVDTTLTAASALQRIAPPLVHALLGFAEHGFAPFQARFAQRDLLAGRAVTLSDGTQGTAHGVTEDGTLLVHTARGMQPITSAEISVRPQ

SEQ ID NO: 8204 - protein, 534 aa, Bradyrhizobium sp. BTAi1
MAGLKSMVVRPSLSVSGLAVSALAVLALALLVAGPALHAQDAPAAAQEHAASGSGPRSGSAGNRAANAPASPSAAEQHKLPADSTTSQTIELPGRTLSFSATAGSIRLFDDKSEPQADIAYTSYQLEGTERASRPVTFFFNGGPGASSAYLQLGNAGPWRISIDAASITPSSKPDLMPNAETWLDFTDLVFIDPVGTGYSRFVASGDEVRKRFFSVDGDVRSLALVVRRWLEKHDRLASPKFIAAESYGGIRGPKIVNNLQHDQGIGINGLILLSPLMDFRDYSGSSLMQYVASLPSYAAVAKQLKGPVTRADLADVERYASGDFLLDLVKGEADLDATNRLADKVASLTGIDPAVSRRLAGRFDVSEFRREFDRKNGRIAGRYDGSVLGIDPYPDSSRSRSADPSGDVLTAPLTSAAVELTTRKLNWRPDGSYELLSGAVNRSWDFGRGISPPESTSELRQILALDPKLKLLVGHGLFDLATPYYGSKILLDQLPAFARPPRVKLVVYPGGHMFYSRDDARQAFRGEAEALMK

SEQ ID NO: 8205 - protein, 425 aa, Coccidioides immitis RS
MAPNNSETAALLKEATALSKTDPSKAETIFQKVLSLGTGSTEAASRDYETALVGLGELYRDQKRPKELAELLRTSRSSFSSFAKAKSAKLVRQLLDFFAAIPNTLDIQISVIKSCIDWAVSERRSFLRQNLETRLVTIYMQKQTYYDALTLINSLLRELKRLDDKLVLVEVQLLESRVYHALGNQPKARAALTSARTSAASVYTPPLLQAGLDMQSGMLHAEDKDFNTAYSYFIEALEGYHSLEEERKATSALQYMLLCKIMLNSVNDVNSLLASKQAIRYAGTSLEAMKAVAKAHSNRSLEEYERALSDYRYELGSDVFIRNHLRRLYDAMLEQNLIKVIEPFSRVEIDHIAKMVGLDTQQVERKLSQMILDKVIIGVLDQGAGCLIIFDETERDQGYDAALETIDKLSSVVDVLYTNQASLLE

SEQ ID NO: 8206 - protein, 700 aa, Medicago truncatula
MSEEAAGGSMLVVYDDDDVDVDVDDDPSDQHLGGGGGGGGCDTSSTEDSPSHQTTLHLVDPTTTTHHHIPYIGQMFPTHDAAYDFYTHFAKTCGFSIRRHRTEGKDGVGKGLTRRYFVCHRAGNTPAKSSTQTKPQRNRKSSRCGCQAYMRISKTTEFGPPEWRVTGFANHHNHELLEPNQVRFLPAYRTISDADKNRILMFAKTGISVHQMMRLMELEKCVEPGYLPFTEKDVRNLLQSFRKLDPEEETLDLLRMCRNIKDKDPNFKFEYTLDANNRLENIAWSYASSIQLYDIFGDAVVFDTTHRLTAFDMPLGLWVGINNYGMPCFFGCVLLRDETVRSFSWAIKAFLGFMNGKAPQTILTDQNICLKEALSAEMPMTKHAFCIWMIVAKFPSWFNAVLGERYNDWKAEFYRLYNLESVDDFELGWREMVCSFGLHSNRHILNLYSSRSLWALPYLRSHFLAGMTTTGQSKSINAFIQRFLSAQTRLAHFVEQVAVAVDFKDQTGEQQTMQQNLQNVRLKTGAPMESHAATVLTPFAFSKLQEQLVLAAHYASFSVEDGFLVRHHTKVEGGRRVYWSPHEGIISCSCHQFEFSGILCRHSLRVLSTGNCFQIPDAYLPIRWRRISVPSSKILQNAPSDHAERVKLFQNMVSSLITESAKSKERLDIATEQVSILLSRIREQPISLQCARDTSTIRNL

SEQ ID NO: 8207 - protein, 346 aa, Bacteroides fragilis NCTC 9343
MLAYTYVEHGKFELLEKLRPQIKDARDAIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 8208 - protein, 402 aa, Bifidobacterium adolescentis
MADWQTLSDRINHVAPSATLAVDSKAKAMKAAGIDVIGFGAGEPNFPTPAPIVAAAAAAVQDPKNYRYTPTAGLPELRQAIADKTLRDSGYEVDPSQVIVTNGGKQAVYESFQILLNEGDEVIIPTPYWTSYPEAVKLAGGVPVTVFAGADRNFEPSIEAIEAARTEHTKAIIVNTPNNPTGAVWKPETVKAIAQWAIEHHVWVISDEIYEHLNYDGAKTTYIGAAVPEVRSQLLVLNGVAKTYAMPGWRVGWMIAPVDVAKAASKLQGHMTSNVNNISQRAAIEAVSGSLDAVYEMRAAFDKRRQTIVAALNDIEGVNCPTPTGAFYAFADVTALLNKPIGTNKTTFANTSELAAALLDEGHVAAVPGEAFGAPGYLRFSYALADDDLVEGMRRMKRWIED

SEQ ID NO: 8209 - protein, 130 aa, Arabidopsis thaliana
  misc_feature (29)..(29): Xaa can be any naturally occurring amino acid
  misc_feature (54)..(54): Xaa can be any naturally occurring amino acid
  misc_feature (68)..(68): Xaa can be any naturally occurring amino acid
  misc_feature (111)..(111): Xaa can be any naturally occurring amino acid
  unsure (1)..(130): unsure at all Xaa locations
RVQKGSSMHSSATMVASPAHAIMVAHFNXLKSSAAFTSTRIANNNITSIRSNGXRVNCIQVWPPIWKXRTFLTHSYLRDIEESKMDMEFDDLNRLKFIPCVEIYLQHRFLXRDHGKSPRYYHGLYSIMLN

SEQ ID NO: 8210 - protein, 561 aa, Vibrio parahaemolyticus RIMD 2210633
MAMTKHDESWWKTATIYQIYPKSFCDSGSKGTGDIKGIISKLDYLKHLGVDAIWLTPVYQSPMVDNGYDISDYYAINPQFGTMEDFDTLLAEAHQLGIRIIMDIVVNHTSTEHHWFQSALGDKNSPYRDYYIWKDPVDGAEPNNWQSKFGGNAWELDDATGQYYLHLFAKEQADLNWENPAVREEVKEVISFWADKGVDGFRLDVINLISKQQDFPSDDIGDGRRFYTDGPRVHEYLQEISEAVFQKYGSVTVGEMSSTTLEHCQQYSSLNGKELSMVFNFHHLKVDYPNGEKWTKAPFDFIQLKQIFNHWQTGLNGKGWGALFWCNHDQPRVVSRLGDDKQYRVESAKMLAASVHMMQGTPYVYQGEEIGMTNPGYTEISQYRDVESTNMYDIMVNRDGVSHEEMMAILAQKSRDNSRTPMQWNSQKHAGFTEGTPWLEVAQNYSEINAEAAVADLNSVFYFYKRLIELRKQVPVITDGRYEDLLPEHQRIFAYARQNDKQTLLCVNNYYAAEVECVLPERFELSKAKNLLSNYQNSASAVASNHQVLRPYETRILLIEE

SEQ ID NO: 8211 - protein, 483 aa, Burkholderia vietnamiensis G4
MSSGVRHDYAPLRLYIDGRFHDADGRRTQPVVDPGTTRVLGELPHATAHDIDAAVQAAHRAFVTWRHESPLVRSDLLRRAAALARERAETIGRHITMDQGKPLREAIAEVVSAAEQLEWHAEEGRRTYGRVVPARSPDVMQTVLREPIGVCAAFSPWNFPFSQAMHKIAAALASGCTLVLKGPEESPSAIVALAQLFHDAGLPPGCLNIVWGVPGDVSKQLIEAPQVRKISFTGSVPVGKQLAALAASLMKRMTMELGGHAPVLVCADADVERAAAMLAAYKFRNAGQVCVSPTRFFVQRAAFDRFVCAYLDAVGTIRVGYGLDAGVTMGPLAHARRVDEIDAFVADATAKGAQIATGGMRLPGPGHYFAPTVVLGPTRDTRLMNDEPFGPIVGIVPFDDLDDALAEANRLPFGLASYAFTTSARNAHRISRALEAGMVNINHFGMGPAEIPFGGVKDSGFGSEGGMEAFDGYLVTKFVTQMN

SEQ ID NO: 8212 - protein, 251 aa, Enterococcus faecalis
MRKPIIAGNWKMNKTLSEAQSFAEAVKNAVPSNDVVDAVIGSPALFLAPLAWNLKDSEVKLAAQNCYWENAGAFTGENSPAAIADLGVDYVIIGHSERREYFHETDEDINKKAKAIFANGMTPIFCCGETLETYEAGKTAEWIEGQITKGLVGLSNEQVASMVIAYEPIWAIGTGKSADANIADEICGVVRSTVEKLYGKEVSEAVRIQYGGSVKPENIAEYMAKENVDGALVGGASLEADSFLALLDAVK

SEQ ID NO: 8213 - protein, 364 aa, uncultured marine group II euryarchaeote DeepAnt-JyKC7
MFDMAGDDAVQFGLGEPDFQPPDIAIEAFSKAMKDGHNKYTTTAGLPALRLKIAEGWQHLVPSLDASSVCMTMSGTNALLDIFLALVDPADEVLLPEPYFPLYPTDVVICGGEPILYPCLFERGFVPTVEDLESRVTDKTVAILYNFPSNPTGGNVTTEERDELVDFARRHDLWVITDEVYDRIVYDTEHVSFIGAGYDKVIMINSFSKTFAMTGWRIGYILSENAEAMEQIAKMQYYVTACSNDAMQYAVLEALNEASDYPEHMRDEFQARRDLICDRLNAMPGVSCHIPTGAFYVFPKVEAAGLNSEEIALALLEGGVLCSPGSAFGAAGEGHLRFAYTIGREGISRGMDRVEKVLAELRGE

SEQ ID NO: 8214 - protein, 394 aa, Aquifex aeolicus VF5
MRKGLASRVSHLKPSPTLTITAKAKELRAKGVDVIGFGAGEPDFDTPDFIKEACIRALREGKTKYAPSAGIPELREAIAEKLLKENKVEYKPSEIVVSAGAKMVLFLIFMAILDEGDEVLLPSPYWVTYPEQIRFFGGVPVEVPLKKEKGFQLSLEDVKEKVTERTKAIVINSPNNPTGAVYEEEELKKIAEFCVERGIFIISDECYEYFVYGDAKFVSPASFSDEVKNITFTVNAFSKSYSMTGWRIGYVACPEEYAKVIASLNSQSVSNVTTFAQYGALEALKNPKSKDFVNEMRNAFERRRDTAVEELSKIPGMDVVKPEGAFYIFPDFSAYAEKLGGDVKLSEFLLEKAKVAVVPGSAFGAPGFLRLSYALSEERLVEGIRRIKKALEEI

SEQ ID NO: 8215 - protein, 424 aa, Campylobacter coli RM2228
MTNKKAFKIACSLIAGGVNSPVRAFANVQSEPRFISHGKGAHIFDIEGNSYIDYVQSWGPLLFGHCDKDILKACNEALKKGSSFGAPTLLETQLAELVLEDFPHLDKIRFVSSGTEATMSAIRLARGFTKKDKILKFEGCYHGHSDSLLVSAGSGAATFNSPSSLGVLADVAKHTLVATYNDIESVKELFEKNKDIACVIIEPIAGNMGLVPGKQDFLEELVKICKENDTLLIFDEVMSGYRASYLGSYGINHIQADIVTFGKVIGGGLPAAAFAARAEIMDILSPLGGVYQAGTLSGNPLAMAAGIASLSKAKKKKDLYTKLGKLAKRLTKGMKELANERGVALQTCYVGSMFGYFFTQDPVYNYKDALKSDLKLFSKFHQNMLKNGIYLAPSQFETGFICAKMNKELIDKTLQSTYESFKKL

SEQ ID NO: 8216 - protein, 247 aa, Geobacter metallireducens GS-15
MKKLVLLRHGESVWNRENRFTGWTDVGLSEKGIEEAISAGRTLKEEGFVFDVAYTSVLKRAIKTLWLVLEEMDLMWIPEYRHWRLNERHYGALQGLNKAETAERHGMEQVMIWRRSYDIPPPPLTPDDQRFPGSDPRYASLLPEELPLTESLKDTVARFLPYWHETIAPAVKEGKRVLVTAHGNSLRALVKYLDLVSDSEIVNLNIPTGIPLVYELTDNMTPIRSYYLGDPDDVARASRMVADQIKK

SEQ ID NO: 8217 - protein, 240 aa, Polaromonas sp. JS666
MSQKPTSHPYKPNMTQDELKALVGQAALPYVEPGSIVGVGTGSTVNKFIDALATMKDRIAGAVSSSVASTERLQAIGIKVFDATEVDELAVYIDGADEIDHAGYMIKGGGAALTREKIVAAQSRKFVCIADESKLVQTLGSFPLPVEVIPMAARRIARQFAALGGTATLRSKGGAESGEPLVTDNGQHILDVTGLKITDPLGFESQVNQWPGVVTVGVFAFQKAHVCLLGASDGVRTLVF

SEQ ID NO: 8218 - protein, 515 aa, Coccidioides immitis RS
MHAPMQPNYRGYPQPVHHRQPTTPRRGVPVPGMMPMQVAQHNMPNPQVLAAQQRHVPVHPDAAIRRSRKPTDKTLPDGIEEVVIGDAVQQYKRMQEVERRLDSAIMRKRIDLQDTVNRNTRRYRTMRLWISNTVEQQPWQQAEQNPEVPPRIGAGRYRVKIEGRLLDDATDPTVPDEDEEDIDMKHLGGEKDPDAMEEDSKPQKREEAKPSSPSIRKRLSHFFKTISVEFDKPSSPGVADLATIIWNKPTLPPSAAALPPTADFDSLEFSRAAEVNINGTITMTRDENLERFLLSKELASILDIEEETRAGIIIGLWEYIKTAGLQESEEKQAVACNERLRAIFGRDKIYFPAIPELIGPHCTPLPPIKIPFTIRVDKEFHSKPIPAIYDIRVAVDDPLRNKMLQVTTSPDFPNMLRQVSSLDDQLALVVQALHHSKAKHSFYTNLSQDPVNFIKRWILSQRRDLETILGESTRAGRPDPNAPEFRRGGLNSAWDTPVAREAARYMLARPPHMGR

SEQ ID NO: 8219 - protein, 128 aa, Glycine max
MSWAGPDEILLSTSLAGFLDKKLIVLLRDGRKLLGTLCSFDQFANVVLQGACERVIVGELYCDVPLGLYVIRGENVVLIGELDREKDELPSHMTCVSEAEIRTAEKAEKEARDLKGTMRKRMEFLDFD

SEQ ID NO: 8220 - protein, 153 aa, Glycine max
ISCPDDTTANRAGAGMVVPFTDLKSMVGFHTRKTSHDITCIASNGRRVQCMQVWPPVDKKKVETLSYLPDLDDAQLAKEVQYLLRKGWIPCLEFESQHGFPYREHNRSPRYYDGRYWTMWKLPMFDCTDACQVLKELQEAKTPYPIDLIRIIG

SEQ ID NO: 8221 - protein, 159 aa, Staphylococcus epidermidis ATCC 12228
MKHMHRGTHEVERTFLMIKPDAVQRNLIGEIISRIEKKGLKLVGGKFMQVPMELAEKHYSEHEGKPFYDKLISFITSAPVFAMVVEGENAVAVSRKIIGSTNPSEAAPGTIRGDYGLNLGRNIIHGSDSTESAQREVKLWFTSSEIADYKEPREDWLYE

SEQ ID NO: 8222 - protein, 216 aa, Legionella pneumophila str. Paris
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVVPMARSFVARQIVKLGGDPEYREGFVTDNGNIILDVFNLNFSTPMALEDSLNVIPGVVENGVFAKRLADKVLVASASGVNNLK

SEQ ID NO: 8223 - protein, 493 aa, Pseudomonas syringae pv. phaseolicola 1448A
MNKPLDPASMPAIPESAVSQWPDVDSLYRRFDELVKQPIRPIKREAMSKVMGYFDERCQGSKRLSEAAKKVIPGGVQHNLAFNYPFPLAFAQAKGAHLTDVDGNRYTDFLQAGGPTLLGSNHPAIRKQVNRILDECGPVTGLLHEYEVKLAELVCEVMPGVDMLRLLGSGTEAVMAAVRLARAYTRKKWVIKIGGAYHGWSDQLVYGMRLPGTGRMEAVGIPRGATANTQESPPNNLDALRRRLQINRLRGGTAAIMVEPFGPESGTRPVHADFNRQLRALCNEFGALLIFDEVVTGFRAGLGGAQAYFNVMPDITVLGKCLTGGYPMAGAIGGRRDVMQLLAGGIGTSSRRAFVGGTLSANPLSCVAGYYALLEARRLNAPALAGRAGDRMRAGLDEIINRRGLPYVAYNMGSIVHLQTSGVLLLDTSNPLKLLRARNEAKTRKHMMEEMGAAYTAHGLITLAGSRIYTSLADTDDVIDDALDRFDAVFQLV

SEQ ID NO: 8224 - protein, 448 aa, Methanococcus maripaludis
MNMNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 8225 - protein, 304 aa, Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGITPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPRGMEEGIDAALSAAAAKEGVTWSDYQKDLKKAGRWHVETY

SEQ ID NO: 8226 - protein, 452 aa, Nocardia farcinica IFM 10152
MTLVKPRRVSGGEHEHGHLEEFRTDPIALMRRVRQECGDVGAFELAGKQVILLSGAEANEFFFRSGDEDLDQGAAYPFMKPIFGEGVVFDASPERRKEMLHNSALRAEQMRGHATTIAAEVDRMIAGWDDEGEIDLLDFFAELTIYTSSACLIGVKFRNELDDRFARLYHELERGTDALAYVDPYAPIESFRRRDEARAALVALVQAIMDERAANPPADKSDRDLLDVLVSVPNEDGGPRFSASEITGIFISMMFAGHHTTSGTAAWTVIELLRHPELRDRVVAELDELFADGKDVSFHALRQIPLLEATLKETLRMHPPLIILMRVAQGDFEVCGHHIAAGDHVAATPAISNRLPEDFPDPDTFDPGRYIDPNQEDLVNRWTWIPFGAGRHRCVGAAFALMQLKAIFSILLRDWEFEMAQPSESYRNDHSKMVVQLQQPCRVRYRRRVRTS

SEQ ID NO: 8227 - protein, 368 aa, Arabidopsis thaliana
MSAILAAAIGGAVGALALIALFVFLLWFCVFRRKNLSRTSETGSSDPSTQEARRFEMEELAQATKSFTNKSLIGIGKFGEVYKGLLQDGVLVAIKKRPGLPTQEFVNEVRYLSSIHHRNLVTLLGFCQESNTQFLVYEYVPNGSVSSHLYGAGGKVPGNRLEFRHRLAISIGAAKGLAHLHSLSPRLIHKDFKTANVLVDENFIAKVADAGVRNFLGREDVGTSSHIVADQIFLSPEVQEFKRFSEKSDVYAFGVFLLELVSGREASEPSPSSSTQTLVDWMQNLTDYADIPMMIDERLGGTYTAEGVEELITLTLRCVDVSSEKRPTMSFVVTELERILDKENQSENLRRKKKKTDQLFCVKCIKNS

SEQ ID NO: 8228 - protein, 473 aa, Hydrogenophilus thermoluteolus
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEADASNDAHLDQELLGRRFHRVDEAIAVSAVWSGYHLGVKAIVALTQSGATALWMSRIASILPIYALTPDPVTFGHLTLFRQVTPVRFDLNPASDPAMLLTQIRTLLVSNGWAAPGETIAVTFGEPMGQPGGSNTLKIVTL

SEQ ID NO: 8229 - protein, 351 aa, Rhodopirellula baltica SH 1
MVQANSRARTSLFLSLWLNLMTHDVYAVGNALVDIQTMVADDLLSELKLDKGIMTLVDDEKQATVLSRFDLPSLSRCAGGSAANTIAAVADFGGKAAFVGKIGDDETGQFFLKDLRALGVTIDVDPQPGTPSGTCAVLITEDAQRTMLTNLAASTALSEADIDEAVIAASKYVYIEGYLFTGEQTKAAAYKAIELAKKNDVKVAFTASDPFLVNMMKDEMWDLIRGPVDLFFCNEEEAKSLTGLEDPIACANKIHESAENVAMTLGPNGSILMHGGEAIPVEGVKVKAIDTTGAGDMYAGGILYGITNGLDWRQSGHLASHAAARVVAQMGARLQKPFTEDEVKQLTDLTV

SEQ ID NO: 8230 - protein, 265 aa, Aquifex aeolicus VF5
MAINLQTLFKKKREGKKITMVSTYDYWSAKLCDEVGIDCILVGDSLGTVVKGEGDTLSVTLEEIIYHTKCVMRGVKNAFVIADMPFMSYQVSMEKAVENCGRVIKETKAKAVKLEGGEEIAELVYKLTRIGIPVVGHVGFTPQHINVFGKPKVVGKKKEEEEKLRRDFRALEEAGAFMIVLESVPTHLAKELWKGSNSIVIGIGAGKYVDGQVLVFHDIVGLFEDFKPKFVRRYLEGAKLVKEALKNFKIDVEGGNFPSEEESYG

SEQ ID NO: 8231 - protein, 222 aa, Rickettsiella grylli
MEIQNLERLKKKLAETTLAYISPGSILGLGSGSTINHLITALAAIRHKIEGVVPASLETEKRLKELHIPVLDLNSAGELMLYIDSADEVNPHLQLIKGGGGALTREKIIASASQNFMCIIDESKYVGMLGQKGLPLEVIPMARSYVAREIVKLGGFPFLRDKFITDNGNIILDTQHWDFTDPIKLERLLNNIPGVVSNGLFAQRPANKLLIANKNGIKIIES

SEQ ID NO: 8232 - protein, 356 aa, Bacillus thuringiensis serovar konkukian str. 97-27
MVIKVTIDRVCTIGPASNNKETLAQLINNGMKIVRLNLSHGTHESHKDIIRLVKSLDDSIKILGDVQGPKIRLGEIKGEQITLQAGDSFLLHTQPVTGSSTEASVDYEGIANDVKVGSRILMNDGEVELIVEKVSTDKIETKVKTGGNISSHKGVNLPGAIVSLPAITEKDKKDIQFLLEEGVDFIACSFVRKPSHIKEIRDFIQQYRETSPNLIAKIETMEAIENFQDICKEADGIMIARGDLGVELPFQFIPLLQKMMIQECNRTNTYVITATQMLQSMVDHSIPTRAEVTDVFQAVLDGTNAVMLSAESASGEHPVESVSTLRLVSEFAEHVKQDGPFVMKDVLELLHKSLGE

SEQ ID NO: 8233 - protein, 840 aa, Pyrococcus horikoshii OT3
MILGRSEPQKEEIKLRVAEALKRDVGRGIVRFDRRYQKMIGVEPGDIVEIEGERVTAAIVANSHPDDKGLDIIRMDGYIRKNAGVSIGDYVTIRRAQVKEAKKVVLAPAQKGVIVQIPGDIIKNNLLGRPVVKGDIVVASGRGDLYYSSGTPFDEIFRGFFEAMSVGFGELKFMVVNTIPKGIVQITYNTEVEVLPQAVEVREEKIPEVTYEDIGGLKEAIQKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKGRGKVIVIGATNRPDALDPALRRPGRFDREIEVGVPDKQGRKEILQIHTRGMPIEPDFEKDAVIKVLKDLEKDERFEKEKIEKIIEKVSKANSEDEIKEILKEDGNVYVEVRNRLIDKLLEELAEVTHGFVGADLAALAREAAMVVLRRLINEGKINPEAESIPREVLEELKVTKRDFYEALKMVEPSALREVLIEVPNVHWDDIGGLEEVKQELREAVEWPLKYPKAFKKLGITPPKGVLLYGPPGTGKTLLAKAVATESEANFIAVRGPEVLSKWVGESEKRIREIFRKARQAAPAIIFIDEIDAIAPARGTSEGEKVTDRIINQLLTEMDGLVENSGVVVIAATNRPDILDPALLRPGRFDRLILVPAPDEEARFEIFKVHTRSMPLADDVDLRELARRTEGYTGADIAAVCREAALNALRRVVKSVPKEKLEEESEEFLNKLVVTRKDFEEALKKVKPSVSKYMMEYYRQFEEARKRVSGESVGREPDYFTG

SEQ ID NO: 8234 - protein, 424 aa, Dehalococcoides sp. BAV1
METEIYFKFILSFGLILLVARLGGAIAERFLKQPAVIGELLAGIIISPFLLGQFLFANDPVIMNFALIDGVFSQNGEHLSGFAPMEIISQIAVVVLLFVAGLETNVTSFIKNSFTGAMVAIGGVVVPFALGVFSAMYFFPDLHMAGWLFIGAILTATSIGITVRILMDMGKLSSREGTIILVAAVVDDIIGLVILSVVISMAQSGSVNALSAVTTGVIGFAVWLGILLLGVYGHKYISKYILTPFKSSGTMPVMALIVGLIVSYLVTLVDLHPVVGAYVAGLMFASTMEKEEILHQTRPIMLFIAPFFFAYLGMQVDLREVWAVIVPALVIVVLAIIGKIVGCYFPARFVGKTSHNGAMIVGVGMVPRGEVGLIVAGAGLIAGAITRDLFGIAVAVSILTTLVMPVMIKPFFKPKAEANAKRLP

SEQ ID NO: 8235 - protein, 253 aa, Methanothermobacter thermautotrophicus str. Delta H
MMEMRITFLGGGRVVRIILGGLQRAGKLPREVMVCDPDEDSLRSLEDEFGVKTSADCSSMEGDVIFLALHPPVLKDVLNKMESPSPESLIVSLAPRIRIEEIQQALDHPKVARVIPNALSLVNRGYNPFSAADELTGTDLEILQSLFEPLGKFPEVSEDKLEAYAVITAMGPTYLWFQLAELEKLAVEFGMSPDEAATAVHSMASGAVEALYSHPNRDMVMDLIAVKPLEDAEDDIRAIYRKSLMRIYQSLTE

SEQ ID NO: 8236 - protein, 676 aa, Rhodococcus sp. RHA1
MQIRRRSVLAGAALTPTFATLGSGTAPANPDPDSEFLIGVGISDATGPVADVGMMGYSSFEQRAEGLHQRTRARAFVFAEPGRQRVVYVCVDVCMIFQSVHDAVLARLAELHGGLYTERNVMLTAVHSHAACGGASHDYAYNLAVLGHNRQVFDAEVCGIVEAITAAHDSLAPGSVSYGRSELTDASVNRSRIAFGRNPSEDRDYYPLGIDTSMRVLRITQGGRDVGAINWFPTHGASLTNTNHLISGDNKGAAAYFWEHDHEGVRYLDDDKPRFVAAFPQTNTGDMSPNLDLRPGHGPTDDEFENTRIIGRRQVAAARTAWESASDILTGGVDSRIMYLDMANQEVGGEFTPDGRTYRTSPACVGAAMSAGSTEDGPAIPIFPEGTTNPLVDALGGMDAPIPQWLQDAQAPKLVLVAVGLLPPDGWVPHVLKIQIIRIGGVYVVGGPAEFTIVSGLRIRRTVADRLGVPLENVIFQGYANSYASYCTTPQEYDAQQYEGGSTLFGRYTLPAYQQGFAALADAMRTGRDVPRGPAPRDLSQFQPYAGPGVDHDEPPAGRVFGDVLTEPAAKVSAGEQVTVEFVTGHPRNDPRRRGTFLEIQRRGGDGWVRHADDGDWSTKYRWTRTGSNRSVAQITWDVPAGTPAGRYRVQHFGNSRDAAGAITSFTGTSNEFEVG

SEQ ID NO: 8237 - protein, 76 aa, Brassica napus
  misc_feature (57)..(57): Xaa can be any naturally occurring amino acid
  unsure (1)..(76): unsure at all Xaa locations
YAFTYHWRLWSIPEIKDCLEEAGFKWVHVWMREMPNTQSGGNAKEYNANRDVKYEEXQHFNQGDAWNAYVVGVANV

SEQ ID NO: 8238 - protein, 310 aa, Gibberella zeae PH-1
MASSNTPEAQDTSYVEMDDKNEATLIGKHCEYDYCNQLDFLPFFCQSCRKTFCLDHRTETAHVCANPGAWAERKRLKELSQPSIGQGRVLRDKVSQKPCSSPECKTTIGTSLIPGVHCQTCNRDYCLKHRLKEDHDCSNLVPIGARPAQFDVGQKTRSAFDKLRAWGTAKKEQAGRALPKPKPTSASARIVAVNNLKKTAKGDAKTPIEKRVYIYVEAEAETAKAKFPKGEFFYNKDWVVGRVLDAAARSLQVQNINNQSSDEKDKLRVFHVEGGRVLEYNEKVGTALQSGNTVVLLRGVGPATPDLIEA

SEQ ID NO: 8239 - protein, 581 aa, Burkholderia thailandensis E264
MPHDVSLIALLAAGFGLAMILGYFASLLKMPPLVGYLLAGIVIGPGTPGFVGDLALAQQLAEIGVMLLMFGVGLHFSLGDLLAVRKIALPGAIVQIAVATALGAGLALLWGWSVGAALVFGLALSVASTVVLLRALEGRGLIESVNGRIAVGWLVVEDLVMVLVLVLLPPLAGLLGGEPALGGAGSHAGDALGSLWGALGVTLLKVAAFIALMLVVGKRVFPRILWLVARTGSRELFTLCMIAAAVGVAFGAAKLFDVSFALGAFFAGMMMRESEFSRRAADETLPLRDAFSVLFFISVGMLFDPRVLIDEPLHVIEVAAIVVIGKTLAAVALVLAFRYPLNTALTVGAGLAQIGEFSFILASLGRGLGLLSAEGQSLILAVALLSIALNTLLFAAIDPALAWVRKHSAFARRLESRNDPLAALPMSTPQAHLTGQVVIVGYGRVGTRIAHALDARGIAYVVVEQNRETVEKLRADGVAAVSGDAIEPIVLVQAHVARAGMVVVTLPDVFDVRQIVEIARTLNPGIEVALCTNSDDEAALLASEGMGDVFVSETELARGMTEHVLARMGADERRARRAGAH

SEQ ID NO: 8240 - protein, 333 aa, Alcaligenes faecalis
MKPRIVTTHRIHPDTLALLETAAEVISNQSDSTMSREEVLLRTNDADGMMVFMPDSIDADFLSACPNLKVIGAALKGYDNFDVEACTRHGIWFTIVPDLLTSPTAELTIGLLLSITRNMLQGDNYIRSRQFNGWTPRFYGTGLTGKTAGIIGTGAVGRAVAKRLAAFDMQIQYTDPQPLPQESERAWNASRTSLDQLLATSDFIIPMLPMSSDTHHTINARALDRMKPGAYLVNACRGSIVDERAVVHALRTGHLGGYAADVFEMEEWARPDRPHSIPDELLDPALPTFFTPHLGSAVKSVRMEIEREAALSILEALQGRIPRGAVNHVGAGR

SEQ ID NO: 8241 - protein, 485 aa, Pseudomonas syringae pv. syringae B728a
MLKNQLKDPSLLVDRAYVDGQWISADDGATLTISNPATGEALAQVPALQGVETRRAIEAADRAWPAWRARPAAERAALLERWHQAMLDNVEDLALIMTFEQGKPLNESRGEIRYGASFVKWFAEEARRSYGETIPAPSADRRLMTLKQPVGVCAAITPWNFPNAMITRKCAPALAAGCPIIVKPSDLTPLSALALALLAERVGIPAGVFNVITGMPTGIGEELTGNPVVRKISFTGSTPVGRLLMRQSAEHIKRLSLELGGNAPFIVFDDADLEQAVTGIMLSKFRNAGQTCVCANRILVQNGIYDRFAARLVEEVSKLKVGNGLEEGVTIGPLINPAAVSKVARHIDDALSQGAKLLHGGSPDGTSQFVQPTVLGDTHAGMLLANEETFGPVAPLMRFTDEAEALALANATPYGLGAYYFTQDLRRSWRFGEALEFGMVGLNTGIISMEVAPFGGVKQSGLGREGSSYGLDEYLEVKAFHVGGL

SEQ ID NO: 8242 - protein, 425 aa, Sulfolobus solfataricus P2
MSKENIFDALKSGKIDYVRVEFVDILGNTKGRSLRRAEFENVINDNKGVDYPESLALMDYKDRPIKSRYEDIIAIPDLNTFVAIPYLERTARVLSFLAQPDGLPYPYCSRSILNKAIEKLKEAGYTLQVSFEPTFYLLNSALNPADYSKAFSLEGLLEQQNFLKLLIKYLEEIDIKVETINKHYGPGQYEVKLSQKPVLEAADSLISSREVIRDTAKMNNVIATFMPKPFKDYPSSSMDITLSLQTVDGKDIMYDPNDSKGIGLSKIAYNFISGILEHLPSILSIAAPTVNSYKRFKEVVTPNMPGIGSERHYIVRLPSYYKDTHQVEFRLADPLANPYILLASMIYAGLDGIERNLMANVNEYYGTLPQTLKESLSRLENDTYMKYNLGQDLISIYINIKNIEIEEYESQITEWERDYYLKAGW

SEQ ID NO: 8243 - protein, 389 aa, Synechococcus sp. WH 8102
MRVSVATAGGTSSSLFTVVASGIQAGSGPSVIRTYRVAMSGLNDLYKRLAASGARILSVSPAGEESPAAPVAASSAPAPQAVTSAPAPKKKSHANVPVNTYKPKTPFLGTVTENYSLVADGGIGRVQHITFDLSGGDPQLEYIEGQSIGIVPEGEDANGKPHKLRLYSIASTRHGDNYQDNTVSLCVRQLEYKNEAGEQIYGVCSTYLCDIEPGSKVKITGPVGKEMLLPDDEDANIIMLATGTGIAPMRTYIRRMFEPREREANGWNFRGKAWLFMGAPKTGNLLYDEDLLHYEKEFPDNFRYTKAISREQQNAKGGRMYIQDRVLEHAEEIFAMIENPKTHVYMCGLRGMEPGIDEAMTAAAAAKGLDWSELRPQLKKADRWHVETY

SEQ ID NO: 8244 - protein, 697 aa, Magnaporthe grisea 70-15
MITAQLREALQEAVVMCSERCLYQSAKWAAELLSAIPPDTNDAEPEGDQSRFISPGFARNPDPAEAALEAAEFNKYLLAKSFFDCKEFDRCAAVFLPDSLLAGLVPMTRAEDNIPSANASKDQAKPPPTQTLRPQDLPELSQKSLFLALYAKVISGEKRKDEDAEMVMGPHDLGTIVNKQLLPVSNYLEQWFNRRSNEDGYTPGSQGWLEYLYGMVLAKSKSEAEAMEWFIRSVHLFPMNWGCWLEMTSLISRVADLNAISPQLPQNIVSFMFHLHTSLELYQQGPQLAHSLEELLKLFPTSSFLLTCRALLEYHNKDLTLAEQHFSTLLALHPHRLDSLDHYSNILYVLNYRPKLAFLAHLCSSVDKFRPESCVVVGNYYSLLSMHEKAVQYFRRALTLDRSCLSAWTLMGHEYVELKNTHAAIESYRRAVDVNRRDYRAWYGLGQTYEVLEMHTYALWYYKKAAGLRPWDGKMWMAVGSCLQKMGRERDGIKALKRALLADSSYETGSGSGLGTAGASGSFTAGGLDRTGALHMDPEVLLQIANMYDNLGELDEARMYMELCVSQEDGGEEDDMAGLGNSISIHRDASVGGSDDDEPRPDGSKMNTTPIVAGGGGTGVTPATSKARMWLARHALEYEDYAEAHRLATELCQDGVEVEEAKALIREARAQMDLAQAQGDGAGSGGALSRTPQQARG

SEQ ID NO: 8245 - protein, 311 aa, Nostoc sp. PCC 7120
MKNEKWNAENIPPQKGRLAIVTGSSSGIGYETARVLANKQASVIIAVRNLDKGNKALAKILQQNKDADVKLMELDLANLASVKNFAENFRKNYLRLDLLINNAGVMIPPYSKTTDGFELQFGTNHLGHFALTGQLLEFLISTEGSRIVNVSSGAHNMGKIDFDDLNWEQRSYAKWKAYGDSKLANLYFTYELDRKLKDNGIDTLVTASHPGWTATELQRTAGGIVKYLNGIVAQDITMGALPTLRAAIEAGLKGAEYFGPNGFMEMRGYPIKVESNELSKDQALAKKLWVVSEKLTDVKFEFNKKAQSAGK

SEQ ID NO: 8246 - protein, 335 aa, Propionibacterium acnes KPA171202
MTVKVGINGFGRIGRNFFRALAEQGADLEVVAVNDLTDTKTLAHLLKYDSIMGRFSGEVSYDDDSITVDGKTIKVLAERNPADLPWKELGAEIVVESTGLFTDGEKAKAHFEAGAKKVIISAPGKNVDGTFVMGVNDGDYDNAKHNIISNASCTTNCLAPLAKVLNDAFGIERGIMTTVHAYTGDQRLQDAPHKDLRRARAAALNMIPTKTGAAQAVALVLPELKGKFDGLAVRVPTPTGSLTDLTFQTSKETTVEEVQAAVKKAAEGPLKGILAYTEDPIVSKDIEGDPHSSIFDATETKVIGNLVKVLSWYDNEWGYSNRLVDLTKLVASKLA

SEQ ID NO: 8247 - protein, 259 aa, Propionibacterium acnes KPA171202
MSRTPIMAGNWKMNLDHVAATSLVQDLGEALKAAGYDSSKSEAVVIPPFTDIRPVAIIIDGDKLPIAYGAQDISAHDDGAYTGEVSGAMLSKLGCRYVVVGHSERREYHNESDELVNAKAKKVIENGMTPIICCGEALEVRKAGKHVEHTVGQIKADLDGIPAEQVAKLVIAYEPIWAIGTGETATADDAQEVCQAIREAVKELYDAPTAEAVRIQYGGSVKPANVAEIMAKPDVDGALVGGASLKAGDFSKIVTFYEA

SEQ ID NO: 8248 - protein, 639 aa, Haloquadratum walsbyi
MSSVDTQLEELKSEIMAELPSDISVSDVTYEGPELVVYTRDPKRFAKNGDLVRDLAGKLRKRITIRPDPEELASPARAQDQIHDVIPDEAGVTDLDFHHDTGEVVIEAEKPGIVIGRGGETLREITQQVGWTPEVVRTPPIESSTVSNVRNFLKQERDERRDILERVGRQIHREELSDDEWVRISTLGCCREVGRASFVLSTPETRILIDCGDKPGSDDVPYLQAPEALGSGASSVDAVVLTHAHLDHSALLPLLFKYGYDGPIYTTEPTRDLMGLLQLDYLDVAAKEGRTPPYDSSMVRETIKHTIPLEYGDVTDIAPDVKLTFHNAGHILGSAVTHFHIGDGLYNVAFSGDIHYEDTRLFNGAVNDFPRVETLVLESTYGGRDDYQTDQEDSERELIEVINETYDRDGKVVIPAFAVGRSQEIMLVLEEAMRTGEIPQMPVHLDGMIWEATAIHTTYPEYLRDNLRDRIFHDDENPFLAEEFNHIDAGEEERQAVSDGEPCIVLSTSGMITGGPIMSWLQHIGTDPDSRLVFVGYQAQGTLGRRIQDGWDEIPINGDQLGRSETLTLEMDVTTVSGFSGHADRQGLENFVKTMNPRPEKILCVHGDEQSVQDLSSGLYHDYNLRTFAPKNLETFRFL

SEQ ID NO: 8249 - protein, 754 aa, Bacteroides fragilis NCTC 9343
MSQLPTLIADLALILICAGIMTLLFKKLKQPLVLGYVVAGFLASPHMPYTPSVMDVANIKTWADIGVIFLLFALGLEFSFKKIVKVGGTAVIAACTIIFCMILLGIAVGMGFGWQRMDSLFLGGMIAMSSTTIIYKAFDDLGLRKKQFTGLVLSILILEDILAIVLMVMLSTMAVSNNFEGTEMLGSIGKLLFFLILWFVVGIYAIPEFLKRCRKLMSEETLLIVSLALCFGMVAIAANTGFSAAFGAFIMGSILAETIEAESIDRLVKPVKDLFGAIFFVSVGMMVDPAMIIEYAVPIIVITLAVILGQAFFGTMGVMLAGQPLKTAMQCGFSLTQIGEFAFIIASLGLSLHVTSDFLYPIVVAVSVITTFLTPYMIRVAEPASNFVDRKLPESWRRFLMRYTTGTRTVNHESLWRKLLFALARILVVYSIVSISVITLSFRFVVPLLREHLPGIWGPLAGAVFTILCISPFLRAIMVKKNHSVEFITLWNDNRVNRGPLVSTVVFRVAVSVLFVMFVITRLFKASVGLMFGVALLLVILMILSRQLKKQSILIERKFFQNLRSRDMRAEYLGEKKPAYAGRLLSRDLHLTDFEIPGESAWAGKTLLELNLGKKYGVHVVSILRGKRRINIPGGSIRLFPMDKIQVIGTDDQLNTFAEEMSHVAVIDSGVFEKSEMTLKQLLIDTDSAFLGKTLRESGIRDKYHCLIAGVERGGEALMTPDVNVPFEEGDVVWVVGENEDVYRLIGQNCDRKR

SEQ ID NO: 8250 - protein, 359 aa, Hydrogenophilus thermoluteolus
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 8251 - protein, 512 aa, Clostridium perfringens str. 13
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKDFIVELENAMKEIGVGEIATISGRYYAMDRDNRWERVELAYNAMALGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 8252 - protein, 439 aa, Arabidopsis thaliana
MASDADMEDYGFEYSDEEQEEQDVDIENQYYNSKGMVETEPEEALSGFAEVVQMEPEKADWGFKALKQTVKIYYRLGKYKEMMEAYTEMLTYIKSAVTRNYSEKCINNIMDFVSGSASQNTGLLQEFYQTTLKALEEAKNERLWFKTNLKLCNIWFDIGEYRRMTKILKELHKSCQKEDGTDDQKKGSQLLEVYAIEIQIYTETKDNKKLKQLYHKALAIKSAIPHPRIMGIIRECGGKMHMAERQWEEAATDFFEAFKNYDEAGNQRRIQCLKYLVLANMLMESEVNPFDGQEAKPYKNDPEILAMTNLIAAYQRNEIIEFERILKSNRRTIMDDPFIRNYMEDLLKKVRTQVLLKLIKPYTKIGIPFISKELNVPETDVTELLVSLILDSRIDGHIDEMNRYLLRGDSGNGRKLHKAVDKWNSQLKSLSSNITSRVC

SEQ ID NO: 8253 - protein, 134 aa, Nocardioides sp. JS614
MRTWRFREPSAAITSLARRQADVRPWGDWLVLDEGPGFKVKRLHVHPHARLSLQQHHFRAEAWIVVAGIATCQVGTRSWLASPGETAHVPRCSAHRLANQHDEELLVIEVQWGAETREDDIVRLADDYGRAGVA

SEQ ID NO: 8254 - protein, 263 aa, Trichodesmium erythraeum IMS101
MAVTTKQLIQWKQKGRPIVALTAYDYTIAQLLDNAGVDLILVGDSLGMVTLGYETTLPVTLEEMIHHAKAVRRAVKQALMVVDLPFLTYQESPQQAIHSAGRILKETGAQAVKLESGNEAIAQTVKKLTSIGIPVMGHIGLIPQSVHQFGGYPQQGNAPDASARILTEALALAEAGAFALVLEHIKADLAKEITEKVSIPTIGIGAGAYCDGQILVINDVLGLSHWQPPFAKPYVNLRETITQAVKEYSLEVKKRKFPQPPSP

SEQ ID NO: 8255 - protein, 284 aa, Rhodopirellula baltica SH 1
MRPVSKYGQNFLIDLNLVELIARSAEIGPSDIVLEIGTGVGSLTSIMASQAGAILTVEIDQNLFQLASEELAPFPHVKMIQGDALKNKSTFRDDIMESIREAKSRLPDDSKFMLVANLPYNVATPIVSNLLHQDPPPDRIVVTIQKELGERMVAGPGSKDYGALSIWIQATCRAEIVRILPPTVFWPRPKVDSAIVRLDVDHERGNAIPDLKYFHQTVRALFFHRRKFLRSVVISAMKGRLDKPAIDEILGRLGHGETARAEELNLEQISDLVEALRQAELANE

SEQ ID NO: 8256 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 8257 - protein, 508 aa, Burkholderia vietnamiensis G4
MGELASIGNARIADSDLHEPGRGGAAAAVVPVILAGGAGTRLWPMSREQHPKQLTQLVGDESLLESTLRRVRGLSATFELAAAQVVCGDAHRHITVRQLAASELRAQVIVEPARRDTAPAMTLAAELARVRHGDAVLAVMPADHAIADTAAFERAMETALRYAQLGCLATLGVRPTHADSGFGYLRTGMPVALDGAAGAFALDAFVEKPAPEIAAHYVASGSHWWNSGIYVVRASVWLRAIAALAPEIHHACVAAIRDGAAAADCFHPAAQPFAACPSNSIDYAVMERLSSLAEPPAAVAVPLDAGWSDLGSWDAVWAALDKDANGNAGRGRVMFEDAAACYAHSEGRLVACVGVSNVAVVETPDAVLVVNREQVQGVKSLVARIKAERGAEADTHRLVRRPWGCYDSVDRGERFQVKRIVVDPGARLSLQMHHHRAEHWTVVKGTAAVTRGDEQFLLGENESMYIPMGVRHRLENPGRLPLEIIEVQTGSYLGEDDIVRFDDAYGRV

SEQ ID NO: 8258 - protein, 367 aa, Pseudomonas fluorescens Pf-5
MSVSLKPVSSMRAAVWHGRHDIRVEDVPLPDAPPAGWVQIRVDWCGICGSDLHEYVAGPVFIPVDAPHPLTGIKGQCILGHEFCGEIVALGEGVQGFSVGQPVAADACQHCGTCYYCTHGLYNICENLAFTGLMNNGAFAELVNVPANLLYALPANFPAEAGALIEPLAVGMHAVKKAGSLLGQNVVVVGAGTIGLCTIMCAKAAGAAQVIALEMSGARKAKALEVGATHVLDPKECDALAEVKRLTGGLGADVSFECIGNKHTAKLAIDLIRKAGKCVLVGIFEEPSEFNFFELVATEKTVLGALAYNGEFADVIAFIADGRLDISPLVTGRIQLEEIVGQGFEELVNNKEHNVKIIVSPGQLRRS

SEQ ID NO: 8259 - protein, 473 aa, Bacillus cereus ATCC 10987
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFSKLSKSGVPIYALIVSTIVGCLSLLSGIYAEDTVYLWLLSIAGFGAILVWASIALSNLLARRAYIKQGGDVKDLKFKTPLYPFVPLLALVLNVTVIVAMAFIPEQRMALYCGIPFMIVCLLFYRATRNKGSNLEHIEKTKTTEIESL

SEQ ID NO: 8260 - protein, 392 aa, Cytophaga hutchinsonii ATCC 33406
MESSEPLVLDVGNLKRGEIIINMGPQHPSTHGVLRLEILTDGEIVKDVIPHMGYLHRCYEKHAEKLPYNQVIPFVDRMDYLAAMNSEHAYAMGVERMLGIENDIPKRVEYIRVLVAELNRISSHFVAIGTYGLDIGAFTPFLWVMRDREHINRLLEWVSGARMLYNYIWVGGLFYDLPVGFEERCKDFISYLKPKLAELQKVIIDNKIFIERTANIGVLPLDLAINYGITGPMLRASGLKFDLRKVDAYSVYPEIDFDIPVGTGAVGTTGDCWDRTHVRVAECFESVKIIEQCLEKLLGEHKRTREFDPQAIVPKKIRPKVMDFYVRAENPKGELGFFFRTTGNTDIPFRCKVRAPSFVNLSVLQAISKNVMIADLVAILGSFDIVMGEIDR

SEQ ID NO: 8261 - protein, 328 aa, Magnaporthe grisea 70-15
MGKAEFGTTKHLSNQMKAKGLQRLRFYCTPCQRQMRDDNAFKQHCMSESHVRNMLIVGEDPKKYIREYSEAFLKDFVNLLKTGHRDKQVQINHFYQEYIANKEHVHMNSTQWSSLTEFAKYLGKEGICRVEENEKGIHISWIDDSPEALKRQEALKRKEAQDRGDEEREQRLLKEQIKRAQKDAAARAAGENGASTEQDQEDKGLRREEGEKIKLSIGVKPAASKPEPAPVEQPAAATLDEETPATGEAKLAEATTDSKPVSLKFGAKPAAKNVFASKKNAFSSGAKKVKIEQPKKISEAERIMREEMGRKRSREFSGSGGPSKRQRM

SEQ ID NO: 8262 - protein, 293 aa, Rhodococcus sp. RHA1
MSPRVPSIVLNSGTIIPQLGLGVWQADNDETEHAVGFALDEAGYRHIDTAAAYGNEEGVGRGIANSGVAREDIFLTTKLWNADQGYEPALKAFDASLGRLGVDYVDLYLIHWPLQDDDRILRTWDALEKIAESGRAKAIGVCNFEPRHLQLLIDRGGVVPAVDQVELHPHLAQQEIRTFAVEHGIAVESWSPLGGTSNSGWGDDSKPNTLLTDPIITRIGDRHSKSPAQVLIRWHLQSGLIVIPKSVHESRIRENIDVFDFELSEQDLSEIETMDDGVRVGAHPDELNIDAPE

SEQ ID NO: 8263 - protein, 422 aa, Chlamydia trachomatis D/UW-3/CX
MSHLFSKACQYFPGGVNSPVRACRAVNITPPIVARASKEVFVDSLDKTFIDFCGSWGSLIHGHSHPKICTAIRQGLERGSSYGLTSEQEILFAEEIFSYLGLETNYKIRFMSTGSEATMTAVRLARGITGRPIIIKFLGCYHGHADTFLQEKPFSHTSLETLDLAHPLTLSLPFNDFPLFQTVMNSLGHKVAGVIFEPVCANMGVILPVPGFIEGVIQTCQQTGSFSIMDEVVTGFRVAQGGAAALYHVKPDILVFGKILGGGLPASAVVTPKDIMDHLAPEGKIFQAGTLSGNPLAMIAGKVSVNLCREQGFYTQLATIEQNFLSPIEHMIRTTGIPVTLVRYGSLFSFFFNPNRPNNLADAQLSDIEAFQKFYQSAFSKGVYLSPSPFEASFLSAAHSMESLDYAQTALIESLEQVFSLV

SEQ ID NO: 8264 - protein, 333 aa, Gibberella zeae PH-1
MSSTTKAPELELSQFLKTVLPQDDRSSLRESVIPQLLDAVSAIGDELRRSYDVSIVGTENAFGDEQLNVDVLAENIIRDRCAKSPAIKTASSEEDPVEKPAREGETVQPISDDEQYTIGFDPLDGSSIIGPNWSVGSIIGIWDGVTAIEQPTEKQIASILGVFGPRTLAIVALRVPSSDPVCFEVSLNNSHMFTVARPELRFAEPPFKTRYFAPANLRAAAENDKYMSLVTKFINDKYTLRYSGGLIPDVYHALVKGHGVYVSPVTSVSKAKLRKYYELLPVALVIECAGGQAIDPATGSRIFDITLKGCDDRAGLVCGTSEEVEVVKKALLD

SEQ ID NO: 8265 - protein, 386 aa, Alkaliphilus metalliredigenes QYMF
MPSLSKTILNLEESGIREIMNLALGMEDVIRLEIGEPQFDTPEHIIEATSQAARDGFTKYTANLGLLSLRETISNHVNNRFNLETSWENVAVSVGGVGAVSSLIRVLADAGDELLIPSIAWPNYKMAIDCIDATPVFYKLDPNNDFLPSIENLESLVTPKTKVLVINSPSNPLGVVIPQKLIKELVEFAKKHDLFLISDEVYEEIIFEGDHISTLPYDTDGRVIGVFSFSKTYAMTGYRLGYAIGNKEIIKEVGKFQEVNVMNACGIAQKAAEAALKGSQDCIREMVAVYKDNMEAATRLMDEYEIPYQQPTGAFYLWVNIGCKDATVFAKDFLVQHKVAIAPGNTFGPEGSPYIRISLASKKEDILEGIHRLAVMLGKSKLAVNA

SEQ ID NO: 8266 - protein, 318 aa, Solibacter usitatus Ellin6076
MKIVVLDGYCLNPGDLSWDTLRGFGEVEIFDRTPADQVAARARGAAIALTNKTPFKADTLAGLPDLKYIGVLATGYNIVDVEAARRYGITVTNIPTYGTASVAQFVFALLLEMCHNVRLHADAVRAGEWSRNADWSFWKSPLVELAGKTMGVIGFGRIGRSVGRIADAMGMKVIANDTFQGNPPDYAEFRWATVEELLRESDVVSLHSPLFPETQGMINARSLGLMKPSAFLINTSRGPLVVDQDLADALNAGTIAGAALDVLSVEPPAESNPLLSARNCLVTPHIAWATREARARLMDLAMSNISGYLSGNPLNVIK

SEQ ID NO: 8267 - protein, 493 aa, Leptospira interrogans serovar Copenhageni str. Fiocruz L1-130
MFMVTELSYCQKMTQLKRSLNLFDSISLMFSSMVGPGIFITTGYILHQVPNPNIVLLAWILGGFLAVAGAMSYAKSASLFPYAGGDYVYLKEAYSPIVAFASGWLSLSINFSASISLSALAFSKSFFSLINPSWDIYFFEIPFLGLTISIGTAQILAMSAILVFTIVNFFGISTASRIQNLFTSVKILGLVSFVILGFVIGNYDISRFKSFSLFPSDLKGFELLFAGVIPVTYSYLGWNMITYVAEEVKDPDKNIYKAVLYSCALVTILYILMNFLFLSSGTLSELSGDKIGITASSALFGPKATVFITVFICWAFLASISAYIIGGSRIYFAMARDGFFFQNMAKLHSKHKSPYMSLLFQCGYACLFCFVKEIESLLYLITCSTLLLATITAYTPILFEKRNYKLKFRIPGYPYTTYLYIASNFGIIATLLWNKPTEAFWGVGFTFLSIPMYYYFKIMQNTLSKNSTPLETPEVLATSLLPENEPVPIASGE

SEQ ID NO: 8268 - protein, 142 aa, Propionibacterium acnes KPA171202
MLGLMSDEERTLVLLKPDAVKRRLMGEIIGRYEAKGLTVRAMELSTIDTKIARKHYAEHVGRDYYAALEEFITSGPLVAMVLEGRRAISVVRAMNGTTDCAEALPGTIRGDFGTEKNHNLVHASDCLESAEREIGLWFPHLV

SEQ ID NO: 8269 - protein, 390 aa, Thermoplasma volcanium GSS1
MNCRMKQSTIGRNIVDEISFGAIVKIRDQLLEMQRQGKKVYRLESGDPSFSLPPHVKEAIKQAIENNKTHYTDSTGIPELRKAIAEKLVRKNKIKDATPENVIVSNGGMNALYVTFRSLLSPGDEVIIPDPMWTEIAEIIKLAEGVPIRLPVENYIEEMQKYEDDDKVKAVFVNSPHNPTGLVFTPKQIDGIISFAESKGIFIVSDEAYEDVIFDGREHVSPGSKYDNTISLFSMSKTYAMSGLRIGYAHTNSEILYDRMKKLLRCTINGVNSATQYGAVAALTGPQEFVGQMRSEYQKRRDIIFNAVSKSRYLEPVKPGGTFYLWAKIKEYPKEVKDSWDMTYYLLDKTGVGSSPGPVFGPAGDGYIRFAFSADTEHVREASELIEKFE

SEQ ID NO: 8270 - protein, 484 aa, Legionella pneumophila str. Paris
MLIFELSKTGRQAKAQIPRAVSKNYSIPEEFQRKSPPRLPACSELQVVRHFTCLSQKNFSIDTNFYPLGSCTMKYNPRGVHKAASLPGFINRHPLAMDNESQGFLETLYKLQNYISEITGMPGVSLTPMAGSQGEFAGVAMIKAYHQSRGDTARDEILIPDAAHGTNPASAVMCGFKVVEIATAPDGDIDLDELKRKVGPRTAGIMLTNPSTLGLFMRQIKEIANLVHQAGGLLYYDGANLNAILGKVRPGDMGFDVMHLNLHKTFATPHGGGGPGAGPVAVGKRLIPYMPLPVVKKTDSGYHWATRQDYPQSIGRLSCFMGNAGILLRAYFYMLVLGKEGLLRVSEFATLNANYLLKELTKVGYTAAYPGRRASHEFILTLNSEKKNYDVTAMDFAKRLLDYGVHAPTTYFPLLVPECLLIEPPETESKEELDAFVAVMKTIREEAIKQPDILKAAPHTLPVKRLDDVKAARELDLNYFATHE

SEQ ID NO: 8271 - protein, 337 aa, Arabidopsis thaliana
MSYSGAGLGKPGSGKRRIRDLLTQSDNRVCADCGAPDPKWASANIGVFICLKCCGVHRSLGSHISKVLSVTLDEWSDEEVDSMIEIGGNASANSIYEAFIPEGSSKPGPDASHDQRMRFIRSKYEHQEFLKPSLRITSVRGSSTKTPAFLSSSLSKKIVDSFRTNSSSQQPQLEGMVEFIGLLKVTIKKGTNMAIRDMMSSDPYVVLTLGQQKAQSTVVKSNLNPVWNEELMLSVPHNYGSVKLQVFDYDTFSADDIMGEAEIDIQPLITSAMAFGDPEMFGDMQIGKWLKSHDNALIEDSIINIADGKVKQEVQIKLQNVESGELELEMEWLPLEQ

SEQ ID NO: 8272 - protein, 456 aa, Legionella pneumophila str. Paris
MPYIPHTPNDTKEMLTAVGAQDIQDLFDEIPASLQYAGFQSIPAGINEMEMLKEAQNQAQKNRNGICFIGAGCYEHHIPAAVWDIASRGEFLTAYTPYQAEASQGTLQLLYEYQTMICELTGMEVSNASMYDGATALAEAVLMAVRLNKHSKTNRVLITGTVHPFYRETIETIVRNQHIEVITLPFDEQQGITDFGSLNQYTGEDITALVIAQPNFFGCLEQVDKMTSWAHHNKTISVACVNPTSLALLKPPCSWGEHGVEIVCGEGQPLGSPMASGGPYFGFLSTRMAHVRQMPGRIIGRTVDKDGKTGFSLTLQAREQHIRRAKATSNICTNQGLLVTAATIYMSLLGPEGLSQVATQCHQNTHELITALTQIEGVELAFKAPFFHEALIKLNQPVQSVLQQLADAGIAGGYAPEQHYPQLANTLLVCATEVRSAEDIAKYAKTLKTIMSKRGA

SEQ ID NO: 8273 - protein, 559 aa, Glycine max
APPPNKDKFKFFYKATLLQQVNDLLESISNEITSAQLVVEELETAIRPIENELNELQVKIRNMEHVEQISIQVQQLKKKLAWSWVYHVDEQLEQQNVKIEKLKNRIPTCQAKIDQQLHLVEKLEEIWSKKKEEIKSMFAKTSQVNQMKENLNQSVSMAKKEAFELERDCKCKTSNIQKMVNQLEKLKKQVQDIHDQHVKNSQAEESNMEEKLKGLKDEVHAAESKLKRLQEEEALLLDNIHRQKDEIRKIADKIDDHEKSYKDLMCQIRGLQQNQSNKITVFGGNKVLDLLRIIENYHQRFKMPPIGPIGAHLKLLHGNKWALAVEHAIGRLLNSFIVTDHADCRLLKQCAKEAHFGHLQIIVYDFSIPRLTIPQHMLPDTEHPSILSVLQCENQTVINVLVDHGNVERQVLVKDYEVGKVVVFDRRIRNLKEAYTEDGCRMFCRGPVQNFLQPNMRRRTGRLCGSFEDEIKKLHAEASDVKNEANGCKNIKKKKKKEFLQPRVLRPPPPGNPLFFFLGGISPPRKKEEFFFWGKYFPPPPPKKKKKKPPAGKKKKKQK

SEQ ID NO: 8274 - protein, 541 aa, Campylobacter lari RM2100
MDAFITLFLTAVAVAVVLNVILKKFGIPTIIGYIATGLFVREFYGFSTNEIIIHVAEFGIVFLMFTIGLEFSFKHLLAMKKEVFLNGSLQMLTCGLVCTLLVTYILGIASHIAMIAGFALALSSTAIVLKILNDSGDINEEYGRKALGILLFQDIAVIPLLLMIDIFSSQNADISKLLFTTLVSAVILLVLLYFIGKYLFTYVLKFIIKTNANEIFIATILFTVIGASFLAHSFGFSYSLGAFIAGALIAETKYKHKIEADLVPFRDLLLGFFFISVGLQIDFHIVFENWFLIFVFVSLVLLIKFVVIYGLLILYTRKRVALKTALSISQIGEFALAVFSLMQVNSLIDEKTAQIFIIVSIITMVATPFILNNLRKIANAAEGEQSDMAKFYLCDQKMKDHFIIFGYTRLGQEVVQKIKKTGIPYLVLESDLNLVELGRSRNENVFFANVAQVETLKVANIEECSVAIITISNEAKLDMLYQVLSNFNKPIQTVLKTSGMGAKIIFPHTDKHLHIVDAEASIARNLVQEALQCRINTSAAE

SEQ ID NO: 8275 - protein, 1029 aa, Arabidopsis thaliana
MKLDEEFLHDRDHSFLTDDEENQAALACSDDEHDGDDDGRRGGENSDSSSPLSRDRSDNNLSDVSNPPWPQSYRQSMDLLTGMTPPSVSFMPQSSSRRLASSFQKKQQSSFCDSLSSSSSKPLLSQPVPDKEETILPVNPQSQLKLSVTDLPLPEPNLCSFSQSVLNGTNVLCGLGLITMPYAIKESGWLGLPILLFFGVITCYTGVLMKRCLESSPGIQTYPDIGQAAFGITGRFIISILLYVELYAACVEYIIMMSDNLSGLFPNVSLSIASGISLDSPQIFAILTTLLVLPTVWLKDLSLLSYLSVGGVLASILLGICLFWVGAVDGIGFHATGRVFDLSNLPVTIGIFGFGYSGHSVFPNIYSSMKDPSRFPLVLVICFSFCTVLYIAVAVCGYTMFGEAVESQFTLNMPKHFFPSKVAVWTAVITPMTKYALTITPIVMSLEELIPTAKMRSRGVSILFRTMLVTSTLVVALSVPFFAIVAALIGSFLAMLVALIFPCLCYLSILKGKLSNTQIGLCIFIIVFGVTLGVYKWLNLYCPHRPNSHGKSIDETKPQTQFFARNTNLSIQNIVIMFSRFHALFLLLVLSVRTYKCVSSSSSSSSSFSFSSFSSSSSSQTLVLPLKTRITPTDHRPTDKLHFHHNVTLTVTLTVGTPPQNISMVIDTGSELSWLRCNRSSNPNPVNNFDPTRSSSYSPIPCSSPTCRTRTRDFLIPASCDSDKLCHATLSYADASSSEGNLAAEIFHFGNSTNDSNLIFGCMGSVSGSDPEEDTKTTGLLGMNRGSLSFISQMGFPKFSYCISGTDDFPGFLLLGDSNFTWLTPLNYTPLIRISTPLPYFDRVAYTVQLTGIKVNGKLLPIPKSVLVPDHTGAGQTMVDSGTQFTFLLGPVYTALRSHFLNRTNGILTVYEDPDFVFQGTMDLCYRISPVRIRSGILHRLPTVSLVFEGAEIAVSGQPLLYRVPHLTVGNDSVYCFTFGNSDLMGMEAYVIGHHHQQNMWIEFDLQRSRIGLAPVECDVSGQRLGIGS

SEQ ID NO: 8276 - protein, 314 aa, Aspergillus nidulans FGSC A4
MASSSDLTLAFIGCGNMGSAILSGILDASKVVSSPFSRILACTKTQSSAEKLDARFRDHGSPLTASFFADKNTAAAEEADVIILGCKPYLVDAMLAEEELADALAGKLVISIIAGKTIDVLSEGISQNQTENSPSKKAVIVRAIPNVAASVRESMTVIELPTPSPSNDQKDLITWIFSQIGQTSFLSSDLFDCGTMLMASIATVSVAVDGILDGCVAEGMKRADASEMTAQCLLGLAKLLREGYHPAVLRESISSPRGCTIQGLLAVERGGVRTGTVQEPRARHKMLDLGIGKTRGFTVRGGRIKKRGAVIDPS

SEQ ID NO: 8277 - protein, 242 aa, Chlamydia trachomatis D/UW-3/CX
MSKQPENSFSSDKFFPIKQKLALEAVALVEPGMCVGLGSGSTAREFILALGDRVRTERLVITAVASSRISQLLAEAVGIPLSDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 8278 - protein, 177 aa, Oryza sativa
MAAAGVSGLAVGCLVAATAALLVAGASAQTGCTAALINLYPCLNYISGNETSPTRTCCSQLATVVQSQPQCLCAAISGDSSSSIGGVTIDKTRALELPKACNVVTPPASRCNSAGGNTPGAATTTSPATQTPGATGAGTGVGSKTTPTAPYLINGGASLRGATGLVLALAAVAVYAV

SEQ ID NO: 8279 - protein, 461 aa, Burkholderia thailandensis E264
MTSRDERLHRGLEERHINLMALGATIGVGLFLGSATAIRAAGPAILLTYMLGGIAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGLAGVVDALPIVMFAYLGVEMLGLTAGEARNPEKSLAKAVNSVFWRVVIFYVGALFVIMSIYPWSQIGTQGSPFVMTFSRLGIPAAAGIINFVVLTAALSSCNSGIFSTARMLFNLAEQGQAPERLASVNRRGVPVHGVLISVALLFVGVALNYYAPQKVFVWLTSVSTFGAIWTWCVILIAQLRFRRRVSAERLARLPLRVPLYPMSSFVALAFLAFVVVLMAFSPDTRVALVIGPLWIAALTVYYHLSQAGRRAPLGAPTDG

SEQ ID NO: 8280 - protein, 155 aa, Triticum aestivum
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 8281 - protein, 372 aa, Pseudomonas sp.
MIKSRAAVAFAPNQPLQIVEVDVAPPKAGEVLVRVVATGVCHTDAYTLSGADSEGVFPCILGHEGGGIVEAVGEGVTSLAVGDHVIPLYTAECRECKFFKSGKTNLCQKVRATQGKGLMPDGTSRFSYNGQPIYHYMGCSTFSEYTVLPEISLAKIPKNAPLEKVCLLGCGVTTGIGAVLNTAKVEEGATVAIFGLGGIGLAAIIGAKMAKASRIIAIDINPSKFDVARELGATDFVNPNDHAKPIQDVIVEMTDGGVDYSFECIGNVRLMRAALECCHKGWGESVIIGVAPAGAEINTRPFHLVTGRVWRGSAFGGVKGRTELPSYVEKAQQGEIPLDTFITHTMGLDDINTAFDLMDEGKSIRSVVQLSR

SEQ ID NO: 8282 - protein, 261 aa, Thermobifida fusca YX
MATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIRAAVQG

SEQ ID NO: 8283 - protein, 367 aa, Polaromonas sp. JS666
MTTVISPVEDIVADMRAGRMVILIDEEDRENEGDLVLAADHVSAEAINFMARFGRGLICLTLTRERCELLQLPPMATRNGTKHSTAFTVSIEAAEGVTTGISAADRARTVQAAVAKDAKVSDLVQPGHIFPLQAVDGGVLMRAGHTEAGCDLASMAGCSPAAVICEIMKDDGTMARLPDLLLFAAEHGLKIGTIADLIEHRSRNESLIEKIGSRTLQTAFGEFTVHAFKDKPSQGLHLALVRGQWSADDTVAARVHEPLSVLDALEVQRSMHSWSLDQSLNHIAREGKGVAVLLNCGESAAQLLAQFEGTARASQAPERGRMDLRTYGVGAQILRECGVHKMNLLGNPRRMPSMTGYGLEIVGYITQ

SEQ ID NO: 8284 - protein, 337 aa, Cochliobolus lunatus
MVVKVGINGFGRIGRIVFRNAIEHNDVEIVAVNDPFIEPHYAAYMLKYDSTHGQFKGDIKVDGNNLTVNGKTVRFHMEKDPANIPWSETGAYYVVESTGVFTTTEKAKAHLKGGAKKVVISAPSADAPMFVMGVNHETYKSDIEVLSNSSCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGPLSGILGYTEDDIVTTDLNGDNRSSIFDAKAGISLNKNFVKLVSWYDNEWGYSRRVLDLLVYIAKIDGNA

SEQ ID NO: 8285 - protein, 139 aa, Wolbachia endosymbiont of Drosophila melanogaster
MAIERTLSILKPDAVKNNITGNINSYIEQSGLKITAQKMMLLTKKQAELFYEIHKDRPFFGELVEFMTSGSVVVQVLVGENAVSKYRQIMGATDPKQADKGTIRGDFADDISENRVHGSDSLENARKEIAFFFAECELV

SEQ ID NO: 8286 - protein, 318 aa, Pichia stipitis
MPSIKLNSGYDMPAVGFGCWKVDVDTCSEQIYRAIKTGYRLFDGAEDYANEKLVGAGVKKAIDEGIVKREDLFLTSKLWNNYHHPDNVEKALNRTLSDLQVDYVDLFLIHFPVTFKFVPLEEKYPPGFYCGKGDNFDYEDVPILETWKALEKLVKAGKIRSIGVSNFPGALLLDLLRGATIKPSVLQVEHHPYLQQPRLIEFAQSRGIAVTAYSSFGPQSFVELNQGRALNTSPLFENETIKAIAAKHGKSPAQVLLRWSSQRGIAIIPKSNTVPRLLENKDVNSFDLDEQDFADIAKLDINLRFNDPWDWDKIPIFV

SEQ ID NO: 8287 - protein, 398 aa, Polaromonas sp. JS666
MKIAQRAQRIEPFYVMEVAKAASALAQEFAGSGKPMIFLNIGEPDFTAPPLVQEAAARAIAQGTTQYTQATGLPALRERISGWYASRFGVQVAPSRIIVTAGASAALQLACLALIEAGDEILMPDPSYPCNRHFVSAAEGNAVLIPTTAEERFQLTREKVQAAWNDKTRGVLLASPSNPTGTSIAPEELQRIHEFVHGQGGVTLIDEIYLGLSYEEHFGHSALAMPGELGQSVISINSFSKYFNMTGWRLGWLVVPEALAPVVERIAQNLFICASTVAQYAALACFEPDSLQEYERRRAEFKARRDYFIPELNRLGLRVPVMPDGAFYAYADCTETAARLGVSGSWDLAFELMKRAHLAVTPGRDFGQAAPEKFVRFSTANSMEQLREAVARLRTLLA

SEQ ID NO: 8288 - protein, 746 aa, Mesorhizobium sp. BNC1
MATARSARTAGSELVVAETLATRRPTKTRKDISSLSADSVPSTFPSRTETLLERERITTASAASAPARFAASTRLVTRSRRLFSSRGILAPGQNSEKTALRRYGNNLEEMREWARLGHGLPFMVAEGVAQWRLRIPPSADKKKRIARMEAALDTYYQPLLLLGAAVIAAPLFKRLGLGTVLGYLAAGIAMGPVARLISDGEDLLPIAELGVVFLLFLIGLDLNPSRLWAMRRQIFGLGAAQVVVTGAVLALAALVFFGLSPAAAVVIGFGLALSSTAFGVQIMESEGTLNRPYGRTAISILLLQDLAIAPLLALIPLLSPGGEGAEDITFSGFALALACVAALILAGRYLLNPLFRLIGSTGAREAMIAAALLVVLGSATLLQVAGLSMGLGAFIAGVLLADSSYRHELTADIEPFRGILLGLFFMAIGLSLDLDVVLENWLLVLGLVPAFMLAKAVLLYGICRLFGCQHNQAVHVASLLPQGGEFGFVLFTAASAALIFSPETASLLIAIVTLSMAMTPAVVRMGALLMLPEEREEIDETFDGAGSEILMIGFSRFGQVASQILLAGGVDVTIIDHSATRVRSVEKFGFRIYFGDGRRKEVLEAAGINKAKVVAVCTNVRATTDAIVNMIRSEFPHVKLYVRSYDREHTLSLKARGVDYEIRETFESALVFGQRSLTELGTSEEVALEIVEDVRRRDEERLAIQAVEGIQAGGDRMHVRPVTPEPLTKPAREARRLDPAVKENSG

SEQ ID NO: 8289 - protein, 419 aa, Methanopyrus kandleri AV19
MGRIIRIPVHGFVELQGAEERVLDSPEVQRLRRVRQLGLAELVYPGATHTRLEHSLGVKYLCDRVMEIHWEELKRNVPDVGKFSRSYIEEVLGLAGLLHDVGHPPFSHVPEPLLEEELGVDHEDIGRAVAKVVLERADAMDVEVTLEVAFGPGDGWTGVLHSVIAGNLGVDRLDYLMRDSLHASVEYGRIELDRLLHTLELGDPVVVHEKGLEAAESVLISRYHMYRAVYFHKTCRAGDAMLLWAMHVAAEDGDLDLRIFDPDRLSRSEDALSAFQSMDDSALLRALEENPESREFVEVLKNRRLYKCVAEYQAAVEPRHGELFKVAVETSEEHLGESFGVLLDSSKVVPYDPSSDEVIVRTRNGDVPLSEVSDIVATLKERTLSEIPTVRVYVRPETRDDESRVRRIVEHVKSALPPA

SEQ ID NO: 8290 - protein, 328 aa, Petunia inflata
MAVNGVSSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 8291 - protein, 523 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 8292 - protein, 127 aa, Zea mays
TTGRLSFCSFSFPSASGRRRFAAVRASAETMATEKLGIKVERNPPESRLSELGVRQWPKWGCEKSKFPWTYSAKETCYLLQGKVKVYPEGHGEEFVEIGAGDLVVFPKGMSCTWDVAEAVDKHYNFE

SEQ ID NO: 8293 - protein, 494 aa, Bradyrhizobium sp. BTAi1
MSSGFIEAHGLWSDEQKAAAGEALAAVKETGLRCIRVSVADPQGKLRSKTLMPGPFHAALKNGIEFTNAQYGFDSAEGIAYNPFVDGGGFGMAEMAGFANVILVPDPTTFRVLPWSPGTGWVLGDLYFRDGRPVPFDARHKLKAALAELAREKYTFITGLEIEFYVTKVIDPKLAPEDMGTLGLPPTPPVVEAAARGFSYQVEDNLDRMDDFICTLADHCVALNLPLRTMENEMGPGQLEFTFDVQTGLKTADTMSLFRSMVKQVATRMGLHATFMTRPGLPNYVASGWHLHQSLATADGRNAFVSEPGSGELLSEVGRRFVGGLLEHAAAASVFTTPTVNGYRRRKPNSLAPDRATWGYDNRAAMIRVQGMPGEPSAHIENRIGEPGANPYLYIASQALAGLDGLRRKLDPGPLETSPYTATHRPLLPTNLMEALEALKGSSYFRAQLGDVFVDWLLGMKQSEVNRFLAAEPDWQATPDDVTAWEHREYFTRY

SEQ ID NO: 8294 - protein, 121 aa, Zea mays
  misc_feature (20)..(20): Xaa can be any naturally occurring amino acid
  unsure (1)..(121): unsure at all Xaa locations
FPPPVPGFLFFSGGHSEVEXTQTLNPLTQGPNPWPVSFFYGGGLQNPCLKTWGGHPAKVKAAQDAFFLRPKANSLGQLGKYPSPGEAPEAKEGIFVKNSSFYFFARPSPGIPPPPPKKRVA

SEQ ID NO: 8295 - protein, 295 aa, Nocardioides sp. JS614
MTSGRAMSPEETAPYGTGPARAESAPDAPAPIKRIRTHHLREMKQRGEKFAMLTAYEQYAAQTFDEAGIEVLLVGDSASNNVFANETSLPVTVDELIPLARAVSRSVRRALVVADLPFGSYQASPEQAYLTAVRFMKEANAHAVKLEGGIEMAPQVRKLTEGGIPVMAHIGFTPQSEHNLGGYRVQGRGEAAARVVAEAVAMEQAGAFAVVMEMVPGDVAAEVTKSVSIPTIGIGAGLDCDGQVLVWQDAFGLRTGRMPRFVKQYADLHGVLLQAARDYAADVKAGTFPGPEHTF

SEQ ID NO: 8296 - protein, 239 aa, Arabidopsis thaliana
  misc_feature (125)..(125): Xaa can be any naturally occurring amino acid
  misc_feature (147)..(147): Xaa can be any naturally occurring amino acid
  unsure (1)..(239): unsure at all Xaa locations
RTVVSIPNGPSALAVKEAAWGLARYAAISQDSGLVPIVEPEIMLDGEHGIDRTYDVAEKVWAEVFFYLAQNNVMFEGILLKPSMVTPGAEATDRATPEQVASYTLKLLRNRIPPAVPGIMASFLXYCKLLQLKKLCLRFMLNYLLYXFLSGGQSELEATLNLNAMNQAPNPWHVSFSYARALQNTCLKTWGGKEENVKAAQDILLARAKANSLAQLGKYTGEGESEEAKEGMFVKGYTY

SEQ ID NO: 8297 - protein, 455 aa, Nocardioides sp. JS614
MGSSPDSLCRMGKQEDFVLRALEERDVRFVRLWFTDVLGFLKSVAVAPAELDGAFSEGIGFDGSAIEGFARVYEADMLAMPDPSTFQILPWRGEGPSTARMFCDIMMPDGSSSYADPRHVLKRTLGKAADQGFTFYTHPEIEFYLFKDTPEAGADPEPVDRSGYFDHTATSSGADFRREAITMLESMGISVEFSHHEGGPGQQEIDLRYADALTTADNVMTFRTVIREVALGQGVWATFMPKPFTTHPGSGMHTHVSLFEGDRNAFFEAGAEYQLSKTGRQFIAGVLRHANEISVVTNQWVNSYKRLMFGGEAPSYICWGHNNRSAMIRVPMYKPNKGQSTRIELRTIDAACNPYLAFAVVLAAGMKGIAEGYDLPREAEDDVWALTERERQSLGIEPLPKSLSEAIAVAEHSELLAETLGEHVFDYFLRNKRAEWEEYRGQVSAFERDRMLPVL

SEQ ID NO: 8298 - protein, 300 aa, Streptococcus thermophilus LMG 18311
MHFYLISFKIILLQLEKENRMETYTLSNGVTIPKIGFGTWQIPEGEEAYNSVSFALKAGYTHIDTAQIYGNEVSVGKAISDSDVAREDLFLTTKLWNDKHDYDLAKASIDESLERLGVDYLDLFLIHWPNPKALRENDAWKAGNAGAWKAMEEAYKEGKVRAIGVSNFMQHHLEALFETAEIVPHVNQILLAPGCTQEDLVAYCRERDILLEAYSPLGTGSIFGNEDVEAVAERNGKSVAQVALRWSLQKGFLPLPKSVTPKNIEANLDIFDFDLSEEDMAVLDKIQGIKTQVDPDTVNF

SEQ ID NO: 8299 - protein, 422 aa, Aquifex aeolicus VF5
MEHHLHHIIQETAPYLVLLFMFIFGYTFQKVNIPSIIAFMIIGFLAQPLVPPEKIKDFEIFKHAGIILLFFFIGLEYSFERLRTMLGAWKTGSIDFVFNFIPPFIIAYAFGFDLITALILAAVFYPSSTSIIAKLLMDYKRIASPEAELLIGILIFEDLVAILLLTIIIPLKEAGSIEFTTIPVSLVKLGVAFLLFWLIYKYLIPKINAWLDRVSEEDIFIFFTLGLVLSIGTIFHSLGISEALGAFLLGVIVPETKVLENIEKQLSDLKELSMGLFFFFFAYETQLTKPENLGLLILLIVLGIILKIISTYLAGYVFGLKKKSRLRASLSFVPRGEFSVIMTSFEPALKSTSIPFIFLTAVIGSILFALAPKVADIIYPPKKKKKKKPIKRPKKGYLKRSRAFSEHAPSLQSSRPETPPQQ

SEQ ID NO: 8300 - protein, 526 aa, Dehalococcoides sp. BAV1
MKIPELHNYLAEFLSPAINPLKLEKGANKDYYLWLDWTEAAALYPKLAEDGFGLIGLFGVEGFRGYQGLSLLYIFEKRNYSGTLVIIRRADSPVSSIAAIFPSACYFEREIRDGYGCEFENAFDRRRLFLHETYPANFHPLANSFKNQPLSLPAGVEDEAFYPFKKISGEGVYEVGVGPVHAGIIEPGHFRFSAIGEPILNLEVRLFYTHRGLEKLAMGKDIDFGLKIAEGISGDESAANTYAYSSAVEHICSSRPPRRAEQLRLILLEMERLYSHLADLSGMLTDVGYPVGAASLSALREELMRWNKRLTGSRFLKGIIAPGGLLKDIPGELITELADYLYAFEGRFSEQVEKALAKTSVVDRFETTGIVNNRLLIPLNITGVTARASGEAIDTRLNQPYGFYPELSFKLPVLPEGDVMARFRVRLSEVQTSLGLILKTAAKLSAGEYAIPLKPVNGYSLILVESPRGQSLHWLWLRDGKIERYKVRTASYCNWQAIEHAVLGDIIPDFPLINKSLNLSYAGTDL

SEQ ID NO: 8301 - protein, 619 aa, Thermoplasma volcanium GSS1
MLSMVEVKIIKSDGFFNEVLISSDKKIHFDTAYAEGDFNCFGEGSIVSETTDDLKFKIANLIPGKYHFKIAIDQYKILREAENRSGSYSFSIWLEKPYHNPDYAQFCAIIDKKLMDVRIAVPKHSISVSIFTKDTLKPVYSRRASFDTFDAVEYVFDGMSDYYFEVDNSRLPKEGYFSPKVHIEHEGGSKIIYHIFPDRFFRVGPHLPTLSRWGDKPTFSSFFGGNLRGITEKIGYIKALNVDTIYLNPVYKSKSNHRYDVDDYFSIDGLLGGEQDFIELVNEAHENGIKIVADMVFNHTSTDFPYFLDALKNGKNSKYWNWYIFHGEGAAVFDGRAKGKTKPLYETFMGVGRMPKLNHKNAEVRKFCIDVMKYYKNKFGVDGFRYDVAHSIYPEFFLEAVKEFGNEMLHIGEAWCLPSMFMLSGYWNSFTNYYLRNAIIKFVREEINITEFYNMIQNMIISYGPLIQQNVMNILDSHDTERILRAFKGNKKKVKLAYSILFMFDGFATIYYGDEVGLDGGRDPDDRRCFPWDNMDEDMLQFLKKLGEIRRMYHTGSAGIITVEETQECKYITRLSGESIIKVAIAKKPVTLEGEIILSSCGEKTIYEGDFALSIAKYA

SEQ ID NO: 8302 - protein, 538 aa, Candida maltosa
MSVSFVHNVLEVVTPYVEYYQENLTKWYILIPTILLTLPFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMVPSTKNIAGREEFADAFNYSQTYNAYRFLLQQFYWILNGSKFNKSIKTVHKFADFYVQKALSLTDDDLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTISATHRDPSIYGEDANVFRPERWFEPETRKLGWAYVPFNGGPRICLGQQFALTEASYVTVRLLQEFHTLTQDANTRYPPRLQNSLTVSLCDGANIQMY

SEQ ID NO: 8303 - protein, 534 aa, Erythrobacter sp. NAP1
MTIGVLPMTKPKVLISDKMDPNAARIFEERGCEVDVITGETPEELKARIGEYHGLAIRSSTKVTAEILDAATNLKVIGRAGIGVDNVDIPYASGKGVVVMNTPFGNSITTAEHAIAMIMALARMIPAADARTQNGEWPKKDFMGIEVTGKTLGLIGAGNIGSIVASRALGLRMKVIAYDPFLTEDRAVEIGVEKVDLDNLLSRADFVSLHTPLTDETRNILSRERLENAKPGIRIVNCARGGLIDEVALKNCLESGQVAGAALDVFAEEPAKENPLFGAPNFICTPHLGASTTEAQVNVALQVAEQMSDYLVNGGVTNALNMPSLSAEEAPKLKPYMSLAEKLGSLVGQLAHGNLTKISIEREGAAAELNGKPITGAVLAGFMRRYSDTVNMVNAPYLAKERGLDVSEIRHQREGAFNTLIRVSVETDAGTRSVAGTLFGKDAPRLVEIFGIGIEADLDGNMLYVVNDDKPGFIGRIGTLLGSQGINIGTFNLGRRDAGGEAVLLLSLDDEPSADVMAEAEKVEGVKMVKALSF

SEQ ID NO: 8304 - protein, 905 aa, Saccharomyces cerevisiae
MNNQPQGTNSVPNSIGNIFSNIGTPSFNMAQIPQQLYQSLTPQQLQMIQQRHQQLLRSRLQQQQQQQQQTSPPPQTHQSPPPPPQQSQPIANQSATSTPPPPPAPHNLHPQIGQVPLAPAPINLPPQIAQLPLATQQQVLNKLRQQAIAKNNPQVVNAITVAQQQVQRQIEQQKGQQTAQTQLEQQRQLLVQQQQQQQLRNQIQRQQQQQFRHHVQIQQQQQKQQQQQQQHQQQQQQQQQQQQQQQQQQQQQQQQQQQQQQQQQQQQQGQIPQSQQVPQVRSMSGQPPTNVQPTIGQLPQLPKLNLPKYQTIQYDPPETKLPYPTYWSDKKADTDTLLYEQIIQRDKINKYSLIRETNGYDPFSIYGFSNKEYISRLWHTLKYYQDLKNTRMKSITSTSQKIPSASIWGNGYSGYGNGITNTTTRVIPQVEVGNRKHYLEDKLKVYKQAMNETSEQLVPIRLEFDQDRDRFFLRDTLLWNKNDKLIKIEDFVDDMLRDYRFEDATREQHIDTICQSIQEQIQEFQGNPYIELNQDRLGGDDLRIRIKLDIVVGQNQLIDQFEWDISNSDNCPEEFAESMCQELELPGEFVTAIAHSIREQVHMYHKSLALLGYNFDGSAIEDDDIRSRMLPTITLDDVYRPAAESKIFTPNLLQISAAELERLDKDKDRDTRRKRRQGRSNRRGMLALSGTSASNTSMNGVHNTVAAGNASSLPPGEILLPDIADIPRTFRTPVPSTLMPGGVDVGPSVESYELRNTTTYKSRPDRPKPVSPPCYIIDHIPGHSLLLSIKLPGKVNTKEEFAAAPNDTSSGTNAMLPSPESLKTKLNSNIRAGVTIPSIPNPIANHTVTNSPNPTLQPVIPGGAASKSVPTPSLPIAPPVAPHDSEATLLTNSNNGSSNNNTQNT

SEQ ID NO: 8305 - protein, 510 aa, Arabidopsis thaliana
MSNIDIEGILKELPNDGRIPKTKIVCTLGPASRTVSMIEKLLKAGMNVARFNFSHGSHEYHQETLDNLRSAMHNTGILAAVMLDTKGPEIRTGFLKDGNPIQLKEGQEITITTDYDIQGDESTISMSYKKLPLDVKPGNTILCADGSISLAVLSCDPESGTVRCRCENSAMLGERKNVNLPGVVVDLPTLTDKDIEDILGWGVPNSIDMIALSFVRKGSDLVNVRKVLGSHAKSIMLMSKVENQEGVINFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKARAKLIIVLTRGGSTANLVAKYRPAVPILSVVVPVMTTDSFDWSCSDESPARHSLIYRGLIPMLAEGSAKATDSEATEVIIEAALKSATQRGLCNRGDAIVALHRIGAASVIKICVVK

SEQ ID NO: 8306 - protein, 262 aa, Ehrlichia ruminantium str. Welgevonden
MNDNYMINPKKELSQCFIHSTDITDKIVNYAGNISNFSIIEIGPGLGTMTYSILKKNPKKLISIEKDSRLLPIHDKIIKKFQGKYEFILSDALDIDLRNIAKPPVKVIANLPYSIATLLLIKWINYINFFHSFTLMFQKEVADRIIAQPNNKNYGTLSILTQLFADVYKMQDFGPEIFSPKPKVFSSVINIVVLPQPRFDVNYDKLRKIVKITFNQRRKMIRSTLKQITNNTDEILHSLNIPNNLRPENLSIKQFCDIANCI

SEQ ID NO: 8307 - protein, 526 aa, Campylobacter lari RM2100
MKKIIVCDAILDKGVELLRKADDVELIEAAHLPKDELLTKLSDVDVAITRSSTDVDLKFINACSNLKALVRAGVGVDNVDIDECSKKGIIVMNVPTANTIAAVELTMNHLLCSARSFVNAHNFLKIQRRWEREKWYGVELMNKTLGVIGFGNIGSRVAVRAKAFGMKVIAYDPYVVASKMTDLGIECVNSLDVILTQSDFITIHTPKTKETTDMISFEEISKMKDGVRLINCARGGLYNEDALCEGLKSGKIAWLGIDVFNKEPATNHPFLEFENVSVTSHLGANTLESQENIAIQACEQALNAARGISYPNALNLPIKTEDLPSFVAPYIELISKMGFLAAQLDKTPIKAIKLESEGQISEYNESLLTFATVSVLRGILGENINYINAHFVAKDKGVELSSCILPSSGYSNKITIKVITDNSNLSISGTIFGENEQRIVELNGFDVDFKPKGKMIILNNNDIPGVIANVSGILAKNNVNIADFRLGRNGFGKALAVILLDAKISKALLEELRAIDACIFAEYAEI

SEQ ID NO: 8308 - protein, 306 aa, Mycobacterium leprae
MQRKSGCTLTIRLLERTEIRWLVKELECRPRKSLGQNFVHDANTVRRVVSTSRVNRSDFVLEVGPGFGSLTLALLDCGAAVSAIEIDPVLAGRLPQTVAEHSNNEIHRLTVCNRDVLSFRRGDLATEPTALVANLPYNVAVPALLHLLAEFPSIRTVTVMVQAEVAERLAAEPGGKDYGVPSVKLSFFGRVRRCGMVSPTVFWPIPRVYSGLVRVDRYATSPWPTDDAFRRQVFELVDIAFTQRRKTSRNAFVKWAGSSNESANRLLAASIDPARRGETLSIDDFVRLLRRSDGRDDAAVRSASAS

SEQ ID NO: 8309 - protein, 107 aa, Zea mays
MAWRASLSRSVKEIRVLFCQSSPASAPAREFVKKNYGDIKARNPSLPFLVRECSGVQPQLWARYGVPDVVAGDMGVERCVNLDGLTEAQIDKKLEELAMAGESLKTK

SEQ ID NO: 8310 - protein, 376 aa, Coccidioides immitis RS
MPSPCTAKTTLSIGIQRARGANRYTWKNPSFVLEAVKKVKFEDRPVPTIQHPHDVMINVKYTGVCGSDVHYWDHGAIGHLVLKEPMVLGHESSGIVISVGPGVRSLKPGDRVALEPGVPCRQCEACKGGKYNLCDDMRFAATPPYDGTLAKYYILPEDFCYKIPESMNLQEAALMEPLSVAVHITKQGGVKPGDQVVVFGAGPVGLLCCAVARAFGASKVIAVDVQQVRLHFARKYAATATFMPGSIPAAENAQRLKEQCGLGRGADVVLDASGAEPSAQTGIHALRPGGTYVQGGMGRAEFSVPIMVVCTREISVKGSFRYSSGDYKLALELVQTGKINVRDLITKVVRFTDAEQAIIEVKAGKGIKTLISGVED

SEQ ID NO: 8311 - protein, 332 aa, Oryza sativa
MSTTNHYQHIKSNKPVLGKARKLKDLMLKSDNRICADCGAPDPKWASANIGVFLCLKCGDVHRALGPDVSKVLSVTLDDWSDSDIDSMLEIGGNSYANSIYESFLPKDHPKPKMDSTMEYRTKFIRAKYETQDFLKPSLRITSKGSFDATNAVKSVTSSISSASGKHVADDTREFVGELNITVVRGIQLAVRDMLTSDPYVVLTLGEQKAQTTVKPSDLNPVWNEVLKISIPRNYGPLKLEVYDHDTFSADDIMGEAEIDLQPMITAVMAFGDPSRVGDMQIGRWFMTKDNALVKDSTVNVVSGKVKQEVHLKLQNVESGEMELELEWVPIP

SEQ ID NO: 8312 - protein, 483 aa, Nocardioides sp. JS614
MGGVPLRPRRRPRAGPHPGDLAGDPRERARIGTLTGVLDRHRLAELRTTEEERFVAARPRSAALAARARGPLLAGVPMPWMTRWPGRFPVFFESATGARLVDVDGHEYVDLCLGDTGAMTGHALPQVADALAARARSGITTMLPSADAVWVGEELARRFGLPTWQLAMSATDANRFVLRFARHLTGRPRIAVMDWCYHGTVDETLAVLDGDRVVPRPGALGPQVPVAETTAVVPFNDAEALERRLAVGDVACLLMEPALTNIGIVLPEPGYLEAVREITHRHGVLLVIDETHTLCTGPGGATAAWGLEPDLVVVGKPIGGGVPCAAYGMSAAVADRLSGPMLGHEIDVAGVGGTLTGNALALAAIRATLSTCLREEDFTVAIPLAERFTDGVAGVIAEHRLPWHVQRLGCRAEYWFCPPPRDGAAAAAAVDEELEGFLHLWCLNRGVLLTPFHNMALFSPAHTPADVDRHTEVFGEAVAALLA

SEQ ID NO: 8313 - protein, 338 aa, Enterococcus faecalis V583
MYKAIVAAKGKTTKIVEKESRPLKDNEARLKMEVCGVCHTDLHVKNADFGDVSGCTLGHEGIGIVTEVGKDVTSLKIGDRASVAWFYEGCGHCEYCTSGRETLCRSVKNAGYTVDGAMAEECIVTDGYAVKVPENLASEPASSITCAGVTTYKAIKESGIRPGQWLMISGLGGLGNLALQYAKHVFNAKVVAVDVNDNQLAFAKEMGADLLINPVKDPDFAAQLQKEIGGVHAAVVTAVAKSAFNGAVDAVRAGGTVVAVGLPVETMDLSIPRLVLDGIHVVGSLVGTRQDLREAFQFGAEGKVVPVCQTRQPEEINAIFEEMEQGKIRGRMVIDFRS

SEQ ID NO: 8314 - protein, 284 aa, Zea mays
  misc_feature (120)..(120): Xaa can be any naturally occurring amino acid
  unsure (1)..(284): unsure at all Xaa locations
MAEANICCLTQVLSVTLNQWTDDEINSMIEVGGNSYANAIYEAFLPEGYQKLHPDSSQEERADFIRSKYELQEFLKPSLRLASSNKGSLEATSSRKHMDNSVSLSASFSSEHPSLHIFFXAGMVEFIGILKVKVIRGTKLAVRDLMSSDPYVVLTLGQQKAKTSVSKRNLNPVWNEELKLSVPQQYGPLKLQVFDHDMLSKDDEMGDAEIDLQPMISAATAFGDPDLLADMQIGKWLRSPDNALARDSAVNVVGGKVKQEVSLRLQNVESGEVELELEWIPLNQ

SEQ ID NO: 8315 - protein, 480 aa, Geobacter sulfurreducens PCA
MDTLSRKTKIIATLGPVSSSPDMIRQLMDAGVDVFRLNFSHGSNDQRREVIAAIRRLSAERGKEIGILADLQGPKIRTGRMENGAIPLVRGDSLDITTDEVLGRPGLISTIYQSLPHDVKPGSRILLDDGLIELRVQSVSGATVRCTVVQGGMLKDLKGINLPGVKVSAPSLSEKDLRDLDFCLEVGVDYIALSFVRTAADVEGLKRILFERDVQVPVVAKIEKPEALRNFKSILKVADAVMVARGDLGVEISPEKVPLFQKKIIRACNEAGKPVITATQMLESMISHPRPTRAETSDVANAILDGTDAVMLSGETASGQFPLEAVRTMDKVALDVERFAQVEDGSGPRRHSVSIAEAVAEAACHAAVILKAKAVACMTQSGSTAARISRYRPPLPILAFTGSVDTMRRLSLYWGVKAYPIGTMAGTDEQIVAVESTLLSGGYRKGDVVVITMGVPVEARGSTNLMKVHKLGTGQFFEIF

SEQ ID NO: 8316 - protein, 609 aa, Saccharomyces cerevisiae
MKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 8317 - protein, 409 aa, Triticum aestivum
  misc_feature (182)..(182): Xaa can be any naturally occurring amino acid
  misc_feature (189)..(189): Xaa can be any naturally occurring amino acid
  misc_feature (205)..(205): Xaa can be any naturally occurring amino acid
  misc_feature (217)..(217): Xaa can be any naturally occurring amino acid
  misc_feature (235)..(235): Xaa can be any naturally occurring amino acid
  unsure (1)..(409): unsure at all Xaa locations
MNTSKLTSSVNITSPPGASCRIRHELKSSFLPKKAEWGVARQVAAPRVSMVVRAGAYDDELVKTAKTIASPGRGILAMDESNATCGKRLDSIGLENTEANRQAFRTLLVSVPGLGNHISGAILFEETLYQSTVDGKKIVDILVEQGVVPGIKVDKGLVPLTGSNDESWCQGLDGLASREAAXYYQQGAXRFAKWRTVVSIPNGPXSELAVKEAAWGXSPGYAAISQDNGLVPIVXEPEILLDGEHGIERTFEVAQKVWAETFYQMAQNNVMFEGILLKPSMVTPGAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 8318 - protein, 314 aa, Brassica napus
  misc_feature (222)..(222): Xaa can be any naturally occurring amino acid
  unsure (1)..(314): unsure at all Xaa locations
MGANSIPTDATIGLDEQISQLMQCKPLSEQQVRALCEKAKEILMDESNVQPVKSPVTICGDIHGQFHDLAELFRIGGMCPDTNYLFMGDYVDRGYYSVETVTLLVGLKVRYPQRITILRGNHESRQITQVYGFYDECLRKYGNANVWKIFTDLFDYFPLTALVESEIFCLHGGLSPSIETLDNIRNFDRVQEVPHEGPMCDLLWSDPDDRCGWGISPRAAAXRSRSRDISEQFNHSNSLKLIARAHQLVMDGFNWAHEQKVVTIFSAPNYCYRCGNMASILEVDDCRNHTFIQFEPAPRRGEPDLTRRTPDYFL

SEQ ID NO: 8319 - protein, 270 aa, Erythrobacter sp. NAP1
MKRLTVPRIRAKKKDGVTEEPLVMLTAYTARQAQLLDAHCDILLVGDSLGQVIYGLDSTIPVSLEMMANHGAAVVRGSYHSVVVVDMPFGSYEASKEQAFESAAFLLKQTGAAAVKLEGGEAMAETVEFLNSRGIPVMGHVGLTPQAVNVLGGYMARGRSDAEADKIVSDAVALDKAGAFAIVIEGVVEPIAIEATQAVACPTIGIGASAQCDGQVLVTEDMLGMFERVPRFVKKYEDIASVIEKTVASYAQEVRERSFPSEDQTYQPKA

SEQ ID NO: 8320 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATMMLDSMIKNPRPTDAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 8321 - protein, 676 aa, Oryza sativa
  misc_feature (561)..(561): Xaa can be any naturally occurring amino acid
  misc_feature (601)..(601): Xaa can be any naturally occurring amino acid
  misc_feature (608)..(608): Xaa can be any naturally occurring amino acid
  misc_feature (621)..(621): Xaa can be any naturally occurring amino acid
  misc_feature (626)..(626): Xaa can be any naturally occurring amino acid
  unsure (1)..(676): unsure at all Xaa locations
MATFARHRVLLCRLAAALLLAPVAAAQPWQFCGQGGNYSANGTYQSNLAGLSATLPKNASASRTLFAKDSLGAVPDIVYALALCRGDVANATACESCVATAFQDAQQLCPYDKDAFIVYDLCYLAFSNRNILAAAADDDGSPRFLMNTQNASAPAEVFDAAVATLLNATSSYAAENSSRRFATGEEAFDAAAATPTIYGLSQCTPDMSPDDCRSCLGRIIALIPRYLSRRKGGRAIGMRCNFRYEVGPFFAGGSMLRLPAPANSTPTAPTGGRKKNKSGTALAIALPLVVILLATVVICLSVQRWRKRSRSKQQSSYSIQMAEDIESTDSLFIDLSTLRAATGNFSESNRIGEGGFGSVYKGVLPSGEEIAVKRLSMSSGQGIEELKNELVLVAKLQQKNLVRLVGVCLQEHEKLLVYEYMPNRSIDTILFDLEKRKELDWGKRFRIINGIARALQYLHEDSQLRIIHRDLKASNVLLDSDYNPKISDFGLARLFEGDQTREVTSRVVGTYGYMAPEYAMRGHYSVKSDVFSFGILMIEIVTGRRSSGSYSFDQSYDLLSXVWEHWTMGTILEMMDPSLTSHAPRDQMLKCIHIGLLCVQXDNPADRXPMVSTVNIMLSSXTSVSXQSPSKPSFFIPKSGTDSNIYSESYPQTSQPTHRSGMMSVNDVSVTELEPR

SEQ ID NO: 8322 - protein, 576 aa, Photobacterium sp. SKA34
MVQPNQKQETLVWWKEATAYQIYPRSFYDSNADGIGDIPGIITKLDYLADLGVDLVWICPFYQSPNDDNGYDISDYQAIHPDFGCLDDVDRLIREAHKRGIKIIIDLVINHTSDEHPWFIESRQNRNSAKRDWYIWRDGSEATTEKPTNEPNNWESIFHGSAWQYDAETAQYYLHLFSSKQPDLNWENPEVKAALFSMIHWWLERGIDGFRVDAISHIKKQANLPSLPNPNGDNYVSSFKYHMNVKEIEEHLHELRDKAFSPFDIVTVGEANGVAAEEALTWVAEETATNKAGVFNMIFQFEHMNLWSEDTNQSSFNLVEFKQILTRWQNALEGMGWNALYLENHDQARSINTFGNPNYRYASATALATCYFLMKGTPFIYQGQELGLVNYHFTSLDQFDDISARNLINKLKHQGKSEQYILSLLNRVSRDHSRLPMPWNSEENGGFSTVTPWITVNPNYELINVSEQLNNQNSVLQFYKQLIGLRKQHKSLIIGRYKLILADDPNIYAYQRISDDCTWTIITNLSDNVAKVDIDRSALGDLILDNQTGNNESAMTNFEKTGLASAYGAYVFMTKH

SEQ ID NO: 8323 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRALKVVITATMMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 8324 - protein, 359 aa, Aspergillus nidulans FGSC A4
MAPFSIKRAKKDQPQAGQPKKAAPAKPDQPTYKKRAQLTQMFPPRPTFTEKDITFQKGRVFLVTGGTSGIGFELAKILYARGGTVYITGRTEEKAKEAVQKIQASVGERDGQIDYIVLKLDDLTSIRESADAFMEKESKLDVLWNNAGIAQPPVGVLSKQGSELQLATNCLGPFLFTQMMLPLLDAAVALNGPAYPGSVRVVWLSDQVVELSSPIEGIVMQELNNPPQDNSRNYLNSKTGAWFLGSEFARRYGPEHGIVSVAMNPGAARTNLLRHAGWTKFLSWPLLHSPKLAALTELYAGLSPDINLENNGCYVIPWGRIHTTVAPHLMNALRSKEAGGTGRAQQFWDFCDDKTKDYH

SEQ ID NO: 8325 - protein, 129 aa, Zea mays
MKKTSSPLLIVLFLTAAAMAAEPEKQAAPAAQETAVHIVYVDRPEDADPEEFHIRTLTPVLGSEQKARDAVLYHYKNAASGFSAKLTPQQVKDLKEQPGVLQVVPSQTYQLHGPGSGTHQGTTHTLGLM

SEQ ID NO: 8326 - protein, 137 aa, Glycine max
  misc_feature (71)..(71): Xaa can be any naturally occurring amino acid
  misc_feature (110)..(110): Xaa can be any naturally occurring amino acid
  misc_feature (131)..(131): Xaa can be any naturally occurring amino acid
  unsure (1)..(137): unsure at all Xaa locations
KNKLLRTNNEKLTAGSMISCAAVTTVNRAGGDMVATFTGLMSMAGLPTTKTNDDISSIASNGGRVQCMQAXPPVGKKKFETLCYLPDLDDAQLAKEVEYLLRKGWIACWXFELDHRFWYREHNTSAEYYYXRYWTMW

SEQ ID NO: 8327 - protein, 383 aa, Acidovorax sp. JS42
MTTPHFPSRLPNVGTTIFTVMSALAAEHQAVNLGQGFPDFHCDPQLVDAVTRAMQAGHNQYPPMAGVPALRQAVASKIEALHARQYCPNAEITITAGATQAILTAILACVQPGDEVIVLEPCYDSYVPNIALAGGVVVRVPLKPGSFRPDFAKIAAAITPRTRLLIINTPHNPSATVWTADDMRTLEELLAPTDVLLISDEVYEHMVFDGAEHQSAARFAGLAERAFIVSSFGKTFHVTGWKVGTVAAPAAMTAEFRKVHQFNVFTVNTPMQYGLADYLQNPAPYLQLPAFYQAKRDLFRQGLEGSRLKLLPSTGSYFQCVDISAVSDLNEADFCQWLTREIGVAAIPLSAFYGDGFDQRVVRFCFAKKDETLRAAIERLRTL

SEQ ID NO: 8328 - protein, 206 aa, Cupriavidus necator
LQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 8329 - protein, 251 aa, Bacteroides fragilis NCTC 9343
MMPCPESFPVPLIHIAKADSTNGYLNALCEKEKVSELTTVVADFQTAGRGQRGNSWESEDGKNLMFSFVLYPTFLEARKQFLLSQIASLAVKETLDLYIGDVSIKWPNDIYWKDKKICGMLIENDLMGIHISQSIAGVGININQKEFHSSAPNPISIIQITHRESDRMEILAQVLQRIKEYYKILQEGDIEFITDRYQAALFRKEGIHFYKDSEGTFNAGIVEVEADGHLVLQDETGKIRRYLFKEVQYIL

SEQ ID NO: 8330 - protein, 159 aa, Cupriavidus necator
LQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 8331 - protein, 488 aa, Bacillus anthracis str. Sterne
MNSATNQTTSQTETTKGKGELRRGLKSKHLTMISLGGTIGTGLFLASGGVIHSAGPGGALIAYAAIGIMVYFLMTSLAELTAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 8332 - protein, 310 aa, Malus x domestica
MSTGTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVYA

SEQ ID NO: 8333 - protein, 391 aa, Streptococcus agalactiae NEM316
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIASLAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 8334 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTVTQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 8335 - protein, 181 aa, Vigna radiata
MASSMISSPAVTTVNRAGAAGMVAPFTGLKSLGGFPTRKTNNDITSVANNGGRVQCMQVWPTIGKKKFETLSYLPDLTEEQLGKEVDYLLRSGWIPCLEFELSHKDAFPHRENNRSPGYYDGRYWTMWKLPMYGCTDSSQVLKELREARTLYPDGFVRIVGFDSVRQVQCISFIAYKPPGY

SEQ ID NO: 8336 - protein, 356 aa, Aspergillus oryzae
MSTENKMRAVVFHSPYKVAVEERPIPKIQDSGDIVVKVTYTALCGSDLHTFRGIEPAGTGFVMGHEVTGEVVEVGSGVKSIQKGDMVVSAFTTSCGECFYCKQGFSSRCEKSVLFGCDHLDGAQAEYVRIPNADGTVMKAPEGVEEKYLVLMADIFPTGYFAASNAFKGYTPEQISEQTVVLIGCGPVGLCALINALEFKPKHLLAVDSIPSRLELARSLGAEPWNFQQDREGLDKRVKELTNGRGADAVIEVVGLSPALRTGFDLLRPWGTISSVGVHNGEIPWAGNDAYDKNLRIQMGRCPVRSVSPQALDVLKKNQHKLGFMADKIMPLSQAVEGYELFNAMKVQKVIFKAGE

SEQ ID NO: 8337 - protein, 395 aa, Bacillus thuringiensis serovar konkukian str. 97-27
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEGNEYKITAEQLREAITEKTKAVIINSPSNPTGMIYSKEELQQLGEVCLEHDILIVSDEIYEKLIYGGAEYTSIAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDEWAKALLEEEKVALVPGTGFGAPNNVRLSYATSLEQVEKALERIHTFMKSKVQA

SEQ ID NO: 8338 - protein, 136 aa, Zea mays
MQASRARLFKEYKEVQREKSADPDIQLICDDSNIFKWTALIKYPLLPPQVRFLTKIFHPNVHFKTGEICLDILKNAWSPAWTLQSVCRAIIALMAHPEPDSPLNCDSGNLLRSGDIRGYQSMARMYTRLAAMPKKG

SEQ ID NO: 8339 - protein, 600 aa, Phanerochaete chrysosporium
MLVSVDALALRTLVYELTYLLYPAVPTAAALLLLQRLGSVWLPTWTIVLLSLCSVPVAHRILLWLKDWRAARKAASMGAILPPRLKGRWPGSIDLLRQLTKTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCVHSLASVLPYPHDAPAHLQTTGASRTEDFARAFAEAQDAVSFRLRMGWLWPWFELFGSRTKAPMAVVDAFLDPILRDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 8340 - protein, 434 aa, Bacillus cereus ATCC 10987
MVVKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKTGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAEKHNIDITLNRLKGALTVYFTTNTIEDYDAAQDTDGEMFGKFFKLMLQEGINLAPSKYEAWFLTTEHTKEDIEYTIEAVGRAFAALANNK

SEQ ID NO: 8341 - protein, 281 aa, Streptomyces griseochromogenes
MITTSQSISPDHVADYYDRLTDLFGEAADGNLHFGYWPHPHDGSSLGVAADRLTDHLIGKLGDIAGRRVLDVGCGSGKPAVRLALSAPTEVVGVTVSPVQVERATALAEREGVADRVRFVCADAMTLPFPDASFDAVWALECMFHMPSPAQVLGEISRVLCPGGRLAVMDVVLREPVPALDRGAVERGRLMFAVPAHIELAEYPRLILGAGLRLEEMADLGDEIIRPSTEALGRAATANPAAFAAAFGVDTERFDTLVAEWAQITAALNLGYVVLTAKRPE

SEQ ID NO: 8342 - protein, 326 aa, Bacillus thuringiensis serovar konkukian str. 97-27
MQSTIRKQLLQVFSEADGEFVSGQTISDKLGCSRTAVWKHMEDLRNEGYELEAVRRLGYRIASKPDKVTANEIQLGLQTKHIGRTVYFEESVESTQHIAAKLAYEGAEEGTIVVAEEQTAGRGRLSRKWHSPKGTGIWMSIILRPSIPVHHAPQLTLLAAVSVAQAIEKCTGVNVGIKWPNDILIQGKKAVGILTEMQADPDKINAVIMGIGINANQKQEHFDEEIQHIATSLAIESGRPIVRAELMQQIFLQLEKLYEEYLQNGFSVIKILWESYAVSIGKEINARTMRETITGVAKGITEDGVLLLEDHEGKVHHIHSADIEIK

SEQ ID NO: 8343 - protein, 108 aa, Zea mays
MPQGDHIELHQKRHGKRLDHEERKRKREARELIGAKGKRFAKKRYAEKAQMKKTLKMHDESNKRQKVDDDVQEGALPPYLLDCDQTQRAKVDYCFWLLSANYCLCYKS

SEQ ID NO: 8344 - protein, 814 aa, Chlamydia trachomatis D/UW-3/CX
MYFDRTKINVESMKQAILERVYCGVVQTPQSASTRDIFTAVAKTVLEWMAKGWLKTQSSYYDNDVKRVYYISMEFLLGRSLKSNLLNLGLLDLVKEALFDLGYDFDQLVEMEHDAGLGNGGLGRLAACFLDSMATLEIPAYGYGLRYDYGIFDQKIENGFQVESPDEWLRYGNPWEICRGEYLYPVHFYGKVKHSIDSRGRDVAELVDSQEVLAMAYDVPVPGFNNDAVNSLRLWQAQSRHGFEFSYFNHGNYIRAIEDIALAGNITRVLYPNDSISEGQELRLKQEYFLVSATIQDILRRYTKTHLSLDKLSEKVSVQLNDTHPALGIAEMMRLLVDREELDWDVAWDATTKIFNYTNHTILPEALERWSLDLFSKVLPRHLEIIYEINARWLAKVSQKYPGDNDKRRALSIIEEGSSKFVNMANLAVVGTNKVNGVSTFHSQLIKSTLFKDFVEFFPDKFINVTNGITPRRWLALSNKKLSSLLNRTIGTEYLTNLTHLHKVIPLAEDSGFREEWRNIKIQNKEELAARIYKELGVTVNPQSIFDCHIKRIHEYKRQLMNILRVIYFYNEIRNGSGEIVPTTVIFGGKAAPGYAMAKLIIKLINNVAAVVNNDPKVNDQLKVIFWPNYRVSLAEAIIPATDLSEQISTAGMEASGTGNMKFALNGALTIGTMDGANIEMAEHIGKEHMFIFGLLEEEISELRKEYYPQGICNANPTIQEILDMIAQAKFSQEDKDLFKPIVNRLLNEGDPFFVLADLEAYINTQNRVASLFKQPEEWTKKSIYNVGGIGFFSSDRSIAEYASNIWNVSRPTS

SEQ ID NO: 8345 - protein, 120 aa, Zea mays
  misc_feature (102)..(102): Xaa can be any naturally occurring amino acid
  unsure (1)..(120): unsure at all Xaa locations
MEANSGGGGGAEGGRAVTGGGGGSDVELVSKTLQVEHKLFYFDLKENPRGRYLKISEKTSATRSTIIVPSSGISWFLDLFNYYVNSEEHELFSKELQLDSKXVFYFDIGENRRGRFFRKF

SEQ ID NO: 8346 - protein, 313 aa, Zea mays
  misc_feature (280)..(280): Xaa can be any naturally occurring amino acid
  unsure (1)..(313): unsure at all Xaa locations
VGGDTSIEEYIIGPATEAADDLVTDGDKEQITLYGPEEGQSWIARPSKGPSMLGSVLSLASRHGSMVNQSVPLMDPIVTLFGSVHENMPQAGGSMRSTLFPNFGSMFSVTDQHAKNEQWDEENLHRDDEEYASDGAGGDYEDNLHSPLLSRQATGAEGKDIVHHGHRGSALSMRRQSLLGEGGDGVSSTDIGGGWQLAWKWSEKEGENGRKEGGFKRVYLHQEGVPGSRRGSIVSLPGGGDVLEGSEFVHAAALVSQSALFSKGLAEPRMSDAAMVHPSXLGISIHLDQFSHYLTNASLHWLCHAAYGSFRKK

SEQ ID NO: 8347 - protein, 492 aa, Polaromonas sp. JS666
MDMKTSPISLLKDPSLFKTDALINGQWVAGGSRFDVNDPSNGQKLADVANLGSQDAEAAIAAANAAWPAWRSKTGKERHAILMKWYQLLMANQEDLGRIMTAEQGKPFAEAKGEVAYGASFVEWFAEEAKRVNGETLPQFDNNRRLMVIKQPIGVCAAITPWNFPLAMITRKVAPALAAGCPVVIKPAELTPLTALAAAELAVRAGIPAGVLNVLTADSANSIAVGKVFCASDVVRHISFTGSTEVGRILMAQSAPSVKKLSLELGGNAPFIVFDDADIDSAVEGAMASKYRNAGQTCVCANRIYVQDGVYDQFVEKFAAKVKLLKVGNGFEDGVVQGPLIEDSAVDKVQRHVADALAKGGKLQAGGHKLQGQFFEPTVISEATADMLCAREETFGPFAPVFRFKAEQEAIDAANNTEFGLASYFYSRDIGRIYRVAEALEYGMVGINAGVIATEHVPFGGVKQSGLGREGSSHGMEEYVEMKYLCLGDILK

SEQ ID NO: 8348 - protein, 317 aa, Photobacterium sp. SKA34
MSNSIQWFPGHMHKARKEIEEAMPKVDVIIEVLDARIPFSSENPLIKSFRNTNDGKPVVKVLNKRDLADPEMTQLWIDHLEKEQGVKAIAVTTENLNEVNQIMDLCRKLAPHREEAGKKIRTMIMGIPNVGKSTIINALAGRTVAITGNQPAVTRQQQRINLDNGVLLSDTPGILWPKVENPHSGFRLAATGAIKDTAMDYIDVGFFTIEYLIKAYPDMIKARYNLDDDLPESEIELMEEIGRKRGCLKGGGHVDLHKASVILINELRNGTLGNITLEHPDMITEELINVAEEAERKAEQKIKKKEERRKRYLKNKR

SEQ ID NO: 8349 - protein, 136 aa, Tropheryma whipplei str. Twist
MEQTLVIIKPDGIRRGLIGQVLSRIEAKGYQIVDIRMLVPDRQSVEEHYLEHRDRHFYLPLVDFMTSGPIVLVRAEGHGVVDALRTLVGVSDPTLALPGTIRGDFGRNWGLGVIQNIVHASDSVKSAKRELDIWFP

SEQ ID NO: 8350 - protein, 170 aa, Brassica napus
  misc_feature (38)..(38): Xaa can be any naturally occurring amino acid
  misc_feature (143)..(144): Xaa can be any naturally occurring amino acid
  unsure (1)..(170): unsure at all Xaa locations
MFRVTGSLSAVSSPAAVTFSAALRLSVAPTLAFASPPXLPRCLSTFSRSLLGRRISSLRARLPVTSMYPLTLSGSSAVKARASFSGGGSRPRREILVQLVLVEEGDSELCSKLETRIVGRGDMCYRSSVFDISTSKKEGGILXXVKIGQMVPEFEEAAFKAELNHVVRCK

SEQ ID NO: 8351 - protein, 190 aa, Momordica charantia
MDSFWFVQQWPPAVCSFQKSGSCPGSGLRTFTIHGLWPQQSGTSLTNCPGSPFDITKISHLQSQLNTLWPTVLRANNQQFWSHEWTKHGTCSESTFNQAAYFKLAVDMRNNYDIIGALRPHAAGPNGRTKSRQAIKGFLKAKFGKFPGLRCRTDPQTKVSYLVQVVACFAQDGSTLIDCTRDTCGANFIF

SEQ ID NO: 8352 - protein, 488 aa, Leifsonia xyli subsp. xyli str. CTCB07
MRRAKIVATLGPATSSYDNIRAIVDAGVDVARMNLSHGSYEVHEGVYANVRKAAEDAGKPVAVLVDLQGPKIRLGKFEAGPYELAEGDIFTITTEEIIGTKEISSTTFKGLPQDVKPGDFLLIDDGKVRVRVLETDGTAVTTEVVVAGPVSNNKGINLPGVAVNVPALSEKDEADLRWGLNLGADLIALSFVRNAGDIERVHEIMAEEGRKVPVIAKIEKPQAVDALEGIIEAFDGIMVARGDLGVELPLEAVPIVQKRAVELARRAAKPVIVATQMLESMISSPVPTRAETSDVANAVLDGSDAVMLSGETSVGEYPKITVQTMAKIVKSTEEHGLDRIAPLGTKPRTQSGAITLAATEVADFVEAKYLCVFTESGESARRMARLRSKIRILAFTPEESTRRKMALYWGVESFVVDRVTHTDQMVAQVDEALKSTGRAENGDKVVIISGSPPGIPGTTNDIRVHRVGDVLCSETQRRASRFGDRSRL

SEQ ID NO: 8353 - protein, 385 aa, Thermus thermophilus HB8 [sequence omitted]

SEQ ID NO: 8354 - protein, 665 aa, Neurospora crassa
MASNPTNTAAPTGGLTEKKHDRRSTSSESVSGTGFAEHADRTGTFNQNARLEASKKIANPLAGLSPQRLEAMGEEYAMMAGLTSEEDIRAFRLGARIAGDESNYDLIPELTEREKEECSSMMLTTILQVCSLCAAVQGMDETVVNGAQLFYKDKFGIGTDSQRDTWLLGLVNSAPYLCCALIGCWLTEPMNRIFGRRGTIFVSCIISAVACFHQAFTNTWWHMFIARFYLGLGIGPKSATTPIFAAECSPPKLRGALVMQWQMWTAFGIMVGYIADLAFYFVPDHGIGLGLNWRLMMGSAMIPAVIVVCLAFLCPESPRWYLSKGRHQDAFGALCRLRFEKVQAARDLFYTHTLLEAEKQAMSGVKKGNRFKELFTVRRNRNAVIASSGLMFMQQFCGVNIIAYYSSAVFRDAGFSDVSALAASLGFGVVNWLFAIPAMYTIDTFGRRNLLLTTFPLMSLFLFFTGFSFWIPEDSKAHIGCIALGIYLFGMVYSPGEGPVPFTYSAEAYPLYIRPIGMSLATATTWFFNFILSITWPRMVTAFKPQGAFGWYAGWNIIGFLFTLFLVPETKGKTLEELDHVFDVPLKKLVRYGADQSLWFFHRGKNGNGMRPTAPSAEMYHGDAERMNEVVSGQQLGEGEREKRWNKEQEREGGIMGRGDAAGKV

SEQ ID NO: 8355 - protein, 460 aa, Oryza sativa (japonica cultivar-group)
ASFRTVGAKITQETGDFFVSDAEGDPDKPTDGFSSIDEAIGALHEGKFVIAVDDESGDNEGDLVMAATLADPESIAFMIRNGSGIISVGMKEEDLTRLMIPMMSPIAEIEDISAAASTVTVDARVGISTGVSAADRAKTIFTLASPDSKPTDLRRPGHIFPLKYRNGGVLKRAGHTEASVDLVALAGLRPVSVLSTVINPVDGSMAGMPVLKQMALEHDIPIVSIADLIRYRRKREKLVELIAVSRLPTKWGLFRAYCYQSKLDGTEHIAVAKGDIGDGEDVLVRVHSECLTGDILGSARCDCGNQLDLAMQLIDKAGRGVLVYLRGHEGRGIGLGQKLRAYNLQDDGHDTVQANVELGLAVDSREYGIGAQILRDMGVRTMRLMTNNPAKFVGLKGYGLAVVGRVPVISPITKENQRYLETKRTKMGHVYGSDLPGNVPEEFLNPDDIAGDQDEDDTHN

SEQ ID NO: 8356 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 8357 - protein, 168 aa, Propionibacterium acnes KPA171202
MQNFPTVGLIDGTFRANLEETGMGYGLEIDMIKIAHDLDLLTSPYVFDVDQAKDMARAGSDILVPHMGLTTSGTIGAKTALTIEDAAVKVQELADAAKSVNPDILCLCHGGPIANPEDAQYILDHTDGIVGFYGASSIERFPAETGIKKQTEDFMALKLNKSCLALRA

SEQ ID NO: 8358 - protein, 69 aa, Triticum aestivum
  misc_feature (7)..(7): Xaa can be any naturally occurring amino acid
  misc_feature (33)..(33): Xaa can be any naturally occurring amino acid
  misc_feature (49)..(49): Xaa can be any naturally occurring amino acid
  misc_feature (52)..(52): Xaa can be any naturally occurring amino acid
  misc_feature (54)..(54): Xaa can be any naturally occurring amino acid
  misc_feature (57)..(57): Xaa can be any naturally occurring amino acid
  misc_feature (59)..(59): Xaa can be any naturally occurring amino acid
  misc_feature (65)..(66): Xaa can be any naturally occurring amino acid
  unsure (1)..(69): unsure at all Xaa locations
GVPEGAXIGEIISRFEKKGFYLKALKLVNVERXFAEKHYADLASKPFFXGLXDXIIXGXVVAKGXXGKN

SEQ ID NO: 8359 - protein, 176 aa, Triticum aestivum
  misc_feature (149)..(149): Xaa can be any naturally occurring amino acid
  unsure (1)..(176): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIXGFDNMRQVQCVSFIAFKPPGCEESGKA

SEQ ID NO: 8360 - protein, 103 aa, Propionibacterium acnes KPA171202
MTRTEILKKFRGQVANGIPLVGGGAGTGITVKSAEAGGIDLLVIYNSGRFRMAGRGSLSGLLAYGDANEIAMDMAREVLPVVKHTPVLAGVNGTDPFRVMPQS

SEQ ID NO: 8361 - protein, 487 aa, Streptomyces avermitilis MA-4680
MSKDAVDTARVASRTDVTQSPADAGDAGYSKDLKARHVNMIAIGGAIGTGLFLGAGGRLHNAGPALAIAYLVCGVFAFFVVRALGELVLYRPSSGSFVSYAREFLGEKGAYVAGWMYFLNWSTTGIADITAIALYTHYWSLFTDIPQWVLALIALAVVLAVNLISVKIFGEMEFWFAIIKVATLVGFMLIGIFLLATHHEVGGHTPGLSAVTDHGGIFPHGMMPVVLVMQGVIFAYAALELVGVAAGETAEPEKVVPRAVNSIMWRVGLFYVGSVVLLALLLPGSVYSADQSPFVTVLSKIGIPAAGDVMNLVVLTAAMSSLNSGLYSTGRILRSMAMAGSAPKFTARMNRSQVPYGGILLTCAVCVLGVGLNYLMPTQAFEIVLNVASLGIISTWVIIMICHLVFVRRARAGLVTRPSFRLFGSPVTEIVTIAFLLAVLGLMWNDPEVGRKTLLLIPLVAVLLVGGWFAVRRRVSQAEDRELAQLK

SEQ ID NO: 8362 - protein, 288 aa, Triticum aestivum
  misc_feature (136)..(136): Xaa can be any naturally occurring amino acid
  misc_feature (148)..(148): Xaa can be any naturally occurring amino acid
  misc_feature (160)..(160): Xaa can be any naturally occurring amino acid
  misc_feature (172)..(172): Xaa can be any naturally occurring amino acid
  misc_feature (220)..(220): Xaa can be any naturally occurring amino acid
  misc_feature (240)..(240): Xaa can be any naturally occurring amino acid
  misc_feature (252)..(252): Xaa can be any naturally occurring amino acid
  misc_feature (261)..(262): Xaa can be any naturally occurring amino acid
  misc_feature (265)..(265): Xaa can be any naturally occurring amino acid
  unsure (1)..(288): unsure at all Xaa locations
MSSSMESSYLPATTESIAMAQEAKNASESISILYRVIQDPSSSADALRTKELAITNLTNYLTEESRAEELRNLLTQLRPFFSLIPKAKTAKIVRGIIDAVSKIPGTSDLQISLCKEMVEWTRAEKRTFLRQRVEAXRLAALLLENQEXYTEALTPLTGLXIREVRRLEDQLXSLGTLDLFGKAKLPFPLRKLPKAKASLTAARTAANAIYVPTTQQGTIXDLQSGSFNAEEKDYKTAYSXFGTFQAFNALDXQRLLQLEIXXLCXKWQQAKFENQYNIGPLINVHSQS

SEQ ID NO: 8363 - protein, 166 aa, Brassica napus
KKMSLFLTFLYVFLCNSVSLSSSLSLHFPLTSLRLTTTTNSSSSSLQTSLASRRNPSQSSSSSPPYSFRSNFKYSMALILSLPIGTPAQTQELVLDTGSQLSWIQCHRKKQKPTTSFDPSLSSSFSNLPCSHPFCKPRIPDFTLPTTCDSNRLCHYSYFYADGTYA

SEQ ID NO: 8364 - protein, 284 aa, Arcanobacterium pyogenes
MSAYGHGRHEHGQNFLTDHKIINSIIDLVKQTSGPIIEIGPGSGALTHPMAYLGRAITAVEVDAKLAAKLTQETSSAAVEVVHDDFLNFRLPATPCVIVGNIPFHLTTAILRKLLHAPAWTDAVLLMQWEVARRRAGVGASTMMTAQWSPWFTFHLGSRVPRSAFRPQPNVDGGILVIRRVGDPKIPIEQRKAFQAMVHTVFTARGRGIREILRRAGLFSSRSETQSWLHSRGIDPATLPPRLHTSDWIDLFQVTGSSSPHHRPISPSGSSQRPPQRKNRSRRR

SEQ ID NO: 8365 - protein, 733 aa, Aspergillus oryzae
MAATSTDRITPVSGVASPVSPASSTGQIPLDQPPKLKGRHKLLQSLQRISSSPSLKRGRSHSTGYRRDGKASLSCVSLGHSAYAPCLGNGSSSQLYGGLNVRPMTSGQAGPVEEHEGNARIRLVGSDSPNTAQSRSVPLPTELRPGPLGSPLGSTDVIQETAVVQPASKPKKTFDFWGSMPGELRMLILSYLTPREIVRCSLVSKAWNKMCFDGQLWSAIDTTDYYRDIPSDGLVKIIASGGPFVRDLNLRGCVQLREKWKSEGKRITDLCRNVVNFSLEGCRIDKTSMHYFLLRNPRLEYINVSGLSSVTNSAMKIIAQSCPQLEILNVSWCSGVNTNGLKRIIKECPKLKDLGASEIRGFDDEDFALELFKRNTLERLIASRTDINDVCLKILVHGIDPEMDVLLDRPIVLPRQLKHLDLHQCSDLTDNGVKSLAYNVPYLEGLQLSQCPELSDDSVIAVIRTTPRLTHLEIEDLERLTNSTLLEIAKAPCAEHLEHLNISYCEALGDPGMLQVMKNCPSLSSVEMDNTRVSDLTLMEASYRVRKRGYGEDLPRVGLRLVVFDCANVTWAGVKEVLSSNAYVPRSRKSLQATSAISVVAQAVVPDESTDTKTVITSSITPPPQPSVYPNEIIQLKCFYGWQMTVNEHNKRVLRGDLAAANRLDRKWADYMMATEEAGAAGAGARRRRRRAREAERIYNADDEGDDAYGIGGVSALGGRRRRAHSGGSCLVM

SEQ ID NO: 8366 - protein, 364 aa, Arabidopsis thaliana
MGKGGMSQGEGSKVEEENMAAWLVGINTLKIQPFLLPSVGPHDVRVRMKAVGICGSDVHYLKTMICADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 8367 - protein, 397 aa, Thraustochytrium aureum
MLTKSEINKEIQAFTLNFGPQHPAAHGVLRLVLELDGEVVRKADPHVGLLHRGTEKLVEQKTYLQALPYFDRLDYVSIIAQEHTYSIGVETLLDLSIPLRSQFIRVIFLEITRILNHLLAVSCHALDVGAITPFFWGFEEREKLIEFYERVSGARMHAAYVRPGGVSFDIPKGLLNDIFYFCESFKVRLDEFEELLTNNRIWKQRLVNIGVVSAADSKNWGFSGVMLRGSGIPWDLRQNFPYEVYNQLSFEIPVGSNGDCYDRYLIRIEEIRQSISIIVQAINLMPEGPVKSFNYKFSNPSKKMMKNSIEALIHHFKYFTEGFPVNRGEVYVATEAPKGEFGVFLVSDGSNKPYRCKIKAPGFSHLQGLDFMSKGHLIADVVTIIGTQDIVFGEVDR

SEQ ID NO: 8368 - protein, 498 aa, Kineococcus radiotolerans SRS30216
MARAPPPRGAPSDRGAGPGDPGTTVEEDVVQLAPQEQSGLGTGLKPRHITMISIAGVIGAGLFVGSKTAIAEAGPGVLLSYAFAGLLVVLVMRMLGEMATAHPDTGSFSTYADRALGRWAGFSVGWLYWWFWVLVIPVEATAAADILSSWIGAPQWVWALLVTLALTASNLTSVGNYGEFEFWFAGVKVVAIVGFIAVGLLAIFGVLPGSDISGTPGFSLTGDAGGFLPNGFSAVLAGILLTMFSFMGTEIVTIAAAESPDPQKGVRRAVNSVIGRIGVFYLGSIFVVVALVPWNSAALDADGSFQTTLQAIGIPGAATIMDVVILTAVASCLNSALYTASRMVFSLSRRGDAPVWLSHVSRRGVPYPAILASTVVGFLAVVGNYLLPEKIFEYLLATSGALALVIYAFIALSQVVVRRRLDEAGERPAVRMWLFPWLTYATIAFIAVVLVLMVVLPGQRVQLALSLVLTVVVVALGLRHQRRRGPAARPADEAAAHR

SEQ ID NO: 8369 - protein, 159 aa, Prunus armeniaca
YFQFVQQWPPTNCRVRIKRPCSNPRPLQYFTIHGLWPSNYSNPTKPSNCAGSQFNFTKVISWPDVESGNDTKFWEGEWNKHGTCSERILNQMQYFQRSQAMWKSHNITEILKNASIVPHPTQTWTYADIVAPIQTATKRTPLLRCKWDKKNQLLHEVVF

SEQ ID NO: 8370 - protein, 193 aa, Wolbachia endosymbiont of Drosophila melanogaster
MRPVILCGGSGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFRGCPETSKRL

SEQ ID NO: 8371 - protein, 489 aa, Synechococcus sp. WH 8102
MHSVASTPLIPVILCGGTGTRLWPLSRASYPKQYWPLSGEGDATLMQQTQQRLEGLNGLEAPLLICNEDHRFIVAEQMRQIGVEPNAILLEPMGRNTAPAVTVAALQATAGGQDPLLLVLAADHLIRDAKQFRQAVDAGRSAAEAGRLVTFGIVPTAPETGYGYIEAAEPFSGGSLREVPIARFVEKPDRATAEQFLATGRFTWNSGMFLFRASAMLAELERLAPEVVSCCRAALEQDAADLDFLRLEREAFAKCPNVAIDVAVMEKTELGSVLPLDAGWSDVGSWSALWETADRDVDGNVLQGRVINKGSRNCYLRSEHRLVVGLGVENLVVVETDDAVLIADRSKAQEIKSVVKQLEADGSPEGKAHRKIYRPWGAYTGVTEGNRWQVKRISVNPGSSLSLQMHHHRAEHWVVVKGTALVERDGDQQLVGENQSTYIPMGCKHRLSNPGRIPVELIEVQSGEYLGEDDIVRFEDRYGRSDQRIPVQS

SEQ ID NO: 8372 - protein, 257 aa, Wolbachia endosymbiont of Drosophila melanogaster
MNLLVSGQPLKAKRYIDEIKKSAPNLYNLCFKYFTPQERFLYLKQRDFAGIEGISIDYLVMEKAKNVAMIEANFDWLDVGTWNSVLELSEKFSKEPASFQHVIREKEPVSTTESNKNLLSGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSTSFPLEIVEFQIGEHLSDNDIVRLDDVYGRIW

SEQ ID NO: 8373 - protein, 502 aa, Staphylococcus epidermidis ATCC 12228
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQNIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 8374 - protein, 3487 aa, Microcystis aeruginosa
MVESIDYKKLMATTLSKMEVMQARINELETRQSESIAVVGMACRFPGGINSPEKYWSFCQAGLDAIVEVPKSRWDISKLYSQEPTLGKMNTAYGGFLQENITEFDARFFSISAKEAASMDPQQRLLLEVAWEALENANLPLKNLADNKVGVFVGITSIDHALKVYGTNYDQIDSFFGSGNALSAAAGRLSYFLNLHGPCLSIDAACASSLAAVHQGIRSLRNRECELALVGGVNLILEPAITISLSQSGMMSPDGRCKTFDASANGYVRGEGCGVLILKTLSEAQKNGDHILALLRGSAVNHNGAAAGLTVPSGPAQQELLRQALVDARIVPEDVSYIEAHGTGTSLGDPIELNAIASVYGKRSDPLYVASVKTNIGHLEAAAGMAGIIKTILILQQGEIPSHLHFQTPNPLINWEDHPIKIPTQNIPWPNNNKVPIAGVSSFGFSGTNAHVIVQQAPVSKISEIQQQLPSHLLTLSAHNKTALKELAKRFHTLLESRPEIGDICYSAAVGRIDLPERLAIVGDTCPELQQRLAAFAEEKPLDDLTFYQRFTSEKSPKIVFLFTGQGACYPGMGHQLYQTQPTFRQYIDQCAEILSKYLDHPLTEILFGEQTDLLNQTAYAQPAIFALEYSLTMLWKSWGITPSLLIGHSVGEYVAACIAGVFSLEAGLALVVKRGQLMQTTTSGKMASIFADEETVSSLIKNYTQTVSIAAINHPQQIVIAGESASIEEVISTCKKQKIPAQYLPVTQAFHSPLMEPILKEFEKEARQIYYQRPQILLLSGLDGELLENAPDAAYWSKQCREPVRFLSSLITAFNKGYNLFLEVGPRPILAEQGRRYKDEVIWLSSLNRGLDNWHTILSALAQLYLNGAPFNPEQFNRNYGYKKVRLPNYPFQRKPFQFQPNPRTENQSIDKIFLDAQTSNLTDTETTVFNMQKHQQEIRNQLKSILALLLKEDENDLPEDETLLNLGADSIILTDFSRKVEEKFQVKVKIDQLFTDLQTLADIAEYLCQFVNEKPLENASEITTKVINDETELSNYLQVIEQLQPIATAYIIRALESLGKKLNQGEQWTIETLRQTLPVARKYHILLNRYLQDLEQANVLHNQGNIWTVKNLPESFSLPQALQKLEKTCPSAKPELEMLQRCGENLAEVLKGNIDPLTLIFPEGSVAHAESIYGNSPVSRLMNQRVAQAINQILTNFSNSDRPYQILEIGGGTGATSEAILHHLNLDHVTYSFSEVSPFLLHQARQKFQKKYNLNFHQLDIEKSPISQGIPARNYHIVVAANVLHATRNITETLTHIRELLRPGGYLVLLETVENNSWLNLTFGLTPGWWRFQDQQLRSDTPLLRGENWCSVLKSCGFATANSFSKQNNIPINNGQELILACVPDEPLSIPAIPKFTVSGESSGKEALMMAQLQSLKDLKDLHEKTIIKQLEVLQTAPVFPSIAPEILTNQTQIIPTQSSKTETYLPVSQEKPKSPEKPSSPNLNPLALKLTENKSLTEQQQAFIQNLQSIYNQKTAKSKAYSQNSRKTMVDVKPTIDFRMALKEFQYPIVSESAQGAYFKDIDGNNYIDLAMGFGVNFFGHSPDFVIKAVQEQMNRGIGLGMQSNLAAETAALISEMGRVERVAFSNTGTEAIMAAVRIARSRTKRQKIVMFAGSYHGTFDGILARVGEDKTTAQPLSLGTPLGMVEDIIVLSYGVEESLDIIATHADDLAAVLVEPVQSRKPDLQPQEFLQKLRQITHKKGITLIFDEIITGFRIAPGGAQEWFNVEADIVIYGKAIGGGLPISMICGKADFLDTVDGGFWQYGDDSHPQTELTAFGGTFCRHPLALAACRAVLLHLRENSPTIQEKVNQLTHRLATEVNQFFQEIGIPIRVVNFGSLFRFEPFGAYSIFLQPIELPLFYYLLNLKGIYTWEKRVCFLSTCHTNKDIDKVIVAVKEAITELQQAGFFANAKRPQVKKEEKKPLSEDEDGRGHLPSLNQSFPTSEAQRQLWLLAELDRNASASYNVTTSLELLGSLDVYILEKTINQVINRHEALRTKIIEQGELQEVVNEVNIKLNLIDFKDEDNPEATALALRSQFSQKPFDLSIAPLFAVILMRLKPDHYLLSLKTHHIVADGWSLGLILQEIGQLYSSQNNTTKEVLTPPMQFRQYLTLRAQETQSPQMLEHRDFWLKTYQEDLPTFELPTDFPRPAVKTYTGGQESQVIPSEVGQNLQKVGRKNKATLFMTMFAAYTAFLRRISGHRDLVIGIPISGRQIEGSDNLVGFCSQFLPLRIQVDATTSFIEHLQHTKQTLIDAFRHQSYTLEDLLAALQLPRDFSRSPLISVSFNMDPSLTLPEFKDLKVSLPPSPIGYTPFDLGFNLIELNDNLIIYCNYNTELFKKETIKQFIESFEILLRGIIDDANHLLYQLPLLTPVQQEKLLRQLTGKTRKLPEKATIIDDFVAQVKLTPNAPALIAGKINLSYQELNEKVNRLTHYLQQEYQLGVGKVIGVMLQRDHNLIIGILATFKTGATYVPIDSQYPHSRIEFILKDSGCHVCLTESNFISKLPEKMQKICLDKIDPIVEKYDKDEPKIFRNSSQTAYIFYTSGSTGNPKGVMGCHISILNVIQSLRLTFDLDKHPEWRYIFTAAVTHDPSIRNIFLPLTIGASLYMYEIKYIGHLVSFLQENQINALHTTPSIYREILGLLEPGETISSLKYISVGGEKLDRETALALRKRFPAEIVSNVYGSTETCVGVSQYEIKENLDSEIPLGQVFHNNRLGVLDEFNNPVPLHVIGEICVEGAALASGYHNQPEMTQEKFKPSFLDETKTLFRTGDLGKQTAPGIIEFMGRKDNQVKVNGYRIDPGEIEYQLTRYAPIERAIVLPVQVNNQTQLSAYCQTDKTLEIAEIRELLAKFLPVYMIPSYFIFLKQFPLTRHGKLDLHSLRELRETGKSLVNSNYVAPRNHLESNLVSIWEKILSKHPIGIFDNFFEIGGHSLLLSRVVTRVHKELNVSVKLADFFKVPTIAGLATLISQTQYNYQEPISAIPPQKSYPMSHGQRRLWALEFLDQNHNAYGMPSAYQFKGNLNIDAFENAFQQLIQRHEILRTTFTLINNQPRQVVHNQMNFVIKQIDLTAYVSTEQENLIEESISHNAKTTFDLEVGPLLKVNLLKLSQENYIVLFNMHHIIFDGWSAGVLIKDFLTHYHAYGQENSQLMPPLRIHYKDYTSWQESQLETLKLQGQRDYWLAKLTPVPVRLNLPVDYPRPPVKSFQGNTITWQPEPELIDTFEKLVKAQEASLFMGLVSLVKSFLFRYTEQNEITIGSAIAGRNHPDLEDQIGFYVNTLVLRDQITDHDSFTDVLSKVKTTTLEAYDHQDYPFDQIVSDLNLQRDPSRNALFDVAIVLQNNQNVDLALDGITVNSIDPKMITAKFDLEFIFVEEEELYLKLIYNTDIFIHERILLIIDLFKNWLEQVLKFAHEPLINLSLASSENLTQEGQELFTEDFNF

SEQ ID NO: 8375 - protein, 230 aa, Propionibacterium acnes KPA171202
MAAIALLGTLDTKGDEFDWLRHRILTNGSQVVIIDVGSFSNSRIADYTSDEVIRAAGESPSDIRTRHNRGEMMDVMGRGASIIASKLAEEGKIHGLLSLGGSGGSSVAASVMQTLPIGFPKLLVSTMASGDVSPYVGQTDVTLMYSVVDVAGINSVSLMVFANAAAAITAMAKEYEDVRTVSNPAHNKPVVGLTMFGLTTPAADEARKTLTDLGYEVLVFHATDSGRGRR

SEQ ID NO: 8376 - protein, 337 aa, Microcystis aeruginosa
MTTTSPKTLTMDIQKPRVLLIGKMYDEAGQKLLEESTNIEILSNPTLEEINEAIQEVSGVFVRYPNKLEASSIRLAKQLKVISTSGFGTDSIDIMAATEQGVIVVNNPGMSTTSVAEHTLSMILALAKKLPFLDHCVKKGNYLIRNQMQPIQLENKTLGIVGLGRIGTLVAHKCNLALGMRVLAYDPYVPASKAETVGATWVKDLDVLLAESDFVSLHTELTSETREMFNISVFKKMKPTAFLINTSRGKVVCEKDLGIALNQKLIAGCALDVFEPEPPALDNPLYNFENVILSPHLAGVTPEASLAAAVSAANQILQVLQGEKPPYMINPEVWNLF

SEQ ID NO: 8377 - protein, 393 aa, Ehrlichia ruminantium str. Welgevonden
MSDHVKITPMTLNFGPQHPAAHGVMRLVLEMGGEVIERIDPHIGLLHRGTEKLIEYKTYLQALPYFDRLDYVSPMAQEHAYSLCVEKLLKCEVPIRAKYLRVIFCELTRILNHLLNISSQALDIGAMTPLLWMFEEREKILNFYERASGARFHSAYIRPGGVAADIPEDLIHDIFQFVNTFPKFMDDVDSLLTENRIWKQRNVDIGVVSKKQALNWGFSGPMLRACGIPWDLRKSQPYEIYDELEFKIPIGEKGDCYDRYLVRMAEIRESIRLVEQCLNRIPDGPVKTDDRKIAPPKRSEMKKSMEALIHHFKLYSEGYSVPAGETYMAVEAPKGEFGVYIVSDGTNKPYRCRIRAPGFAHLQAIDMMAKGHMLADLTAIIGSLDIVFGEIDR

SEQ ID NO: 8378 - protein, 744 aa, Medicago truncatula
MSGAVIVAVAAAIGNLLQGWDNATIAGSILYIKREFQLQSEPTVEGLIVAMSLIGATVVTTCSGALSDLFGRRPMLIISSLLYFLSSLVMFWSPNVYILLFARLLDGLGIGLAVTLVPLYISEIAPPEIRGSLNTLPQFAGSAGMFFSYCMVFGMSLTKAPSWRLMLGVLSIPSLIYFALTLLLLPESPRWLVSKGRMLEAKKVLQRLRGCQDVAGEMALLVEGLGVGGDTSIEEYIIGPDNELADEEDPSTGKDQIKLYGPEHGQSWVARPVTGQSSVGLVSRKGSMANPSGLVDPLVTLFGSVHEKLPETGSMRSTLFPHFGSMFSVGGNQPRNEDWDEESLAREGDDYISDAAAGDSDDNLQSPLISRQTTSMDKDMPLPAQGSLSNMRQGSLLQGNAGEPVGSTGIGGGWQLAWKWSEQEGPGGKKEGGFKRIYLHQEGGPGSIRASVVSLPGGDVPTDGDVVQQAAALVSQPALYNKELMHQQPVGPAMIHPSETAAKGPSWNDLFEPGVKHALFVGVGLQILQQFSGINGVLYYTPQILEQAGVGYLLSNLGLSSTSSSFLISAVTTLLMLPCIAVAMRLMDISGRRTLLLTTIPVLIVSLFILVLGSLVDLGDTANASISTISVVVYFCSFVMGFGPVPNILCAEIFPTRVRGLCIAICALTFWICDIIVTYSLPVMLNSVGLGGVFGLYAVVCCIAWVFVFLKVPETKGMPLEVIIEFFSVGAKQIDAAKHNCGQA

SEQ ID NO: 8379 - protein, 501 aa, Glycine max
MATRVVAEQKPKTKIVCTLGPASRSVPMIEKLLRAGMNVARFNFSHGSHEYHQETLDNLRAAMENTGILCAVMLDTKGPEIRTGFLKDSKPIQLKQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVRTMAKICIEAESTLDYGDVFKRIMEHSPVPMSPLESLASSAVRTANSARAALILVLTRGGSTAKLVAKYRPGMPILSVVVPELKTDTFDWACSDEAPARHSLIFRGLVPVLSAASARASHAETTEEAIEFAMQHAKSKGLCHNGDSVVALHRVGTASVIKILTVK

SEQ ID NO: 8380 - protein, 395 aa, Nocardia farcinica IFM 10152
MKAVTWQGRRKIAVDEVPDPRIQQPTDAIVRITSTAVCGSDLHLYEVLGPYMTPGDVLGHEPMGIVEEVGAQVRDLKPGDRVVVPFQISCGHCAMCDTGLPTQCETTQVRSQGSGAALFGYSELYGQVPGGQAEYLRVPYADHTHITVPEGPDDQRFLYLSDVLPTAWQAVEYAAVPDGGSVTVLGLGPIGDMACRVAAHRGYRVIGVDRVPERLSRVAARGIEVIDFSAVDADLGDVIRDRTDGRGTDAVIDAVGMEAHGSPIGSVAHRSAALLPDVVARKVMDTAGVDRLAALHEAIDIVRRGGTISLVGVYGGMVDPLPMRVLFDKQIQLRMGQANVTRWAPEILPLLTDDDPLGVDTFATHRLPLSKAPAAYEMFQQKADGAVKIVLDPAA

SEQ ID NO: 8381 - protein, 150 aa, Arabidopsis thaliana
  misc_feature (93)..(93): Xaa can be any naturally occurring amino acid
  misc_feature (106)..(106): Xaa can be any naturally occurring amino acid
  misc_feature (111)..(111): Xaa can be any naturally occurring amino acid
  misc_feature (116)..(116): Xaa can be any naturally occurring amino acid
  misc_feature (120)..(120): Xaa can be any naturally occurring amino acid
  misc_feature (123)..(124): Xaa can be any naturally occurring amino acid
  misc_feature (131)..(131): Xaa can be any naturally occurring amino acid
  misc_feature (133)..(133): Xaa can be any naturally occurring amino acid
  misc_feature (135)..(135): Xaa can be any naturally occurring amino acid
  unsure (1)..(150): unsure at all Xaa locations
ITSNGGRVNCMQVWPPIGKKKFETLSYLPDLTDSELAKEVDYLIRNKWIPCVEFELEHGFVYREHGNSPGYYDGRYWTMWKLPLFGCTDFAQXLKEVEECKKGVPXAFNLXSSGFXQQPXKVXXNKFSLPXRXPXFNRNFFAFTKTFPLN

SEQ ID NO: 8382 - protein, 868 aa, Zea mays
MAASPAAAAALLILFALGAAGGVAADGSDHRYKMYEPVPLYANKVGPFHNPSETYRYFDLPFCSPEKVKEKSEALGEVLNGDRLVDAPYKLDFRSEVESKAVCSKKLTKEDVVKFRNAVAKDYYFQMYYDDLPLWGFIGKVEKGGKADPSEWKYYLYRHIIFDILYNNDRVIEINVHTDQSALVDLTEDKETNVDFLYSVKWKETPTPFEKRMEKYSSSSNMPHHLEVHWFSIINSCVTVLLLTGFLATILMRVLKNDFVKYAHDEEAADDQEESGWKYIHGDVFRTTFIFLLALVGVFYPYNRGALFTALVVIYALTSGIAGYVATSFYSQLEGTNWVRNLLLTGCLFCGPLLLTFCFLNTVAIAYSATAALPFGTICVIVLIWTLVTFPLLVLGGIAGKNSKSEFQAPCRTTKYPREIPPLPWYRRTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMEDCPSAANLHGAAKVKSEVEWKGKEVASRRRCRLAANASPTHQGPRPDPVRAAVLRAIQLGYRHFDTAAHYATEAPIGEAAAEAVRTGLVASREDLFVTSKVWCADAHRDRVLPALRRTLSNLQMEYVDLYMVHWPVTMKAGRFTAPFTPEDFEPFDMRAVWEAMEECHRLGLAKAIGVCNFSCKKLETLLSFATIPPVVNQVEINPVWQQRKLREFCRAKGIQLCAYSPLGAKGTHWGSDSVCLRWVYEQGDCLIVKSFDEGRMKENLDIVDWELSEEERQRISKIPQRKINQGRRYVSEHGPYKSFEELWDGEI

SEQ ID NO: 8383 - protein, 321 aa, Oryza sativa (japonica cultivar-group)
MSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQARHVCLRWVYEQGDCLIVKSFDEARMRENLDIVGWELTEEERQRIAGIPQRKINRALRFVSDHGPYKSLDDLWDGEI

SEQ ID NO: 8384 - protein, 957 aa, Thermobifida fusca YX
MSDRSVSRPPALTFPDRHIGPDPAERAAMLETVGYASTADLMTAALPADILTAPDAPAPLRLPEPVGEAEVLAELRALAARNRLLVSMIGQGYYGTVTPPVIRRNILENPAWYTAYTPYQPEISQGRLEALLNFQTMVADLTGLPIAGASLLDEATAAAEAMTLARRVDKGKRSVFVVDADVFGHTLAVLRTRAEPLGIDLVVADLSAGLPDVDAFGVLVQYPAASGQVRDLRPVVDAAHERGALVVVAADLLALTVLRSPGEFGADVAVGSTQRFGVPMGFGGPHAAYMAVRDGLQRQLPGRLVGVSVDAAGKPAYRLALQTREQHIRREKATSNICTAQVLLAVMAGMYAVYHGPHGLRAIAERVHRRTAELAAGLRKLGVEVLTDAFFDTLRVRVPSRAAAVVRTARDLGINLFFADEDTVGVSCDETTTSEHVAAVLRAFGATTPPQTGDVPSALPEGLRRDVDYLTHPVFHTYRSETAMLRYLRRLADRDLALDRTMIPLGSCTMKLNATAEMEAITWPEFAELHPFAPLDQAEGLVQIVRDLETWLAEITGYDAVSLQPNAGSQGEFAGLLAIRGYHRSRGEEQRDICLIPSSAHGTNAASAVMAGMRVSVVACDSGGNIDLADLRAKIDAAGDRLAALMVTYPSTHGVYEETIAEVCRLVHEAGGQVYVDGANLNALVGWAKPGKFGADVSHLNLHKTFCIPHGGGGPGVGPVAVRAHLAPFLPNHPAHTEAGPHTSAGPVAAAPFGSASILPISWAYIRLMGEEGLRAATEQAVLAANYVARRLAPYYPVLYMGRNGLVAHECIIDLRGLQKRTGISNEDVAKRLIDYGFHAPTMSFPVPGTLMIEPTESEDLAELDRFIDAMIAIRGEIDRVAEGSYDRADNPLKNAPHTAEEVTADEWKHAYSRSEAAYPVPSLRASKYWAPVGRIDQAYGDRNLVCACPPPEAFAQ

SEQ ID NO: 8385 - protein, 273 aa, Propionibacterium acnes KPA171202
MSVPSITLNDGVAIPQLGFGTWKVPANEAEKAVSAALEAGFRHIDTAAIYGNEEGVGRALADSGLDRKDLFVTTKLWNSSHHADDARKAIETSLTKLGLDHVDLYLIHWPAPVKYGDAYIEAWNALQDFKSEGLTRSIGVSNFKTEHLDAIEGATPSVDQIEMHPSFNQATFRAELAERGINPEAWSPLGQSKDLDNPVLTDISKATGKTPAQVVIRWHLQIGNVVFPKSVTPSRIAENFDVFDFELSDEQIAAIDGLDHGNRLGGDPSTADF

SEQ ID NO: 8386 - protein, 522 aa, Magnaporthe grisea 70-15
MFGGLVEVRPLPLAGFLLGVYVAAWFIQAALMDYRIAKRGGGGVKAPRVASNMITAGIWFFWAGWRQMRNDLLSLYNSVYDKHGTPESPNCVEITLTTPGVRFILTREPEHVKTILTSKFSDFGKGYHFHKIWSPFLGDSIFTTDGQLWHDSRSLIRPMFIKEKVRDLDIFDRWTNEMINLLPPPGQSVDIANLLYRMTLDVTTDFLLGESVNALRDEHNEFAYYFNEIQRIQMMLTILVPAAPFLPRHRYYAGIKYIEKFMAPFIEQALALPPDELEKLSKTDKDFTFLHNIARYSRDRKVIRDQIMAVLLAGRDTTAATLSWTIYELCNKPEVVKRLRQEILRVVGPFGNKPTYENLKELKYLTHIINETLRIYPAVPYNIRAALEDSSLPSPDGKPSIAVLKGDIVVYSALSMQRRKDIYPEVSETFPDPAVYCPERWEHWTPKPWTYVPFNGGPRICVGQNFAMTEMAYVLVLIFQKFDRIEYCGDWDAQYHKAEIVGAPGHGVPVTLYPAVDDQVKE

SEQ ID NO: 8387 - protein, 406 aa, Rhodopirellula baltica SH 1
MSSSIELNTIPEAVEAIARGEVIIVIDAEDRENEGDFICAGEKATPELINFILGGRGQLCVSVLPEVCKRLELTPVVPQNNAPLQTAFMTPIDIATAKTGITAAERSETIRRLTDLEATQEDFVRPGHVYPLLAKEGGVLRRAGHTEAAIDLSRMAGLAPVGVLCEVLNETGDRASRDDLARLAKQHDLKIISIEHLIAHRRVSEKLVSRAATSKLPTRYGDFEVIVYEVNYEAQEPIALVYGDLTAPGTPPLVRMHSSCFTGDLIQSLRCDCGDQLHMALDMISREGRGALIYLPQEGRGIGLAQKIRAYALQDKGMDTVEANHALGFKADMRDYGVGLQILKDLGLSEVRLLTNNPKKTKAFNLRGFDLKVVDQVPIVPPTNEHNVRYLETKREKMGHQLPPLS

SEQ ID NO: 8388 - protein, 334 aa, Brassica napus
  misc_feature (213)..(213): Xaa can be any naturally occurring amino acid
  unsure (1)..(334): unsure at all Xaa locations
MTSDGATSTSAAAAAALATRRKPSWRERENNRRRERRRRAVAAKIYTGLRAQGNYNLPKHCDNNEVLKALCSEAGWVVEEDGTTYRKGHKPLSLPGDMAGSSSRATPYSSSYNQSPFESPILSYQVSPSSSSFPSPSRGDNISTIFPFLRNGGIPSSLPPLRISNSAPVTPPVSSPTNKHPKPLPTWESFTKQSMAIAAKQSMSSFNYPFYAXVSAPASPTHHRQFNAPATIPECDESDASTVDSGHWISFQKFSQQQQPFHGVSSAVPASPTFNLVKPPVPQRLSPNTAGIQEIGQSSEFKFENRQVTPWEGERIHDVAMEDLELTLGNTKGR

SEQ ID NO: 8389 - protein, 460 aa, Ralstonia eutropha JMP134
MKHLQRNLGARHIRFLALGSAIGTGLFYGSASAIQLAGPAVILAYILGGAAVYMVMRALGEMAVREPVSGSFGRYASEYLGPLAGFLTGWTYILEMIIVCLADVTAFGIYMGFWFPEVPQWIWVLGIVMLICGLNLCNVKVFGELEFWLALVKILAIGAMIIGGTLILFLGVKMNGEHSPGLTNLWAHGGFLPHGAGGLIASLAVVMFAYGGIEIIGITGGEAKEPEKVIPRAINAVPARILLFYVLTMVVLMAIFPWTGIGGQGSPFVQIFSGLGIKSAAAILNLIVISAAISAINSNIFGAGRMMFGMAEQGQAPRLFAITSRQGVPWVTVLAMAAALLGGVVLNYLIPEQVFVIIASIATFATVWVWLMILLSQVAMRRRLSAEEVRALKFKVPMWPVGPALAIAFMLFVICVLGYVEDTRVALYIGAGWVALLSLAWYLRAKPHEDRILTGESSAL

SEQ ID NO: 8390 - protein, 221 aa, Dunaliella tertiolecta
MFRNSAVSALRLGAIAFRRVDPTKVPNAMCRAYTQQNTGNSSSSAGKWAWTAGILGAGLLSSNHAFAAGPSTKERSFIAIKPDGVHRGMISNIISRFEQKGYKLVGIKVIVPGMDLAKAHYAEHEGKPFFNKLTSFLTSGPVVAMVWEGKEVIKYGRTMIGATNPLASAPGTIRGDFCVDMGRNMIHGSDGPESAQREIALWFQPSEIAEYESATQSWVYE

SEQ ID NO: 8391 - protein, 498 aa, Ralstonia metallidurans CH34
MPVIQPVKRPVIQPVILAGGAGTRLWPLSREQYPKQLLNLVANDTLLEATAARLEGVAARTGRPAGVEAPQIVVCGEEHRFMVADMLKRKGKRARVVSEPCGRNTAPALTMAALHAMASAGEGGDAVLVATPADHSVTDSDAFRDAIAAAVLHAERGAIVTLGVRPTAPETGFGYIRAAVPVPPGGFLIERFVEKPHLELAQHYVDSGEYWWNCGIFVVLASVWLKAVMQLQPEMHARCCAAYETGQPSESGKDDVFRIGQEAFDTCPSDSIDYAVMEKLDGLRGIPGMLVPMDAGWSDVGSWAAIWDIATKDNAGNAGRGRVLFDGASSCLAHSEGRLIACVGVQDVVVVETADAVLVVDKHHVQDVKNVVQRLRQEHGAEIVNHRKVHRPWGCYDSIDHGDRFQVKRIVVEPGASLSLQMHYHRAEHWVVVRGTARVTCGETTSILTENQSTYIPIGTLHRLENPGKTPLEIIEVQSGAYLGEDDIVRVEDNYGRK

SEQ ID NO: 8392 - protein, 558 aa, Pediococcus pentosaceus ATCC 25745
MAATIKWWQQAVVYQVYPRSFQDTNHDGIGDLKGITAHLDYLKQLGIDVIWLNPIYRSPNDDNGYDISDYQQIAADFGTMADFDELLQAAHDRGLKIIMDLVVNHTSDEHPWFKRSRQDRTNQYRDFYFWRSGNGKKAPNNWDAAFGGSAWQYDEQTQQYYLHTFSTKQPDLNWENPTLRESVYTMMTWWLNKGVDGFRMDVINQISKLPGLPDGPLKPHSQFGDARVTNGPRVHEFLQEMNQEVLSQFDIMTVGETHGVTPADALKYAGADQHELDMVFEFQHLRLDNSQHGLGKWSTRKTPLVALKKVISDWQVGLEGRAWNSLFWNNHDTPRAVSRFGDDRPAYRVRSAKMLATCLHLLQGTPYIYQGEELGMTDAHFTELASYRDIESLSAYRDLVTERQLLSPADMMARLAARSRDNSRTPMQWDTEVNAGFSDAAPWLTVNPNYRQINAAAALADPDSVWYYYQHLIQLRHQYPSVTLGSFELLWADDPQVFLYARQWEGRTWLVCCNFTAETLSRPLDQYLTPTAKCLISNYGEQQPNKLRPYEAWVYQLA

SEQ ID NO: 8393 - protein, 383 aa, Streptomyces coelicolor A3(2)
MTPTTETTVGIGGAAESTDMVLNIGPQHPSTHGVLRLKLVLDGERITSAEPVIGYMHRGAEKLFEARDYRQIIMLANRHDWLSAFSNELGVVLAVERMLGMEVPTRAVWTRTLLAELNRVLNHLMFLGSYPLELGGITPVFYAFREREVLQNVMEEVSGGRMHYMFNRVGGLKEDLPAGWTTRARGAVAAVRSRMDVFDDLVLGNEIFRGRTRGVGALSAEAVHAYGVSGPVARASGVDFDLRRDEPYLAYGELQDTLKVVTRTDGDCLARFECLLAQTHNALDLADACLDRLAELAPGPVNQRLPKVLKAPEGHTYAWTENPLGINGYYLVSKGEKTPYRLKLRSASYNNIQALAELLPGTLVADMVAILGSLFFVVGDIDK

SEQ ID NO: 8394 - protein, 488 aa, Pisum sativum
MILEMGSMWVVLMAIGGALLVLRSILKNVNWWLYESKLGVKQYSLPPGDMGWPFIGNMWSFLRAFKSKDPDSFISSIVSRYGSSGIYKALMFGNPSVIVTTPEGCKRVLTDDEKFTTGWPQSTIELIGKNSFIAMTYEEHKRLRRLTSSSINGMEALSLYLKYIEENVIISLEKWSNMGQIEFLTEIRKLTFKIIMHIFLSSESEPVMEALEKEYTILNHGVRAMQINVPGFAYYKALKARKNLVGIFQSIVDDRRNIRKVYSQKKAKDMMDSLIDVEDDNGRKLNDEDIIDIMLMYLNAGHESSGHITMWATYFLQKHPEYLKKAKEEQEEIIKRRPSTQKGLTLKEIRGMDFLYKVIDETMRVITFSLVVFREAKSDVTINGYTIPKGWKVLTWFRSVHLDPEIYPNPKEFNPNRWNKEHKAGEFLPFGAGTRLCPGNDLAKMEIAVFLHHFTLNYRLEQLNPKCPIRYLPHTRPMDNCLGRVKKC

SEQ ID NO: 8395 - protein, 313 aa, Streptococcus pyogenes MGAS8232
MKTSEKIYQLLSQTDDFVSGEYLADQLSISRTSVWKSIKSLENQGIQIDSLKHKGYRMVQGDILLPKTISQGLGMPVTYTPHSQSTQLDAKQGIEAHNSAPRLYLAPSQEAAKGRLDRQFFSASTGGIYMSMYLKPNVPYADMPPYTMMVASSIVKAISRLTGIDTEIKWVNDIYLGNHKVAGILTEAITSVETGLITDVIIGVGLNFFVTDFPEAIAQKAGSLFTEKPTITRNDLIIDIWKLFLSIPVKDHVKVYKEKSLVLNKQVTFIENSQEKRAIAIDLTDQGHLIVQFDNGDLQTLRSGEISLSSWEN

SEQ ID NO: 8396 - protein, 490 aa, Pisum sativum
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 8397 - protein, 840 aa, Synechococcus sp. WH 8102
MTSSQPLDLRLPTPGCYNDPERAGLDAKSVFDGMTEHLFFTLGKLAPTASRHDLYMALSYAVRDRLMMRYLATTEAMRAHPQKSVAYLSAEFLIGPQLNNNLLNLGIQQEAEAALRNFGIESLQQILDVEEEPGLGNGGLGRLAACYMESLASLKIPATGYGIRYEFGIFDQLIRDGWQVEITDKWLKGGWPWELPQPDEACFVGFGGRTESYIDDKGSYRSRWIPAEHAIGIPHDVPVLGYRVNICDRLRLWRADATESFDFYAFNIGDYYGAVEEKVGSETLSKVLYPNDGTDEGRRLRLKQQHFFVSCSLQDMLRSLDNRGLPVEDFPKYWTVQLNDTHPAIAVAELMRLLIDDRHMDWDKAWDITSRSVAYTNHTLLPEALEKWDLNLFSSLLPRHLELIYEINRRFLQQLRLRYPGNDAIQRKLSIIDEDGSKAVRMAHLATIGAHHVNGVAALHSDLVKTDLLPEFAELWPEKFTNVTNGVTPRRWVALANPELSTLLNEHIGEDWISNMENLRKLEERQNDQGFLEHWGNTKLSVKRKLASYIHRNTGVLVDPSTLFDVQVKRIHEYKRQHLNVLQVITQYLRIKNGQADGMAPRTVIFGGKAAPGYYMAKLIIRFINGIAETVNADPDMDGRLRVVFLPDYNVKLGEQVYPASDLSEQISTAGKEASGTGNMKFAMNGALTIGTLDGANVEIRELVGAENFFLFGKTVEEINDLKRSGYNPGAFINAMPELQEALRLIEMGHFSNGDSELFRPLLDNLTGHDPFFVMADFADYLRAQEAVSLAWTDRMHWNRMSLLNTARTGFFSSDRSIGEYCENIWNVGPLNVDITCDVR

SEQ ID NO: 8398 - protein, 458 aa, Synechococcus sp. WH 8102
MLLPALLSEISSHDFEVAETLIGVLRFVLIFVAARSLAELLVRFELPTILGELLAGVIIGASGLHLLVPPETQVQLSGVFSNVVGGIAHIPPDEIPEIYNESFGALQAVSNLGLFSLLFLTGLESELEELIAVGAQAFSVAVVGVVLPFALGTLGLMGIFHVDPVQAIFAGASMTATSIGITASVFGELGYLRTREGQIVIGAAVLDDILGIVILAVVVSLAAGGTLEIAPIVQLVVAAVLFVVVALVLSQKAAPAFDWVVDQLKAPGGKLIGSYLLLGASCFIATAIGLEAALGAFAAGLIASTSKHRHEIQAAVTPIVGLFATVFFVLVGAGMDLSVINPSDPSARSALVIAGFMFLVAIVGKVVAGWAVFGPQKTNKLVVGLGMLPRGEVGLIFLGLGTAAKLLSPGLEIAILLMVIGTTFLAPVLLRLVLKDKPPEDGNEVPEEFAADPLAGAS

SEQ ID NO: 8399 - protein, 461 aa, Zea mays
FGSRDCVRLNFSHGTQEDHRKLFNLVKSLSVKYQHQVSIMCDIQGPKIRTGRMEKPFEIRAGEKIDVTPEDVLGTPQLIQIKYATMLKDLDAGDVIFINDGIIKLTVESKSEKALHCVCNAGGQISDRKGCNIPSGNISLDVVTPKDDKDLQLIAELNPEYVASSFIGTAEDVLKVKKVLAGYGNTNIKIISKIERPVALENIDAIIEVTDGLMVARGDLGVEIDTWDVPSAQKMLCQKANAAGKPVIVATQMLESMTQNSRPTRAEANDVYNAVLDGADAVMLSGETATGKYPIAAIQVMDKIVEAAEGHMPERLSTNFLSTKVGMTETIALSVYETAKNFTRIGRKCKIIVITYPPSAYTARMVSKFRPPADVITITSDLRIAREINLLWGVRSVHFPELSEENNMEVRNLTAIKKLIEVGLVQLDNYVICVSRSLFGKHTGACSNVYCLPVLKEEGLL

SEQ ID NO: 8400 - protein, 291 aa, Prochlorococcus marinus str. NATL2A
MGGDNTLNDFRHIPRKRFGQHWLKDQGVLDQIVKAAELNPEDCVLEVGPGKGALTEKLIESQARFIQAIELDRDLVVGLKKRFSHQNKFSLREGDILSAPLDAENGLTINKVVANIPYNITGPLLKRLIGELRKAPDNCFETLVLLMQKEVAQRLLARPGTSNFSALSVRIQLLAKCQDVCDVPSKCFQPAPKVDSKVVMIKPFASIDPDFYEVGNLLEKLLKHAFAGRRKKLRNTIGSFVTSNDQIKEFFAYRGISLDQRPQEISPSNWFGLAKALKETCVIENGTFQSK

SEQ ID NO: 8401 - protein, 255 aa, Haemophilus somnus 2336
MARRPLVMGNWKLNGSKAFTKELITGLKDELNAVSGCDVAIAPPVMYLAEAEAALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSINDANAAELFTQPDIDGALVGGASLKASAFAVIVKAAAKAKN

SEQ ID NO: 8402 - protein, 139 aa, Nocardia farcinica IFM 10152
MTEQTLVLIKPDGVSRGLVGEVLARIERKGLKIAALELKQVSDELAREHYAEHADKPFFGSLIEFITSGPVVAAVLEGPRAIAAFRQLAGGTDPVEKAAPGSIRGDFGLETQYNLVHGSDSPESAKREIGLWFPEFPVA

SEQ ID NO: 8403 - protein, 524 aa, Candida tropicalis
MATQEIIDSALPYLTKWYTVITLAALVFLISSNIKNYVKAKKLKCRDPPYFKGAGWTGISPLIEIIKVKGNGRLARFWPIKTFDDYPNHTFYMSIIGALKIVLTVIQENIKAVLATQFTDFSLGTRHAHFYPLLGDGIFTLDGEGWKHSRAMLRPQFARDQIGHVKALEPHIQILAKQIKLNKGKTFDIQELFFRFTVDTATEFLFGESVHSLYDEKLGIPTPNEIPGRDNFATAFNTSQHYLATRTYSQTFYFLTNPKEFRDCNAKVHYLAKYFVNKALNFTPEEIEEKSKSGYVFLYELVKQTRDPKVLQDQLLNIMVAGRDTTAGLLSFAMFELARHPEIWSKLREEIEVNFGVGEESRVEEITFESLKRCEYLKAILNETLRMYPSVPVNSRTATRDTTLPRGGGPNGTDPIFIPKGSTVAYIVYKTHRLEEYYGKDADDFRPERWFEPSTKKLGWAYVPFNGGPRICLGQQFALTEASYVITRLVQMFETVSSPPDVEYPPPKCIHLTMSHDDGVFVKM

SEQ ID NO: 8404 - protein, 507 aa, Candida tropicalis
MIEQVLHYWYYVLPAFIIFHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 8405 - protein, 517 aa, Candida tropicalis
MYEQVVEYWYVVLPLVFILHKVFDMWHTRRLMKQLGAAPVTNQLHDNFFGIINGWKHLSSRKKVELKNIMIINLPIRKFQVWVHMLVPSLEQSSSSQKIRRNIKALLATQFSDFSLGKRHTLFKPLLGDGIFTLDGQGWKHSRAMLRPQFAREQVAHVTSLEPHFQLLKKHMVKNKGGFFDIQELFFRFTVDSATEFLFGESVHSLKDETIGSYQDDIDFVGRKDFAESFNKAQEYLAIRTLVQDFYYLVNNQEFRDCNKLVHKFTNYYVQRALDATPEELEKQSGYVFLYELVKQTRGPNVLRDQSLNILLAGRDTSAGLLSFAVFELARNPHIWAKLREDVESQFGLGEQSRIEEITFESLKRCGYLKAFLNETLRVYPSVPRNFRIATKNTTLPRGGGSDGNSPVLVKKGEAVSYGINSTHLDPVYYGDDAAEFRPERWNEPSTRKLGWAYLPFNGGPRICLGQQFALTEAGYVLVRLAQSFDTLELKPPVVYPPKRLTNLTMSLQDGTIVKID

SEQ ID NO: 8406 - protein, 506 aa, Candida tropicalis
MSLTETTATFIYNYWYIIFHLYFYTTSKIIKYHHTTYLMIKFKASPPLNYINKGFFGIQATFTELKHLICHTSIDYAIDQFNNVPFPHVHTFVTKVLGNELIMTKDPENIKVLLRFPVFDKFDYGTRSSAVQPSLGMGIFTLEGENWKATRSVLRNMFDRKSIDKVHDFEPHFKTLQKRIDGKVGYFDIQQEFLKLGLELSIEFIFGQVVSEDVPHYDDFTQAWDRCQDYMMLRLLLGDFYWMANDWRYKQSNQIVQAFCDYLVQKSLENTCNDKFVFVHQLAKHTTNKTFIRDQALSLIMASRDTTAELMAFTILELSRKSHHLGKLREEIDANFGLESPDLLTFDSLRKFKYVQAILNETLRMYPGVPRNMKTAKCTTTLPKGGGPDGQDPILVKKGQSVGFISIATHLDPVLNFGSDAHVFRPDRWFDSSMKNLGCKYLPFNAGPRTCLGQQYTLIEASYLLVRLAQTYETVESHPDSVYPPRKKALINMCAADGVDVKFHRL

SEQ ID NO: 8407 - protein, 572 aa, Wolbachia endosymbiont of Drosophila melanogaster
MHSGSQHLFDIIILLSAAVFIVIAFWKMNISPVLGYFVAGAVIGSHGFNLIHSAEAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMESNEIFISTTLLIVLGAAFITEQFHLSLALGAFVAGLLVAETEYRHSVEHAVLPFKDLFLGLFFMTVGMSINTELLLNKLPLITLLSIILIVLKTSIIYILCRFFGFKSAPAIQAGLLLSQGGEFAFILFRLADELNVLPSEIAQVLMMVTTVTMAFTPLLSGLGDWIANSFSTEKTILDDEAVETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHVNIVIRLPDLSNVEVYRDLGASKIIPETSEIGLQLGGAALSLSGISESGVTSLKSRFRKGNYSMLKDLGSDKDE

SEQ ID NO: 8408 - protein, 280 aa, Nostoc sp. PCC 7120
MSATLYQQIQQFYDASSGLWEEIWGEHMHHGYYGADGTEQKNRRQAQIDLIEELLTWAGVQTAENILDVGCGIGGSSLYLAGKLNAKATGITLSPVQAARATERAKEAGLSGRSQFLVANAQAMPFDDNSFDLVWSLESGEHMPDKTKFLQECYRVLKPGGKLIMVTWCHRPTDKTPLTADEKKHLEDIYRVYCLPYVISLPEYEAIARQLPLNNIRTADWSQSVAQFWNIVIDSAFTPQAIFGLLRAGWTTIQGALSLGLMRRGYERGLIRFGLLCGDK

SEQ ID NO: 8409 - protein, 488 aa, Bacillus halodurans C-125
MMNKDQALIFELSKPGRVGHSLPELDVLEQPVETLIPAEFLREEAPELPEVSELQLMRHYTALSKRNHGVDSGFYPLGSCTMKYNPKINEDVARYPGFANIHPYQPEAQVQGALRLMYELQTALAEITGMDEVTLQPAAGAQGEWTGLMLIRAYHEANGDTNRTKVIVPDSAHGTNPASATVAGFESVTVRTDEDGLVDLDHLREVVGEDTAALMLTNPNTLGLFEAHIVEMAAIIHEAGGKLYYDGANSNAILGIARPGDMGFDVVHLNLHKTFTGPHGGGGPGSGPVGVKKELIPYLPKPVVVKDGDSYRLDYDRPHSIGRVKPYYGNFGINVRAYTYIRTMGPEGLRTVSEYAVLNANYMMRRLAPYFDLPYDQHCKHEFVLSGRQQKKLGVRTLDIAKRLLDFGYHPPTIYFPLNVEECLMIEPTETESKETLDEFIEAMIQIAKEAEETPEVVQEAPHHTVIGRLDETTAARKPILRYEKITQ

SEQ ID NO: 8410 - protein, 447 aa, Bacillus halodurans C-125; identical to SEQ ID NO: 378

SEQ ID NO: 8411 - protein, 651 aa, Blastopirellula marina DSM 3645
MHSTPPASDHTREATALRRLLPRLKKTFADRIEPNEWETYTRRIDEHFPELFRQLYALYGHQYDFYFHLEGILTSITEMWLDRPSELKALDALREADPQWYQSQRMTGAMCYVDLFAENLQGVRDNIPYLTEMGITYLHLMPVFRSPKGDNDGGYAVSSYREVNPALGNMEELADLASELRHRGISLCLDFVLNHTSDEHEWARKALLGDLECQEYYRMYPDRSMPEAFEKSMGAIFPEEHPGAFTYRSQLRKWIWTTFHNYQWDLNYENPALFNRMIEEALFLANQGVEILRMDAVAFLWKRLGTTCQNLPEAHSILRAMNAAVRIAAPAMVFKSEAIVHPDDVRSYISEKECQLSYNPQLMALLWNSLATRETRTLRDALEKRFRIDPGCEWVNYVRCHDDIGWAFSNEDVEGAGFDASSHRRFLTDFYCGKFEGSFARGLPFQEDPITGDARVSGTCASLAGLEKAIAEKSDKEIDLAIKRIHLLHGVIMTIGGIPLIYLGDGIASLNDYAYEQDVDKLGDTRWVHRGKFDWDRAKERHDPESIVGRVYEDILRLVHLRGQTRALNRAQTEFVDAGNIHVLGYFRNAVDSSVLVLANFSEEEQQIEGRHLRMLGLRKTVIDILSGQTVTATHELKMGPYQMLVLMRPS

SEQ ID NO: 8412 - protein, 294 aa, Escherichia coli O157:H7 EDL933
MEGLTVEFSVLSNNLKMPMMGFGVFQVTDKNVCKQSVLNAIRTGYRLIDTAAVYGNEDAVGEAVREAISEGLCTREELFITSKLWVQDMLNQDTAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 8413 - protein, 796 aa, Ustilago maydis 521
MGRQQRKEDRQARKRTKISATQSHAKNASASSNAVGKQTNNAGFVFNKNQFASLINKGKAKQQQMQQRQHVATQAQTANSNRANTHMDVAAFDAAEASAAAAARLRGEIAGAAATSNSHDLDSDRMHDDLDTSFAPPGSLLDPMLTGRRDSSIKAYMRELRKVVDNADVLLQVLDARDPLGCRSLETERMLLRAGKKIVLILNKIDLVPKSNVEAWLKYLRHDFPTLAFKASTQSQRTNLSQGALTVNSSAKGGADVITGGSEAIGAGALLQLIKNYSRSLNLKTSIAVGVFGAPNVGKSSLINSLKRARVCSVASTPGHTKVVQSVMLDKSVRLLDCPGIVFSDESVSGAASLGLSSQEIQIRRQSALLRNVVKVELVQDPITPVEAIMARVEPAHLMSVYGLEWFQQGDAQDLLMRIAVQRGRMGRGGKIDIQGTARSVLHDWNVGRIQYYTHPPALHRSAILSEHNAPVDALTKSIGGQEQDVNKQLEKSSKILSGFSEAFDLAGLLGEADAEVFGVGTGESLNLPDAPAPRYAQEEEEDEIDDPQSVTTRLVEVPRPTSAEADTSRRSTLGKRSRLSDPQDSDSDDDFSAIPSHRRVPGLDPGADDDDDDPIHADLASQNDLVPDPTNINAWNDKLATKASAISVSSKRNAELSLAFSAQELAQMAPLSGAARRKMKKLKKRADRAGAGLVGQFEHQKLEESDAAFAKSEIELVKGVGGGMFGNLAKTTKTGQEKERNTTEKQRATGSMFDVLLEGQDMDSEEQDEEQEQEKEKAVPTAGGAAAEDDYEEEL

SEQ ID NO: 8414 - protein, 298 aa, Zea mays
  misc_feature (163)..(163): Xaa can be any naturally occurring amino acid
  unsure (1)..(298): unsure at all Xaa locations
MAAAPSSLASSHLSPIAAVSTPAVPHQLRIGCSRRRAGRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQXVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 8415 - protein, 525 aa, Methanothermobacter thermautotrophicus str. Delta H
MSRMKVLIADSINEKGISELEEVAEVVVNTTITPEELLDAIKDFDAIVVRSRTKVTREVIEAAPRLKIIARAGVGVDNVDVKAATDRGIMVINAPESTSITVAEHSIGLMLALARKIAIADRSVKEGKWEKNRFMGIELNGKTLGIIGMGRIGSQVVVRTKAFGMDIMVYDPYISKEAAEEMGVTVTDLETLLRESDIVTIHVPLTPETRHLISEDEFKLMKDTAFIVNCARGGIIDEDALYRALKDGEIAGAALDVFEEEPPEGSPLLELENVVLTPHIGASTSEAQRDAAIIVANEIKTVFQGGAPRNVLNMPVMDSETYKSLKPYIELAEKMGAIIAQALPGNIEKLDVTYCGELAEMQFDILTRTMLQAILNPILTEPVNLINAPSIAKKRGIMVTEARRSESDGYRSIIIATAESDRGGFSVEATHIKEPTIIGINGYRVDVKPEGTMIIARYRDLPGTIGAIGTKLGQHGINIATMQVGRKEIGGEAVMVLKVDQSVPAEVIEEVKKLDNVDDAVAIEI

SEQ ID NO: 8416 - protein, 332 aa, Escherichia coli
  misc_feature (1)..(1): Xaa can be any naturally occurring amino acid
  misc_feature (109)..(109): Xaa can be any naturally occurring amino acid
  misc_feature (166)..(166): Xaa can be any naturally occurring amino acid
  misc_feature (194)..(194): Xaa can be any naturally occurring amino acid
  misc_feature (279)..(279): Xaa can be any naturally occurring amino acid
  misc_feature (318)..(318): Xaa can be any naturally occurring amino acid
  unsure (1)..(332): unsure at all Xaa locations
XKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLXDPLDGSSNIDVNVSVGTIFSIYRRVTPVGTPVTEEDFLQPGNKQVAAGYVVYGSSTXLVYTTGCGVHAFTYDPSLGVFCLCQERXRFPEKGKTYSINEGNYIKFPNGVKKYIKFCQEEDKSTNRPYTSRYIGSLVADFHRNLLKGGIYLYPSTASHPDGKLRLLYECNPXAFLAEQAGGKASDGKERILDIIPETLHQRRSFFVGNDHXVEDVERFIREFPDA

SEQ ID NO: 8417 - protein, 527 aa, Archaeoglobus fulgidus
MKVLVAEPISEEAIDYMRKNGLEVEVKTGMSREELIREVPKYEAIVVRSQTKVDAEVIQAAKNLKIIGRAGVGVDNIDINAATQRGIVVVNAPGGNTISTAEHAIALMLAAARKIPQADRSVKEGKWERKKFMGIELRGKTAGVIGLGRVGFEVAKRCKALEMNVLAYDPFVSKERAEQIGVKLVDFDTLLASSDVITVHVPRTKETIGLIGKGQFEKMKDGVIVVNAARGGIVDEAALYEAIKAGKVAAAALDVYEKEPPSPDNPLLKLDNVVTTPHIAASTREAQLNVGMIIAEDIVNMAKGLPVRNAVNLPSIEPSDFEFMMPFLTLAEKMGKIASVRLGGAIRKVKVTCSGKLATKNTEFVTRALLKGLFEPILSNEINLVSAKPVAVERGITIEESKVESVEHYESLLEVWVESNGKEMYLAGTCFGNEYRILKIDVYNVNFVPKGHYIISLHEDKPGVIGRVGTLFGRNNINIAGMIVGRSGDKPGGIQLMLLLVDDPPTPEVLEEMTKLDGIIDATYVEL

SEQ ID NO: 8418 - protein, 1464 aa, Cryptococcus neoformans var. neoformans B-3501A
MFTKATSHLRPFIRLPSSHSPASPDHFTANPSLLHHLPQHGTSNSVIVQGQHSAQAGGASGHAGRTGYGGGAGAGGGYTGHARAFLSLPQTASFDPSSTLSDERKKDASSSSSSNTSLLLKHRLSKTPRIVHLNDSVRARRAIEERKGGKDFTVVELEDVPRIHRRDSIAEYTSGRLPLTSTSTRSLSRSHTSFDIFQVGIPQPRSIGLRALSTTSNAPRALEAEDIEAVEELELMTPRAGREVRTIGQPNRVLMDLAGRDLPSTVTAGWQLGGIRRNSTAAVERPSLDLPPADLSSIATHEQKEDKQREEAILQALRQAKQNGNAELVKNLITHYRSPRSLPPFSPDSLPGVPELSKHYPLPSGYSIRIYNACLIAALAIRSPGQSIAPILEIYNELLEKDMIPDSMTYGAVIRALAMRERDVRGSQEIWERQKTWGLWRSEISGNQTWDPEVAAENDANIEAYLAENNVLSAVRLFRAAALTGQAGRFVVSIHGTVLDALSKLEKPDVTVMEQLVEHAESHEVPGIISLYKHLFLAYAKIKDASALSQVWNKYRGLAKTASREDWAAACGQREAYDVRIEGAMREPWDIVISAFIEVGELSKAFEVFGEMAEVAEKKTKGEVPPATHRTCGVLVTALARAGEFDLALEWFNSLQASAIVTQNSPHRLTLEHTIVLAEQLLLKGRWFDAADVVIGLGGIRDELAQPSAQHSLRTVAWKTNFALIHHAARSIPEEAARTLARAQEVLAAVPIQLDLRTVVLHLTLLAQASDYTNMIRVVDLISARKLPANTIQRLNDACDQIAKEDIPFKYRIELIKAFGRHHADLTPFVAEKLIQAYISEKGRPVDERDLSKESLYILLDAFTVVEQKQVNEGEYDEALEQLMQDLAATDVSEDMKNANSNQAVGYLVKNVIFRFGAERARSMLGAVFGEQEATNLVQPVSPTFIQSETVSGSERPSEAASPSQSHASSATSAPALSFSQTLTSSIERFTYRNPTITPLEAYALLRDGLSVSQVPRLEIILSLMDHLARRNDEPKVRELYELAQVVLNSLVRPDVQAQSWYSAENAMLIACCHLGYLEEAGLHRARIVQAGFTPSADAYATMIASSKDTTDDALVARELWEEALGMGVKPHLFLYNTVISKLSKARKAESALDLFMRMKSERIRPSSVTYGAVINACCRVGDALSAETLFEEMTSQPNFRPRVPPYNTMMQFYLQTQPNRERFLYYYGALQRARVPPSAHTYKLLIDAYATLPPIDIPAMELVFAHLIADKSVRVQGTHWASLISAYGIHAGDAKRAKEVFDKIPEKGGDYEAVVWEAWLNVLSQQGTIEQLEEAHTRMLESGVQPTAYVYNVLINGYARAGNIGRAREVFESMGDSITGVAAPNNHPVLLTSSGHAKPSTQAATTGVVYREPSTYESMIRAEITCGDQQRAAEVLQRMEERGYPMAVYMRGKAALEGEPPKF

SEQ ID NO: 8419 - protein, 368 aa, Marsilea quadrifolia
QTAASRPLSVKATATEIPSKVHKSSSKNVVRIGINGFGRIGRLCLRVALARDDIEVVAVNDPFIDTKYMAYMFKYDSTHGIYKDEIKAVDESTLQIGGQRVKVFGKRDPSEIPWGSAGADFVVESSGVFTTIEKASSHLKGGAKKVIISAPSADAPMFVMGVNEETYKPDMQIVSNASCTTNCLAPLAKVVDQEFGIVEGLMTTVHATTATQKTVDGPSGKDWRGGRGAAQNIIPSSTGAAKAVGKVLPQLNGKLTGMAFRVPTPNVSVVDLTCRLEKGASYDDVKAAVKAASEGSMKGILGYTEDDVVSTDFVGDSRSSIFDAKAGIALNKNFIKMVTWYDNEWGYSNRVVDLISHIAAVVAANKGN

SEQ ID NO: 8420 - protein, 131 aa, Medicago truncatula
MVTPGSDAPKVAPEVVAEHTVRALQRTVPAAVPAVVFLSGEQSEEEASVNLNAINQVNGKKPWTLSFSFGMALQQSTLKAWSGKEENVKAAQEALLTRAKANSEATLGTYKGNSKLGAGASESLHVKDYKY

SEQ ID NO: 8421 - protein, 252 aa, Medicago truncatula
MQNNNTNNGGGGMDELLAVLGYKVRSSSDMADVAEKLEQEGINHLSSDTVDELIANAAYIGTPGKGILAADESTGTIGKRLASIGVENVESNRRALRELLFTAPGVLQYLSGVILSEETLYQSTTAGKPFVDVLNEAGVLPGIKVDKGTVELAGTDGETTTQGLDGLGARCAKYYEAGARFAKWRAVLKIGPNEPSEHSIHENAYGLARYAVICQENGLVPIVEPEILVDGPHDIQKCAAVTEKVLAACYKA

SEQ ID NO: 8422 - protein, 526 aa, Dehalococcoides sp. BAV1
MKKVLVSDALSATGLAPLKEIAQVDVKTGLKPEELISIIGEYDALLVRSQTQVTADIINAGKKLQVIGRAGVGVDNIDLKAATGNGIIVVNAPTGNTISATEHTLALMLAMARHIPRANASLKSGQWKRNEFVGSELKGKTLGIVGLGNIGSEIAKRALALEMRVIGYDPFISMERAKKLQVELLPFEDLLKQADFITLHVPMTGQTKGLIGPKELEMMKPTVRLINTSRGGIIDEEALAKAVKEKRIGGAAIDVFSKEPCTESCLFECDNIIVTPHLGASTAEAQELATSDVVKQVIDVFEGRPARYAVNAPYISAESLPVVGPFMPVARTVGSLVSQLTDGHMKNVTIKYCGELAAYDTTALKALVLGGILEHISEERVNVVNADIVASQRGLGVTEQKESTCQNFSSLITVTIDTDNGKSNTVAGSLVRGDVHIVKLNDYWIDIVPTGGYFLFADHIDRPGLIGSAGKITGDADINISYMHLSRQKARGQALMILALDEPLPEKQRQQLLSLPDVQMVQVVKI

SEQ ID NO: 8423 - protein, 446 aa, Pediococcus pentosaceus ATCC 25745
MAKKNYSQADIRQMAKDENVRFLRLMFTDLFGIIKNVEVPISQLDKLLDNKLMFDGSSIDGFVRIEESDMYLYPDLSTWMVFPWGSEHGKVARIICEVYSNDRKPFVGDPRNNLIRVLQEMKDAGFTDFNIGPEPEFFLLKLDENGKPTTNLNDKGSYFDLAPVDLGENCRRDIVLELENMGFDVEASHHEVAPGQHEIDFKYADALTAADNIQTFKLVVKTVARKYNLHATFMPKPMDGINGSGMHLNMSLFNKEGNAFYDEKGDLQLSQNAYWFLGGLLKHARSYTAVCNPIVNSYKRLVPGYEAPVYVAWSGSNRSPLIRVPSSKGLSTRFEVRSVDPAANPYLAIASVLEAGLDGIRNKIEPEDSVDRNIYRMNIQERNEEHITDLPSTLHNALKEFQNDDVMRKALGDHIFQSFLEAKKLEWASYRQEVTQWERDQYLEMF

SEQ ID NO: 8424 - protein, 228 aa, Pediococcus pentosaceus ATCC 25745
MDQNELKKLVGEEAVKFIEDGMTVGLGTGSTVKFMVDALGERVKNENLNIVGVPTSDRTAEQARSLGINVKSVDEVDHIDLTIDGADEISSDFQGIKGGGAAHLFEKIVATNSKKVMWIVDESKMVDHLGAFPLPLEVIPYGSKQVFKKLEKEGLHPEFRKNDAGEYVLTDSKNYVIDLHLGEIKHPHQLADYLIKQVGIVEQGLFLDMVNTVIVGRQNGPEVLTARP

SEQ ID NO: 8425 - protein, 358 aa, Medicago truncatula
MSNFKSKYHDELIANAAYIGTPGKGILAADESTGTIGKRLSSISVENVESNRRALRELLFTAPGVLQYLSGVILFEETLYQSTAAGKPFVDVLNEAGVLPGIKVDKGTVELAGTDGETTTQGLDGLGARCAKYYEAGARFAKWRAVLKIGPNEPSEHSIHENAYGLARYAVICQENGLVPIVEPEILVDGPHDIQKCAAVTEKVLAACYKALNDHHVLLEGTLLKPNMVTPGSDAPKVAPEVVAEHTVRALQRTVPAAVPAVVFLSGGQSEEEASVNLNAINQVNGKKPWTLSFSFGRALQQSTLKAWSGKEENVKAAQEALLTRAKANSEATLGTYKGNSKLGAGASESLHVKDYKY

SEQ ID NO: 8426 - protein, 589 aa, Lactobacillus delbrueckii
MKKTKIVSTLGPASDDIETITKLAEAGANVFRFNFSHGNHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELVCEAQNTGVIGSKKGVNAPGVEIRLPGITEKDTDDIRFGLKHGINFIFASFVRKAQDVLDIRALCEEANASYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVQSVQAMHDIDVRTEKELDTRNTLALQRFEEYKGSNVTEAIGESVVRTAQELGVKTIIAATSSGYTARMISKYRPDATIVALTFDEKIQHSLGIVWGVEPVLAKKPSNTDEMFEEAARVAKEHGFVKDGDLVIIVAGVPFGQSGTTNLMKLQIIGNQLAQGLGVGTGSVIGKAVVANSAEEANAKVHEGDILVAKTTDKDYMPAIKKASGMIVEASGLTSHAAVVGVSLGIPVVVGVADATSKIADGSTLTVDARRGAIYQGEVSNL

SEQ ID NO: 8427 - protein, 505 aa, Helianthus tuberosus
MEIPYLLTTTLLLLFTTLYLLLRRRSSTLPPTIFPSLPIIGHLYLLKPPLYRTLAKLSAKHGQILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 8428 - protein, 248 aa, Pediococcus pentosaceus ATCC 25745
MNNNEVELNDKIELILSRERKELAKLVLIRHGESTANRDNIYTGWSDVPLTPLGIKQAQRAGKLIAKLGINFDMVHTSMLKRAIVTANIVLDDLNQNWLPINKTWRLNERHYGALRGQNKDETRQIYGKEQVALWRRSFDAVPPLLEHPDDDRRYAVNGILNEPLGESLHMAYNRLLPYWIDQIAPRLMEGQNQLVVAHGSSLRALIKYLENISDQGIDGVEVENGEPIIYELKSDLSIQNKIILKEA

SEQ ID NO: 8429 - protein, 485 aa, Prochlorococcus marinus str. NATL2A
MKILDLARRTKIVATIGPATESASQISKLVEAGATTFRLNFSHGDHEEHAQRIKTIRKVSDDLGIHIGILQDLQGPKIRLGRFKNGPVNVKNGDKFILTSKNIDCNQDQANVTYDKLAEEVNVGNRILLDDGRVEMKVEEVDLKEQRLICSITVGGVLSNNKGVNFPDVQLSIRALTDKDKKDLAFGLKQGVDWVALSFVRNPSDLIEIKDLIRNHGYDTPVVAKIEKFEAIDQIDAVLKLCDGVMVARGDLGVEMPAEEVPLLQKQLIKKANSLGIPIITATQMLDSMASSPRPTRAEVSDVANAILDGTDAVMLSNETAVGDYPIESVATMATIAKRIERDYPQKALESHLPSTIPNAISAAVSSIARQINAAAIIPLTKSGATAKNVSKFRPPTPVLAVTNEKSVASTLQLVWGVTPLLIENQTSTSKTFDDAMNMAKKMKILKQGDLVVETAGTLSGVSGSTDLVKVGIVSSEDENESLFI

SEQ ID NO: 8430 - protein, 271 aa, Thermus thermophilus HB8
MSKLASPQSVRALLERHGLFADKRFGQNFLVSEAHLRRIVEAARPFTGPVFEVGPGLGALTRALLEAGAEVTAIEKDLRLRPVLEETLSGLPVRLVFQDALLYPWEEVPQGSLLVANLPYHIATPLVTRLLKTGRFARLVFLVQKEVAERMTARPKTPAYGVLTLRVAHHAVAERLFDLPPGAFFPPPKVWSSLVRLTPTGALDDPGLFRLVEAAFGKRRKTLLNALAAAGYPKARVEEALRALGLPPRVRAEELDLEAFRRLREGLEGAV

SEQ ID NO: 8431 - protein, 366 aa, Photobacterium profundum SS9
MTLSNLSSFFTCRVTKDSVILPPVIFHNKLSRGATVMTIKVGINGFGRIGRFVFRASVERNDIEVVGINDLIDVEYMAYMLKYDSTHGRFNGTVEVVDGNLVVNGNTVRVTAVRNPEELKWDEIGVDVVAEATGLFLTDETARKHITAGAKKVVLTGPSGDVPMFVMGVNSADYAGQDIVSNASCTTNCLAPIAKVINDKWGIESGLMTTVHATTATQKTVDGPSMKDWRGGRGASQNIIPSSTGAAKAVGKVIPELNGLLTGMAFRVPTANVSVVDLTVNLKTAATYEEICAEMKRASENEFAGVLGYTEDAVVSQDFIGEVQTSVFDAKAGVALTDKFVKLVSWYDNEIGYSNKVLDLIAHVSK

SEQ ID NO: 8432 - protein, 409 aa, Thermus thermophilus HB8
MREEFLEEIPLDAPPEEAKELRTEVMTLNVGPQHPSTHGVLRLMVTLSGEEVLEVVPHIGYLHTGFEKTMEHRTYLQNITYTPRMDYLHSFAHDLAYALAVEKLLGAVVPPRAETIRVILNELSRLASHLVFLGTGLLDLGALTPFFYAFRERETILDLFEWVTGQRFHHNYIRIGGVKEDLPEEFVPELKKLLEVLPHRIDEYEALFAESPIFYERARGVGVIPPEVAIDLGLTGGSLRASGVNYDVRKAYPYSGYETYTFDVPLGERGDVFDRMLVRIREMRESVKIIKQALERLEPGPVRDPNPQITPPPRHLLETSMEAVIYHFKHYTEGFHPPKGEVYVPTESARGELGYYIVSDGGSMPYRVKVRAPSFVNLQSLPYACKGEQVPDMVAIIASLDPVMGDVDR

SEQ ID NO: 8433 - protein, 596 aa, Zea mays
MAEKQGDECGSFSAEEVIAKFERLTRDAAAVQRETLRRILADNAGAEYLRGLGLGGRTDPDSFRACVPLATHADMEPYIARIADEGDTSHVLTATPVTSISLSSGTTQGKRKYLLFNDDLFKCAMQTGQTSFAFRNRAFPVEDGKSLQFIYASRQFKTKGGLTATTATTNVYRHRDFKAHMRHTQSECCSPSEVLFCPDFAESLYCHLLCGLVLADDVRTVSATFAHSLVLAFRTFERVWEELCADIRHGAPSPTRVTNPAVRRAVSALLVAPNPALADEVARRCRGVVNWRGVIPALWPRARYVSSIVTGSMEHYVKKLRHYAGALPLVALDYGATEGMIAANVEPREPPESATFTVLPNIAYFEFIPLRLRGCDVAGAADARYTEADPVGLTDVAVGEHYEVVMTTFAGLYRYRLGDVVKVAGFYNSTPKLKVVCRRNLVLSINIDKNSEHDLQLAVDSAAKVLAAGAGRLEVVDYTSHADVSRDPGHYVVFWELSAEPDGDGHVLQSCCDELDRAFTDPGYVGSRKARAIGPLELRVLRRGTFQKVLRHYLSLGSPVNQFKLPRCVAPSSSAAGVLEILAANAVEAFFSTAYD

SEQ ID NO: 8434 - protein, 458 aa, Streptococcus agalactiae NEM316
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPDVPAWAFASFFALVIFGLNALSVRFFAEAESFFSSIKVIAIIIFIILGLGAMFGLVSFEGQHKAILFTHLTANGDFPNGIVAVVSVMLAVNYAFSGTELIGIAAGETDNPKEAVPRAIKTTIGRLVVFFVLTIVVLASLLPMKEAGVSTAPFVDVFDKMGVPFAADIMNFVILTAILSAGNSGLYASSRMLWSLANEGMLSKSVVKINKYGVPMRALLLSMAGAVLSLFSSIYAADTVYLALVSIPGFAVVVVWLAIPVAQINFRKEFLKENRLEDLSYKTPFTPVLPYITIVLLLISIVGIAWDSSQRAGLYFGVPFIILCYIYHKLRYKTW

SEQ ID NO: 8435 - protein, 275 aa, Bartonella henselae str. Houston-1
MTIHKAVKRITASEIRSRKGQEPIVSLTAYQAYSARIADPYCDLLLVGDSVGMVVHGFETTLPVSLDMMILHGQAVMRGSKRALVVVDMPFGSYEESPEQAFSNASRILAETGCSAVKLEGGVYIAETIDFLCKRGIPVMSHVGLTPQAVNRFGGFKTQGRNESNWQQIEADAAAIEKAGAFAVVVEGVVEPLAVKLTQMLSIPTIGIGASSQCDGQILVMEDMLGYGTWVPKFVRRYGVLEQEMEKAIKSYADDVKSRTFPSDEEIYKLKQKSG

SEQ ID NO: 8436 - protein, 302 aa, Zea mays
  misc_feature (120)..(120): Xaa can be any naturally occurring amino acid
  misc_feature (177)..(177): Xaa can be any naturally occurring amino acid
  unsure (1)..(302): unsure at all Xaa locations
HKAQCRCGRCFSRIAVVTGANRGIGLEVCRQLAGNGVTVVLTAVDEELGAKAVGNLQGLALSDVLSHQLDITDASSIARLANFLKARFGKLDILVNNAAVAGVVYSQDHLDDLEPREEKXQRLEWLWRNCRETYHAAKECLQTNYYGTKHVIEALLPLLKASDDGRIVNISSDFGIXRNEDLKQVLNDVGNLTEERLDELLDQFLRDFKVGTAEARGWPVAFAAYKVSKAAVNAYSRMLAAKQPALRVNCAHPGYVKTDITLHSGLLAPEEGASNVVKVALLPDGGVTGAFFEEGNELASFV

SEQ ID NO: 8437 - protein, 363 aa, Pseudomonas fluorescens PfO-1
MALNSIEELVEDIRQGKMVILMDDEDRENEGDLIMAAECCKAEHINFMAKYARGLICMPMSRERCETLKLPLMAPRNGSGFGTKFTVSIEAAEGVTTGISAADRARTVQAAAAKDAKAEDIVSPGHIFPLMAQAGGTLARAGHTEAACDLARMAGFEPSGVICEVMNDDGTMSRRAELEAFAAEHDIKIGTIADLIHYRMIHERTVQRIAEQPLDSELGQFNLVTYRDSVEGDVHMALTLGTVCAEEPTLVRVHNMDPLRDLLMVKQPGRWSLRAAMAAVAEAGSGVVLLLGHPLDGDVLLAHIRETGDQAAVKKPTTYSIVGAGSQILRDLGVRKMRLMSAPMKFNAISGFDLEVVEYVPSE

SEQ ID NO: 8438 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 8439 - protein, 351 aa, Mycoplasma pneumoniae M129
MKAYAMLKIGATGWIEKPRPVCGPNDAIIRPLAVAPCTSDVHTVWEGGIGERHNMVLGHEGCGVVDEVGSEVKSFKVGDRVLVAAITPEWNSVNAQAGYPMHSGGMLGGWKFSNVKDGMFAEYFHVNDAEGNLALMPEGMDLADACMLSDMIPTGFHANELADIQYGVALSFFCAGPVGLMAIAGAALKGAGRIIVVDSRPDIVEIAKAYGATDYIDFKKVSVVDEILKWTNNEGVEKVLISGGGSTILETAIKVLRPGGKIGNVNYFGAGEFLTIPRVEWGVGMAHKAIHGGLMLGGRLRLEKLARLIMTKKLDPSKMITHRFKGFEHIEEALFLMKDKPKDLIKSVVIF

SEQ ID NO: 8440 - protein, 433 aa, Crocosphaera watsonii WH 8501
MVTTTSLKTTKSEEIFAAAQKLMPGGVSSPVRAFKSVGGQPIVFDHVKGAYIWDVDGNQYIDYVGTWGPAICGHAHPDVIAALHNSLDKGTSFGAPCSLENTLAEMVIDAVPSIEMVRFVNSGTEACMSVLRLMRAFTGRDKIIKFEGCYHGHADMFLVKAGSGVATLGLPDSPGVPKNTTANTLTAPYNDLEAVKALFAENPDQIAGVILEPVVGNSGFVVPDGGFLAGLRELTQENGALLVFDEVMTGFRISYGGAQAKFGVTPDLTTLGKVIGGGLPVGAYGGRQDIMSMVAPAGPMYQAGTLSGNPLAMTAGIKTLELLQKPGTYQQLEQITQQLSEGLIKIGKDAGHSVCGGYVGAMFGLFFTEGPVKSYDDAKKSDTAKFGRFHRGMLEKGIYLAPSQFEAGFTSLAHTSEDIDKTLAAAKEVFADL

SEQ ID NO: 8441 - protein, 348 aa, Zea mays
KPLHCLAVRLTAERIARPDQYADPVPPPPALEDPALFHYAIFSDNVLAASCVVRSAVANSNDPSKHVFHVVTDRMNLGAMQVIIRRMDLKGAHYEVKAFEDYKFLNSSYVPVLRQLESANLQKFYFENKLENATKDASNMKFRNPKYLSMLNHLRFYLPEMYPKLHRILFLDDDVVVQRDLTGLWKIDMDGKVNGAVETCFGSFHRYAQYMNFSHPLIKAKFNPNACGWAYGMNFFDLDSWRREKCTEQYHYWQNQNENRTLWKLGTLPPGLITFYSTTKPLEKSWHVLGLGYNPSISMEEIRNAAVVHFNGNMKPWLDIGMNQFRHLWTKYVDYDDSYIRQCNFAPP

SEQ ID NO: 8442 - protein, 333 aa, Candidatus Blochmannia floridanus
MITKIGINGFGRIGRVIFREAQERTDIEIVAINDLLNIEHIAYLLKYDSTHGKFQGNIKTYSDHLIINDKTIHYTSKKKPIDLNWKNLGVDVVIESTGMFLTQEYAQGHILSGAKKVILTAPPKDDNIPMFVMGVNHDSYQGSKIISNASCTTNCLAPIAKIIHDHFGIIEGFMTTIHAVTSTQKTVDSPIHKDWRSGRSAYQNIIPSSTGAAQALGKVITDLHGKLTGMAFRVPILNVSVIDFTVRLKKSVSYKNICDVIKDASEHTFKDIIGYTEEKLVSSDLNGEKLISIFDAKSSMLLNNHFVKLISWYDNETGYSNKVIDLSNYIMKN

SEQ ID NO: 8443 - protein, 520 aa, Helianthus tuberosus
MEIPYLLTVVLLLLTTLYLLLFTTLLLLFTTLYLLLRRRRSSTLPPTIFPYLPIIGHLYLLKPPLYRTLAKLSAKHGPILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 8444 - protein, 305 aa, Pseudoalteromonas tunicata D2
MNKARNEIKEVMPQMDVIIEVLDARIPYSSENPMVTALRADKPVIKILNKADLADPVMTSAWMSYFEQENGVKAIAFGNDKAAEVHKINELCKKLVPHKVGPDKQIKAMIMGIPNVGKSTLINTLAGRIVAKTGNEPAVTKAQQRIKLEDGIMLYDTPGMLWPKVENENSGYRLAATGAIRDTAIEYEDVASYTAEYLLQSYPKLLQQRYKIDELPEQDWQFIELAGKKRGCIRQGNQIDTHKMSEILINELRDGVIGRITMETPAMRDAEELVVEQLRIDAQLKLAAKEQEKKDRRARARKNRR

SEQ ID NO: 8445 - protein, 91 aa, Brassica napus
MDVRNRKNDEVSVFQMPLHYPRYSKEDYQVMPEWKLDRVLADYGLSTYGDLAHKREFAIGAFLWISTTQSKDLSRQAINSKLKKETTSAMA

SEQ ID NO: 8446 - protein, 586 aa, Schizosaccharomyces pombe
MRVLVAETGREDNVSVHSREVSVNGSDSGTGNDAYKLETDDEHPPATPVRGLSTRSQKRPFRPLTIQQDEDVENDTGMNTEYNDDNSSLVNTPRDSTTYAETNSPNTEKLAGRDDDRSLLNLIDRGEIDSKRQRHYVPVHCKRMPKKEITLNQKLYVSQVIGPADAPKSKTIFGKRIMQWEPSQFKESVWASEISKSGKYLATAGKDAIIRVWKVIETPERRETLLKEGPQSCGRFFTPSSIFEPEPVLECVGHNAEVLSISWSKNDFLLTSSADRTVRLWHPKSTKSLAVFRHNEIVTCVAFHPIDDRYFVSGSLDCKIQLWSILRHKILHWTELEYVVSTICFYPDGESIVVGMFYGLCAIYETKNLQYVSSWLIHHSPSRNKKCRVTGLQCASIIPNDSKSDNVVLVSTNDNAIRLYNTVTHALVLKLSDAHRVNGRVLSRLSEDNSYIISGSDTNEVVLWHIPNKVLINASRKRSVILHLPTETFKVCSERLTSTIIAPARTAVEAKESEHDRSLIAEGYNLVKPHSHRSYGTPPVHPIDIIIATNMAGMTIVLCVDYDLGNSHHGFRNSKFGHFVKRLLRT

SEQ ID NO: 8447 - protein, 145 aa, Brassica napus
  misc_feature (135)..(135): Xaa can be any naturally occurring amino acid
  unsure (1)..(145): unsure at all Xaa locations
MATNSAWKLDDHPKLPKGKTIALIVLDGWGESAPDEYNCIHTAPTPTMDSLKNGRPDTWTLIKAHGTAVGLPSEDDMGNSEVGHNALGAGRIFAQGAKLCDIALASGKIFDGEGFKYVSESFEKNTLHFVGLLSXGGVHSRLGPA

SEQ ID NO: 8448 - protein, 947 aa, Oceanicola granulosus HTCC2516
MTFKPTDYLPYDFANRRHIGPSPAEMDEMLDVVGADSLEALIDDTLPPKIRQAAPLDFGKPLSERELLHRMKVTASKNEVLVSLIGQGYHGTVTPPAIQRNILENPAWYTAYTPYQPEISQGRLEALLNFQTMVSDLTGLEIANASLLDEATACAEAMTMAQRVSKSKLKAFFVDESCHPQNISVMKTRAAPLGIEVIVGAPDTLDPGSVFGAIFQYPGTHGHLRDFTDEMSALHEHKAIGIVAADPMALCLLKEPGAMGADIAVGSTQRFGVPIGYGGPHAAYMATKQAYARNMPGRIVGVSIDSHGNRAYRLALQTREQHIRREKATSNVCTAQALLAVMAGFYAVFHGPEGLKAIAQRIHRKTVRLAEGLAEAGFDVAPKSFFDTITVEVGGRQSAILQAAVDEGINLRRVADGRIGITLDERTRPATIQAVWRAFGIDRRDDDYTPRYRLPESLVRSSAYLTHPVFHMNRAETEMMRYMRRLSDRDLALDRAMIPLGSCTMKLNSAAEMMPVTWDEFSLLHPYAPREQAAGYTEMIDDLSAKLCDVTGYDAISMQPNSGAQGEYAGLLTIAGHHRARGEGHRNICLIPMSAHGTNPASAQMVGWKVVPIKSAANGDIDLDDFRAKAEQYADTLAASMITYPSTHGVFEETVIEVCRITHEHGGQVYIDGANMNAMVGLSRPGDLGGDVSHLNLHKTFCIPHGGGGPGMGPIGVKSHLVEHLPGDPATGEGAVSAAPFGSPSLLPISWAYCLMMGGEGLTQATRVAILNANYIARRLDGAYDVLYKGPSGRVAHECIIDTRPFADSAGVTVDDIAKRLVDCGFHAPTMSWPVAGTLMIEPTESETKAELDRFCDAMLAIRAEIADIEEGRADREANPLKNAPHTMEDLVRDWDRPYSRETGCFPPGAFRVDKYWPPVNRVDNAWGDRNLTCTCPPMEAYKDAAE

SEQ ID NO: 8449 - protein, 508 aa, Nicotiana tabacum
MAIENNNNGVNFCTVKRPKTKIVCTLGPASRSVPMIEKLLRAGMNVARFNFSHGSHDYHQETIDNLRQAMESTGILCAVMLDTKGPEIRTGFLKDAKPVQLKQGQEITISTDYSIKGDESMICMSYKKLAEDVKPQSVILCADGQITFTVLSCDKENGLDRCRCENTAVLGERKNVNLPGVIVDLPTLTDKDKDDILNWGVPNHIDMIALSFVRKGSDLVEVRKLLGEHAKNILLMSKVENQEGVANFDDILLNSDAFMVARGDLGMEIPIEKIFLAQKVMIYKCNIQGKPVVTATQMLESMIKSPRPTRAEATDVANAVLDGTDCVMLSGETAAGAYPDLAVGTMAKICIEAESTIDYPDVFKRIMSNAPVPMSPLESLASSAVRTANSAKAALILVLTRGGSTAKLVAKYRPGMPILSVVVPEIKTDSFDWTCSDESPARHSLIFRGLVPVLHAGSARASHEESTEEALDFALQHAKTKGLCKQGDSVVALHRVGTASVIKIVTVK

SEQ ID NO: 8450 - protein, 167 aa, Bromus secalinus
MADHHRDRGVLGGGALGERGSHGGYGYTGDHGGYGGDDEQHQQKQPVMMCALKAATAATAGGSMLVLSGLILAGTVIALTVATPVLVIFSPVLVPAAISMALMSAGFVTSGGLGVAAVSVFSWMYKYLAGKHPPGADQLDHAKARLASKARDIKDAAQIRVEQAQGA

SEQ ID NO: 8451 - protein, 315 aa, Glycine max
MAATTLVSEVTLPSSSGQRKMPLMGLGTAPEATSAVTTKDAVLEAIKQGYRHFDAASAYGVEQSVGEAIAEALKQGLIASRDQLFITTKLWVTDNHAHTILPALQKSLRTLQLEYIDLFLIHWPIATKPGKVVYPIEVSEIVEFDMKGVWGSMEECQRLGLTKAIGVSNFSIKKLEKLLSFATIPPAVNQVEVNLGWQQQKLRDFCKEKGITVTAFSPLRKGASRGANFVLDNDVIKELADAHGKTAAQICLRWLYEQGLTFVVKSYDKERMKQNLGIFDWSLTEDDYKKISEIHQERLIKGPTKPLLDDLWDEE

SEQ ID NO: 8452 - protein, 347 aa, Brassica napus
MKATLAPPSSLISLPRHKVSSLRSPSLLLQSQRPSSALMTTTASRGSVAVTAAATSSAEALREGIAEFYNETSGLWEEIWGDHMHHGFYDPDSSVQLSDSGHREAQIRMIEESLRFAGVTEEEKKIKRVVDVGCGIGGSSRYIASKFGAECIGITLSPVQAKRANDLAAAQSLSHKVSFQVADALDQPFEDGIFDLVWSMESGEHMPDKAKFVKELVRVTAPGGRIIIVTWCHRNLSQGEESLQPWEQDLLDRICKTFYLPAWCSTTDYVELLQSLSLQDIKYADWSENVAPFWPAVIRTALTWKGLVSLLRSGMKSIKGALTIPLMIEGYKKGVIKFGIITCQKPL

SEQ ID NO: 8453 - protein, 252 aa, Geobacillus stearothermophilus
RKPIIAGNWKMNGTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGALVGGASLEPASFLQLVEAGRHE

SEQ ID NO: 8454 - protein, 280 aa, Silicibacter sp. TM1040
MSASSQKTALTAEDIRAMKGRTPIVSLTAYTTPMAQLMDEHCDFVLVGDSVGMVLHGLPSTLGVTMEMMILHGAAVARGLKRAMMVIDMPFGSYEQSPAQAFANAARLMAETGAAAVKLEGGEEMADTIRFLVKRGIPVMAHIGLTPQSINTLGGYKVQGRDDAAKPLIADARAVAEAGAFAVVLEKVPASLADQVTEIVDIPTIGIGASAGCDGQVLVVDDMLGFFGAFKPKFVKRYAELGPAAEEAIADYASEVRARRFPSAEHTFADHAPQKAPQQD

SEQ ID NO: 8455 - protein, 1128 aa, Candida albicans SC5314
MTVPYKRKHDADSLFDARNGGEGVSEYMSQLLINSSDQPRKRRTMTQAPSRNGRESASETESISGADSDSDGESDDDEDDEDDDDDDEEEDDDDDVGSDPAKAGVIEKLTLKNFMCHDSFELKLGPQLNFIIGRNGSGKSAILTGISVGLGAKATDTNRGSTIRDLIKDGKSTSRITVVLKNEGSDAYKPDVFGKKIIIERKLQRSGSNTYSIKNEAGKVVSNKKSVLDEILYKFSITIDNPLAFLSQDKAREFLTSSSDKNKYEYFMDGAFITDILENYTSISNNVQVLDNKVRQAEEYTKVAKQEYKAIAKVHNAHRTNDALRNKLEMLNAKIYWFNVQTIEKKIDQENRQKDTCLQEIEQAKNQIDVCEKEIEAKIPRKDAADQQVKEVESQIKDIVEEFEGLRSKRSEMKSELEINKKETKKNIDEMNSLKEDITRTETKIEQERRRIQELQGGNKEKMAEELEKLNSEIDELESQLENLKKQLVEMQDNPDPELRSVSQQREKSRQKIADLQNQKRQLEKESVSKYSPWGSRMAELIKAIKRHPDWVQEPIGPIGSYIHVKNQYNNWKPLLSTILNKTLDSFIVTNEGDRSRLDRLLKQYQIRSNIIVKKTERLNYASGKADSAFTTVLDMLNVENDTILYALIDINSIEKNVIVESASEARDSCRRRNVQNSLVLFRKDSGHRMSYQNNTFRQDPIYYQNGMAKFGVANMSDLISDLQRELDEEHRHQNDLERRARSIKMKLDAKRDNLVSESRAIKRNLDQLKRNRSTLEDQLEVEVDYSNITTLEARIEDNNEQIRRLVALNEALLENLSQMNENYKDLKQQIEDCKSKKVKHETIREKFVKQLVEIETEIETQEDLKKRYLYKITELEDRIKRADDILAEGNRKLEEFVAKAEEHCSRDRVTIYPNDTQETIAQDYQETRFDLERAESALGTSLEEVLDQLEKAKAKCDKAEGELESLSSASRKLNAEVNARFNFLHTIIQSSIQEAKRTFEKAMWLRGFQGTLKFDFAEKTLQLNVQTGNDEKKRTVESLSGGEKSFSQIALLLSIWKVMNSRIRGLDEFDVYMDSVNRSISIKLLLKELKRYPKSQNIFITPQDIAVVGELNDKGVKIHKMSAPREE

SEQ ID NO: 8456 - protein, 353 aa, Pyrobaculum aerophilum str. IM2
MKIPIKMRAALYKAPGQPLELAETEIPTPGEGEILIKVAATGVCHSDLHILDGEIVPPPEGFILGHEVSGWVVDFGPRCENPHGLSPGDPVVISWIIPCGKCYWCVRGQENYCPYAAARMPGLVGLNGGHAEYMSVPETAVFPIPKEVDVHTAAVISCAYGTAYRALKEAAVGPGTSLVVIGVGGVGLAAVELASALGARPIIAVDVRKHVLEKAAELGATHLINATNGDPLSKIRDILPQGADVVYETKPNPDLKLAVEIVRRGGTIVVTGLGTSTIEIPANHIVMNGIRIIGSLGYKPRTDIPELLTLAASGKIKPQRLISHKYAPNEINEAYKNLRIGLHHRAIIIWNTK

SEQ ID NO: 8457 - protein, 364 aa, Arabidopsis thaliana
MGKGGMSQGEGSKVEEENMAAWLVGINTLKIQPFLLPSVGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAEVGPETNVLVMGAGPIGLVTMLAAQAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQKEVEDAFETSARGSNAIKVMFNL

SEQ ID NO: 8458 - protein, 233 aa, Arabidopsis thaliana
  misc_feature (217)..(217): Xaa can be any naturally occurring amino acid
  unsure (1)..(233): unsure at all Xaa locations
CWVSGTVYVDMPLKPNILDDIAKDHWASALPPRQKYLSSVGEELVMLEDESGRLRLTGAPLKNQILVTGCVIAVMGTENSNGDFEVVDIKIPDLPPQTERRDAFASKNKNRDQAESIKNDDFQAKDTTEPTSHGKKIAIVSGLGFSGTDADHSVEIQLLVEYLIGEAFDPTIQNSVSQISRLIIAGNSITPDDIKVSHEITSATRKPQKKYGYDSSXYNPTPLAHLDYFLSCL

SEQ ID NO: 8459 - protein, 366 aa, Pseudomonas aeruginosa PAO1
MSKMMKAAVFIQPGRIELVDKPIPDVGPNDALVRITTTTLCGTDVHILKGEYPVAPGLTVGHEPVGIIEKLGSAVVGYREGQRVIAGAICPNFNSYAAQDGVPSQDGSYLVESGRCACHGYKATAGWRFGNLIDGTQAEYVLVPDAQANLAPIPDGLSDEQVLMCPDIMSTGFKGAENANIRIGDSVAIFAQGPIGLCATAGARLLGASTIIAIDGNAHRLDIARGMGADVTLNFRECDVIEEILKLTGGRGVDASIEALGTQSTFETALRVLKPGGTLSSLGVYSEDLTIPLSAFAAGLGDHRINTALCPGGKERMRRLLNIVASGRVNLGPLVSHEYRLDDIVAAYDLFANQRDNVLKVAIKPH

SEQ ID NO: 8460 - protein, 387 aa, Xanthomonas campestris pv. campestris str. ATCC 33913
MLALNYHGSRDVRVETVPDPLLVERDDLILRVTATAICGSDLHLYHGKIPDLRPGDILGHEFMGIVEEVGPDVTAVRPGDRVVIPFVVACGQCFHCLLQEFSACETTNTGKGAALNHKDMRPPAALFGFSHLYGGLSGGQAEYVRVPKANVGPLVVPDALHDEQVLFLSDILPTGYQAVVDAGVKQRSTVAIFGAGPVGLMAAACCRMLGAERVFMVDRHAYRLDFASRTYGVIPINFDEIDDPADIIVSQTDGRGVDASIEAVGFEAEGSALETALTTLKLEGSSGVALRQCIAATRRCGTVSVPGVYAGFIHAFMFGDAFDKGLTFKMGQTHVQKHMPYLLERIGNGELKPSAIISHRLPLAEAARGYEVFDKKQDDCRKVVLTP

SEQ ID NO: 8461 - protein, 493 aa, Oryza sativa (japonica cultivar-group)
MAGGGGGGRASAQRRAALAALITLLLLASLAFLLSATGTASAPNSAPFRLAAIRRHAEDHAAVLAAYAAQARKLSAASASQTESFLSISGHLSSLSSRISLSTVALLEKETRGQIKRARSLAGAAKEAFDTQSKIQKLSDTVFAVDQQLLRARRAGLLNSRIAAGSTPKSLHCLVMRLLEARLANASAIPDDPPVPPPQFTDPALYHYAIFSDNVLAVSVVVASAARAAAEPARHVFHVVTAPMYLPAFRVWFARRPPPLGTHVQLLAVSDFPFLNASASPVIRQIEDGNRDVPLLDYLRFYLPEMFPALRRVVLLEDDVVVQRDLAGLWRVDLGGKVNAALETCFGGFRRYGKHINFSDPAVQERFNPRACAWSYGLNVFDLQAWRRDQCTQRFHQLMEMNENGTLWDPASVLPAGLMTFYGNTRPLDKSWHVMGLGYNPHIRPEDIKGAAVIHFNGNMKPWLDVAFNQYKHLWTKYVDTEMEFLTLCNFGL

SEQ ID NO: 8462 - protein, 422 aa, Zea mays
MSCLCWFKRRSRKGRSSSSGKRGASSTATVSVSGPATATATTTTTTTASAESTSRSDDSGAVRPVSKSAGSSQSQRSISSLYEERGHGQLRVFDYDELQGATAEFGRAQKLGEGGFGSVYKGFIRAADGKGDRVPVAVKKLNQRGMQGHKQWLAEVQFLGVLEHPNLVKLLGYCAVDSERGAQRLLVYEFMPNKSLEDHLFRRANPPLPWNRRLQVILGAAEGLAYLHEGEVQVIYRDFKTSNVLLDKDFRAKLSDFGLAREGPTGANTHVSTAVVGTQGYAAPEYMDTGHLTTKSDVWSFGVVLYEILTGRRSLDRNRPAAEQKLLEWVAQFPPDSRNFRMIMDPRLRGEYSVKAAREIAKLADSCLLKNAKERPTMSEVVEVLGRAVQAHAEPDSGAPGPGPGAKGKKTDAATPSRRRRD

SEQ ID NO: 8463 - protein, 132 aa, Prunus avium
FCYVMSSGSYDYFQFVQQWPPTNCRVRIKRPCSKPRPLQNFTIHGLWPSNYSNPTKPSNCNGSKYEDRKVYPKLRSKLKRSWPDVESGNDTRFWEGEWNKHGRCSEQTLNQMQYFEISHDMWVSYNITEILK

SEQ ID NO: 8464 - protein, 472 aa, Neisseria gonorrhoeae
MSIKNVVKLIEESEARFVDLRFTDTKGKQHHFTVPARIVLEDPEEWFENGPAFDGSSIGGWKGIEASDMQLRPDPATAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLRRGGVFSKDWIDSYIAFKEEDVRRIRMAPHPLEFEMYYRL

SEQ ID NO: 8465 - protein, 472 aa, Yersinia enterocolitica (type 0:9)
MMLLPVIMAGGTGSRLWPMSRELYPKQFLRLHGVNSMLQETVNRLEGISVREPVVICNEEHRFLVAEQLRQINKLSHNIILEPVGRNTAPAIALAALNAVSQGDDPIMLVLAADHIINDCDAFHQAVRDALPFAERGSLVTFGIVPTGPETGYGYIQRGEVTVNELSEAFKVKRFVEKPDTETAEQYISSDEYYWNSGMFMFRAKRYIQELEKFRPDILDACKAAMKDSDSDKDFITIDKDKFSACPDESIDYAVMEQTSNAVVVPLDAGWSDVGSWSALWDVSSKDKSGNSVTGDTFLHDTQNCYINTDEKLVAAVGVDNLVIVSTKDAVLVVDKSKVQDVKKIVEHLKQTKRSEYRRHREIYRPWGRCDIVVNEQRFNVNRITVKAGGAFSMQMHHHRAEHWIVLSGTAKVTIADKTFLITENQSTFIPIGSLHMLENPGQIPLELIEVQSGSYLGDDDIIRIKDHYGRC

SEQ ID NO: 8466 - protein, 852 aa, Kluyveromyces lactis NRRL Y-1140
MSNIATSHRPPGLNEKNGTNMINNGGENVDLFGTENIRDVYPGVETGGWVQGESADKIDWLELVGNEDFKRHLKTGEHMKVYRKKKGFKQFRRLILAQELRPFGNEFQDSSSSNEKGTATEPMKNGGAVWCIRFSHDGKFMATAGKDEILRIWKVISSPAERLELNQHSISFLKSTANAISQLNGQLAQYGGDTDSASLNSGSSNTHVDSLGSSNANRDGFSTKAVPQEQQGQTQGHRHPYGLGDSYCGVFHPNPLVTFHEHTDDILDIDWSKNSFILTGSMDKSCKLWHCARPTSLKTFVHSDFVTAVRFHPEDDRFFLSACLDQKCRLWSILEKQVIFEYDCGDLITAMDISYDGNYTILGTFNGYIHVLITKSLELLFSFNVLDKDSELKKCHRTSRRLKKQSSDKAKNGPKITGLEFIQKDARNYKISSKDVSDWFLVSSNDSRIRIYTLNQEFVSVMKGHSNEHSQITAHSTVTRSGKAYVVSGSEDHWIYCWKLSDEVVKSTETSSKDSKSTRSRSGSLRSFCRRRNNDSVASETLDAVLSRGYTKNHQVSSNSNYIGFHAHHHPITCATAVPMQVTKVLSLSNDLICELTMQFWETTDDFTMESASKNARAKKNGNAISSNDGQKTDCRRKISIDKTIPNVKGKSGVSGAQSNNVPNIQISDGDNRTTNAVNGTTAANPPSLIEFIGGIVVSADTTGVIRVFRSDISSNVRKKVLNRLNAIEKQLKENGEGSVKPRTSGVSSVAAATNGSLSTATTFVGNGSNGHNVHSIERPTPFPMQDSLPLVDESSSSLTTLQQQQPHSQSRVCNVCGGTRFATDQTLSFNQAPQNVKYYCLDCGALYTSLR

SEQ ID NO: 8467 - protein, 95 aa, Acinetobacter sp. ADP1
MQTAIVRHILVKDKDLADQLKKKIQDGADFTKIAKQYSTCNSAKRGGELGEVKKGQLVPVIDKLVFSAAERVLHGPIKSQFGFHLVEIKFRTDFR

SEQ ID NO: 8468 - protein, 149 aa, Glycine max
MDADGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSERASKEPKSPSKATKSPKKA

SEQ ID NO: 8469 - protein, 487 aa, uncultured bacterium 561
MNIELTNPTLFRTEAYVNGEWIGADNGARLPVTNPATGALITDVAKTGAAETRRAIAAAETAMLSWRQKPAKQRAQVMRRWFDLIMANQEDLARIMTLEQGKTLAESRGEVAYGASYIEWFAEQAKRIDGDVIPAPSGDKRIICIKQPVGVCAAITPWNFPNAMITRKAAPALAAGCTIVIKPASETPLSALALAELAHQAGIPPGVLNVLAGSSSDIGAELTSNPTVRKLSFTGSTPIGKMLEAQCVPTLKKTSMELGGNAPFIVFDDADIDSAVQGALISKYRNSGQTCVCSNRLLVQAGIAEEFTAKLVAATESLKLGNGLDENVDLGPLVNAKAVNDVHELVQGSISAGAKLVLGGAPSNLGVCFYQPTILTGVRPEMPVFRNEIFGPVAPIISFETEAEAIELANDTEFGLASYFYTRDIGRVWRVAEALEYGIVGINEGIISNEMAPFGGVKESGSGREGSKYGIDDYLEIKYMLMGGLNQ

SEQ ID NO: 8470 - protein, 334 aa, Zea mays
  misc_feature (305)..(305): Xaa can be any naturally occurring amino acid
  unsure (1)..(334): unsure at all Xaa locations
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERXSPIFLGSYDDVEEIKALYAEQAKSSSASS

SEQ ID NO: 8471 - protein, 365 aa, Pinus sylvestris
CQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADRPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 8472 - protein, 250 aa, Chromobacterium violaceum ATCC 12472
MGCGSSSGTPAIGCGCPTCQSDDVRNKRTRASAYVRVGELGFLIDTGPDLRQQALREGVSRLDAVLYTHPHADHLNGIDDLRAFCYLKQGPIALYGNDFTIANIRERFGYALQPPSRMWDKPVLLPEVVNGPFQHQGVTLTPIPLLHGSWPCLGWRIGDVAWLTDLSRIPDSSLPLLEGLELLFLDCLNEDPYPSHLSVGEAFEWAARIAARRTVLIHMTHKLEYLDLSQRCPPGVEVGFDGWRAEVAME

SEQ ID NO: 8473 - protein, 488 aa, Candidatus Blochmannia floridanus
MPQLLRRTKIIATLGPATDQKNTLEKIIISGVNIVRLNFSHGNSSEHFFRANKVRKLANQLHKYIAILGDLQGPKIRISTFQTNNIYLQSGDDFLIDSTLKNSHNNQKYVGVNYKELPQDVSPGDYLLLDDGKIQLKVIKIQNTQIFTKVVIGGLLSNNKGINKLGGGLSAKVLTNKDKLDIITAAKIGVDYLAISFPRNSMDLNFARKLITDAGSNAKIISKIERAEVVKSDDTIDDIIKASDAVMIARGDLGIEIGEPQLVGIQKKIIQRAHLLNRAVITATQMMESMIINSVPTRAEIMDVANAVLDGTDAVMLSAETATGQYPSETVSSMADVCLGAEKTLNNTNNQLIFINQLQKKINNTKEAIAASTMHIANCLSKIRAIISITDWEHIVLLLSRFNSQLPIFALSKHIHILNIVTLYKGVIPIYFNRTGNNIIDARQASNLLRDQGFLTPGELVIIIQDNIVNQSNINNVTHILTIEEQCK

SEQ ID NO: 8474 - protein, 357 aa, Geobacter metallireducens GS-15
MYVVILAGGSGTRFWPLSRKLHPKQLMSVFGGKSMLQRTAERVLPLNPKRILVITNHLQAEETRRQLEYLRGVRIEVIEEPLGRNTAPAICLAATLIARHDPEAVMAVLPADHFIRDEDAFCATIQKGREAALNGYLVTLGITPDRPETGYGYIEAETSLRGDGPYPVKRFVEKPDRERALEFLAAGTFFWNSGMFLWRADVILGQMAAHMPELAQAFAGITFSPDIWEPADLAPQIEAVYAMVKGESIDYGVMEKADSVAMIPASFGWSDVGSWSALPEVMEPDAAGNVVIGAPETVIADAAGCILRGEKLMALVGVRDLVVVDTPDALLVCAKDRAQDVKKVVEELERRGLRRCL

SEQ ID NO: 8475 - protein, 672 aa, Geobacter metallireducens GS-15
MSYEVLKDLEILFGLAVFTVVLLRRFMLPSIIGFLATGILAGPYALGLIEDTHQVEQMAEIGVVLLLFTIGIEFSLKELMRIKHLVFWGGGMQVGVTILIVAALAVAFGSTLPQATFYGFLVALSSTAILMKLLMDSGEMDTPHGKMALGILIFQDLCVVPLMLFTPFLAGAGNGWTGILLVSAKAVAVVVIAHFGSRFAVPWLFEQVVKSRSRELFILTIIFIGFGTAWLTAQVGLSLALGAFIAGLAISESEYSHQALGDIIPFRDAFMSLFFISVGMLLDPSVILKQPLLVGSLVVIILVVKFLVTGGAAVALGVPARVGIVTGLALAQIGEFSFILCQTGVQHGLLSKEHYQVFLAASVATMALTPLCLKIGAPVAAWLVRILPAPLTRGRGVLRGKEKKVTLSDHVIVVGFGVNGKNLSRVLKAQKIRHVIIETNPFTVSAEKSKGTRIMFGDASRPEVLTHAAVEHARIIVIAISDAAASRRVVAQARQMSPTIHIIVRTRYILEMEPLYKIGANEVIPEEFETSIEIFSRVLRNFLVPHDQIDHCVAEIRRDSYDMFRTMSRRHSHAVGIAGYLTGAEIGSFRVKKGAPLEGESLRQGTLRSRSGATLLVIKRGDEVTPNPDPVWVLQEGDIVLLLGTPEQLAAAARLFEAPTVPSKGTAVLGAH

SEQ ID NO: 8476 - protein, 1040 aa, Oryza sativa
MAGTISRIRLENFMCHSSLHIELGQHVNFITGQNGSGKSAVLTALCIAFGSRAKSTQRAAALKDFIKTGCSYAAIIVDINNQGEDAFKPEVYGDLVRLERRITESSSSMFLKDQHGNKVAHRKDDLIEIIEHFNIDVENPCVIMSQDKSREFLHSGNNKDKFKFFFKATLLQHVNDLLLAIRELLDNADSVVQELEKSIKPAMMELDELQQKIKNMEHIEEIAHEIDNLKKKLAWSWVYDVDRQIEEQTVKLLKLKERIPACQEKIDGHAAMIVKLKEELTDKERNARSLVEKSREVTMMKEKLEDDIAQAVALKIELEREHVRGTNVLKNMNNRVKQLQKQIHDFREQYIQYTQDESSKAENDKCEIQKEINSLHSNVTRLKEEERGLHEKAKSGRVWVTHIRDLQQRQSDKVLSDYNPVSQYATGAIPQVSTFGGQRVRNLLKSIERQERRFNIPPLGPIGVHVKFINYNKWSFAVECALGRLLDAFIVSCHRDSVILRECAKEVNYHNLQIIIYDFAKPRLNIPDHLLPSTTHPTVLSVIQSENPTVLNVLVDQGSAERTVLVRDYEVGRSVAFDNRIQNLKDVYTSDGYKMFSRGPVQTILPPHRKGNAGRLCTSLGEKIAEMESEIADMERIISQRTRDMKKPNDKREDIELKIKNLKRKRVEEERLLESKKVQLDDIRKTSADINRVTSSDTSELEAEMMQVEVDIEQKELLVQKTNLRLTKALQDENDRRACYKEFIDGVYREVGPSNVLEKEIERVKDKLQTAEQGKAYYEGIMETKVLPDIKIAEAEFEDLQKLQQESFKKASIICSESDVETLGGVAGSSPEQLSATINKLELRFHKESSRYTESIDDLRALHIKKKEKIEDKQQLYAGFRDKLNSCQKALDMRWKKFQRNAALLKRQLTWRFNEHLGKKGISGFINVDYKERLLSVEVRFSQDSSRDTITDTRGLSGGERSFSTLCFTLALHGMTEAPFRAMDEFDVFMDAVSRKISLDTLVDFAVTQGSQWIFITPHDISMVQPGDRIKKQQMAAPRG

SEQ ID NO: 8477 - protein, 519 aa, Magnaporthe grisea 70-15
MGVQDFANLFLGGRFSGSVTTAAMLLFLVVVLVVSGVRSIRSISARRRFIAENNCKPAPAWPQKDPILALDFILKGLANFKQKKFLDGWTKYYEDLGPTFTTKSAGMLYINTIDPENIKTVLATRFRDFSLAERVEIMGPLLGRGIFVTDGDEWAHSRALLRPNFAKEQVADLGMIDRHFSDLMALLRPHAADGTTVALQPLLMRMTMDTATEFLFGQSTRTLSVEQADSAGNAFSRAFQFSLNEMAHLFRLGPFRILRRQSRELKDSHDICRAYVDGFVDEAWAWKQGGKTDGRTNFLRDLVESTDNKQKVRDELLNILIAGRDTVASVLGSLFRVLAQRPEIWAKVRAEVAQFEGELPRYDQLRDLKYAKYCINEALRLWPAVPLNGRLAVRDTVLPRGGGPNGDEPVYVPKGSLVNYSVYSMHRRTDFYGADAEEFRPERWEGKIQGWQYLPFNGGPRICLGQQYALTEMLVVLVRFAQEFSHIESRESTPWQEELHLTVQPANGVQVALTAANTA

SEQ ID NO: 8478 - protein, 562 aa, Dictyoglomus thermophilum
MIYDDKIFGDLCHKEFLVEREVKKLEEIYLEEVLPEDPKPEDEIEFTFNCPLKFHITSGKIVKDNREIYTFNIQERKTQWNDSIFNFSEIIKIKIPPLKENGLYQIHLYEMNEKIYEQYLSIDSFEAPLWSEESIIYHIFIDRFAKDEKEVEYSENLKEKLGGNLKGILSRLDYIENLGINTIWISPIFKSTSYHGYDIEDYFEIDPIWGTKEDLKKLVREAFNRGIRIILDFVPNHMSYKNPIFQKALKDKNSNLRSWFIFKGEDYETFFGVKSMPKINLKNKEAIDYIINAAKYWIREFGISGYRMDHATGPDINFWSIFYYNLKSEFPETFYFGEIVETPKETKKYVGKFDGTLDFYLFKIIRDFFIGKRWSTKEFVKMIDLEEKFYGNKFKRISFLENHDSNRFLWVAKDKKLLRLASIFQFSINAIPIIYNGQEMGCSQYRDILEGNRTLHEHARLPIPWSDDKQDKELIDFYRQLVKIRKSHPALYKGTFIPIFSDMISFIKETQEESILVLINIEDKEEIFNLNGTYRDLFSGNIYTNSLKLGPMSAHLLLRIDH

SEQ ID NO: 8479 - protein, 98 aa, Brassica napus
MARSLSTAKTLSVIVAGEFSNAIFRRGFAVAADTALHGSVGSGGTTASASAMKKNVGEESSEKAPWIPDPKTGYYRPATVSQEIDPAELRAVLLNNKQ

SEQ ID NO: 8480 - protein, 263 aa, Pediococcus pentosaceus ATCC 25745
MKIGFIGVGNMAKAIIKGLLKNNFESTDILVHSAHQSSYGPFAEKNQLIATKSNQELVRNSDIIVIAVKPYVVKTVIDEVRDDLNHHQLVVSLASGISIEDLQTSLDEQQPILRIMPNVNVEIGEGMTAVVANGDLKMEPFQSGVKIFETVGSTMELAEKDFPIFSAIAGSAPAYAYLFIDALSRAGVKHGLTKASATKIAAQMVKGSAEMVLKSDEIPYALIDKVSSPGGTTVAGLLAMEEAGFSPAVVKGIDATVAKEINH

SEQ ID NO: 8481 - protein, 496 aa, Arabidopsis thaliana
MGKKSGSSSSWLTAVKRAFRSPTKKEHNNNAHGNEVDEDEDKKKEKRRWLFRKSTNHDSPVKTSGVGKDAPAQKSTETTTIINPTVLSSVTEQRYDASTPPATVSAASETHPPSTTKELPNLTRRTYTAREDYAAVVIQTGFRGYLVLDLTLNYIGKKSIKSIERASEVTSTSERSQCEEASKDDFKVYASSKGSSIAEDWDDRPHTIEEVKAMLQQRRDNALRRESNNSISQAFSHQVRRTRGSYSTGDEYEEERPKWLDRWMASKPWDKRASTDQRVPPVYKTVEIDTSQPYLTRGNSRTGASPSRSQRPSSPSRTSHHYQQHNFSSATPSPAKSRPIQIRSASPRIQRDDRSAYNYTSNTPSLRSNYSFTARSGYSVCTTTTTATNAALPNYMAITESAKARIRSQSAPRQRPSTPEKERISSARKRLSFPVPPLPQQMDGQSLRSPSFKSIGGSQLGALEQQSNYSSCCTESLGGGGEISPASTSDYRRWLR

SEQ ID NO: 8482 - protein, 498 aa, Dictyoglomus thermophilum
MKIKFFIKRTLIFIFILVTFLTYIHGYNEPWYKNAIFYEVFVRSFADSDGDRVGDLNGLIDKLDYFKNLNITALWLMPIFPSVSYHGYDVTDYYDIHPGYGTMEDFENLIRKAHEKNIKIILDLVVNHTSSRHPWFVSSASSYNSPYRDYYIWSTEKPEKNSNLWYKKPTGYYYALFWSEMPDLNFDNPKVREEVKKIAKFWIEKGVDGFRLDAAKHIYDDDSKNIQWWKEFYSYLKSIKPDVYLVGEVWDNEYKIAEYYKGLPSNFNFPLSDKIMNSSSKSKRLRNYRISRLKRLFGENNTDFADAIFLRNHDQVRVRTFFGGSIDKSILAGSIYLTLAGNTFIYYGEEIGMEGSKPDEYIREPFKWTDDMKSKYQTYWIIPRYNLPGNGIALDTEEKDPNSIYNHYKKLLEIRVKCRALSNGKIERIKTQDRSILAYKLELEDEKIMVVHNLNRIENTFNFNNEIKEKDILYIRNAKTEKNKIILGPYSTVIVKIP

SEQ ID NO: 8483 - protein, 368 aa, Thermotoga maritima MSB8
MGETKLFFGPNHPGMHGNFSVHMYVEGDIVKKARPVPGFLHRGFEKLMERRYWYSNISLIPRICVPEPDINEICYAMAIEKIAKVEVPERAQWIRMIVLELARIANHIWTVGGIGGPLGLYTASHWGVADRDRILDIFEALSGARVYHMYIIPGGVRKNMTPKIEEMIWKTLDYIESRLPDYENLIFKNRIVHSRLRGRLILTREQAVEMGVTGVGLRATGVEYDIRKVDPYLFYDRVEFEVPTATDGDAFSRVYLKFKEIPQSIKIIRQALEKMPQADRVNVPIGRGNGLRRIVPKGMAYAHVESTRGEYGFFVVSDGKNKPYRVAVRGASYPQGLYGIEKYLPGTRIEDVPIWLATMDVCAPEIDR

SEQ ID NO: 8484 - protein, 561 aa, Prochlorococcus marinus str. NATL2A
MKSEDCYEIEFDDIADALAAIRNGECVVVVDDEKRENEGDLICAAQFATPQQINFMATEARGLICLAMQGERLDELDLPLMVDRNTDSNQTAFTVSIDAGPEFGVSTGISAEDRAKTIQVALNSQTKPIDLRRPGHIFPLRAKIGGVLKRAGHTEAAVDLSLLAGLSPAGVICEIQNLDGSMARLPELKKYARERNLKLISIADLIHYRLENERFVYRQAVAKLPSLFGDFKAIGYKNELDGSEHVAIIKGNPENLKEPVLVRMHSECLTGDAFGSLRCDCRPQLEAALSRISEEGEGVVVYLRQEGRGIGLVNKLKAYNLQDGGLDTVEANEKLGFPADLRNYGVGAQILTDLGINRLKLLTNNPRKIAGLGGYGLQVESRVPLVICPGDHNAAYLEVKREKLGHLIDNNIQRNLTNERQNIVVYWDGKVNNSELKHFEDKACKWSENHFLNISIQTAPRLIALCENPLFIWNVRHRDIKTHLEGNLIDKRLLESLLKELSNWENTERIGIIKTENYERLLHPSSNISIESKKISELSNFENSPLFDWNLKDKTSTIEWS

SEQ ID NO: 8485 - protein, 107 aa, Burkholderia xenovorans LB400
MQNLTAPALAEWLADTSRPAPVLLDVREPWEIQTAAIAGAVSIPMREIPARSEELDDDVQIVCVCHHGARSAQVAMFLESRGHTNVFNLQGGIDAWSRQVDPSVPTY

SEQ ID NO: 8486 - protein, 442 aa, Streptomyces spectabilis
MSTTAMPASTHHTIALEQSHRLPGGQSMTDLSGLVVDRARNAEVWDKDGKRYIDFFTGVGVCNIGHSHPRFLAEVGEQLSACAVGTFYTDARSRYYELLAAQLPERLGRIHMFSTGSEAVEAAVKLARAATGKHEVVSFWGGFHGKTQGALSLHGGPRKHRSGPFPPGSHQVPYAYCYRCPLQLEHSTCGQRCVDLAEQSIENGSVGDIAAIIVEPVQGTNGNIIPPAGYLRAVRRLADRHGALLILDEVITGFGRTGSLFAFEQDPEVRPDVVVLGKAMASGVPASAIVSRAELVEGTSFGQPSAAASTFGGNPLASAAALATLRILLDERLPERSRLLGETVARRLASWKEEFPFVGNAANVGLMVGVELVEPGTRRPLPKDVTRRIFQGLLAEGVLAMAYDSRIRIYPPLSIPADHLDEGLTAFESVFRSLRSLRSTQT

SEQ ID NO: 8487 - protein, 284 aa, Sinorhizobium meliloti
MSRYKTLAAAALVAMIAAGVARAEGTDPVIAKVGDQEIRQSELDLAITSLDPQLQRMPDEQKRAAALSAVIDVKLLLKDAEKEGLQNDEAFKQRVAFLTERELHNAFFKKHVVDAVTSEEVKARYDKEVAAIPPQEEVKARHILVKTEDEAKDVIKELDAGKNFADLAKAKSTDPNKEEGGDLGYFTKGRMVPEFETAAFALEKGAYTKTPVKTQFGFHVILIEDKRPQAPPTLEQVEPQVRQLVMRDKYLELLNSAKESTAVEISDPALKKAYDEAGKPQETK

SEQ ID NO: 8488 - protein, 308 aa, Oryza sativa
  misc_feature (181)..(181): Xaa can be any naturally occurring amino acid
  unsure (1)..(308): unsure at all Xaa locations
MERDITSLPTKRVAVVTGGNKGIGLEVCRQLAADGITVVLTARDETRGVEAAEKLSGMGLSSVVFHQLEVTDSSSVARLADFLKTRFGKLDILVNNAAVGGMEYVQGVDTNKEQFVSMDKKQRLAWLNKQGRETYDAAKNGVQTNYYGTKIVIQALLPLLLQSSGEGRIVNVSSDFGLLRXVNNEDLRKELDDVDNLTEERLDEVLDSFLKDFEAGALEAHGWPTASFAAYKMAKVAMNAYTRILARRHPELRVNCAHPGYVKTDMTIDSGFLTPEEGGRNVVTVALLPDGGPTGAFFAEGKEASFLG

SEQ ID NO: 8489 - protein, 132 aa, Prunus avium
LCFIISAGDGSYVYFQFVQQWPPTTCRVQKKCSKPRPLQNFTIHGLWPSNYSNPTMPSNCNGSRFKKELLSPRMQSKLKISWPNVVSSNDTKFWESEWNKHGTCSEQTLNQVQYFEISHEMWNSFNITDILK

SEQ ID NO: 8490 - protein, 131 aa, Prunus avium
ICYVMSSGSYDYFQFVQQWPPTNCRVRNKPCTKPRPLQNFTIHGLWPSNYSNPRMPSKCTGSLFNFRKVYPQLRSDLKISWPDVESGNDTRFWESEWNKHGRCSEASLNQMQYFERSHAMWISYNITEILK

SEQ ID NO: 8491 - protein, 745 aa, Saccharum hybrid cultivar
MSGAALVAIVASIGNLLQGWDNATISAALLYIKKEFKLESEPTVEGLIVAMSLIGATIITTFSGPVSDWIGRLPMLILSSVLYFVSSLIMLWSPNVYVLLLARLINGFGVGLAVTLVPLYISETAPPEIRGLLNTLPQFSGSGGMFLSYCMVFGMSLLPSPDWRIMLGVLALPSLFFFGLTIFYLPESPRWLVSKGRMAEAKKVLQRLRGKDDVTGEMALLVEGLEVGGDTFIEEYIIGPAIEPADDHVADGDRERIILFGPEEGQSWIARPSKGSSMLGSVLSIGSRHGSMVNQNLPLTDPIVTLFGSVHENISLAGGSMRRIVPSKFDSMISITDQHPKTEQWDEENLHRDNEEYATDGAASDYENNVHSPLLSRQNTSAEGKGIAHHGHRGSALGLRRRSLSDEGGEAATSTGIGGGWQLAWKWSEREGEDGKKEGSFKRIYLHQEGVAGSRRGSVVSLPGGGDASEGGKFIHAAALVSQSALYPRDITEQRMAGPATMHPSEAAAKVPSWRDLFEPGVRRALLVGIGIQILQQFAGINGVLYYTPQIMEQAGVAVLISNLGLSSASASILISSVTALLMLPSIGLAMRLMDVSGRRFLLLSTIPVLIASLIVLVVSNVIELGTVVHAVLSTISVITYLCCFKMGFGPIPNILCAEFFPTRVRGICIAICALIFWVGDIIVTYSLPVMLNAIGLEGVFGIYAVACAIAFVFVYLKVPETKGMPLEVITEFFAVGAKQAVAKA

SEQ ID NO: 8492 - protein, 404 aa, Photobacterium profundum SS9
MHNIGMSSKLNNVCYDIRGPVLKHAKRMEEEGHKILKLNIGNPAPFGFDAPDEILVDVIRNLPTSQGYCDSKGIYPARKAIVQHYQKRGLLDLDVEDVYIGNGVSELIVMAMQALLDNNDEILVPSPDYPLWTAAVSLSGGNPVHYICDEESDWYPDLDDIKKKITPNTRGIVLINPNNPTGAVYSRDFLLEIVEIARKHKLIIFADEIYDKILYEGAQHTSIAPLAPDVFCITFNGLSKSYRVCGFRAGWMVLSGPKHEAKGYIEGLEMLSSMRLCANVPMQHAIQTAIGGYQSINELILPGGRLLEQRDKAYDLITQIPGVSCVKPKGALYLFPKLDQKKFNIVDDQRMALDFLQQEKVLIVHGTGFNWEKPDHFRIVTLPRVDDLEMAIGRLERFLHNYRQ

SEQ ID NO: 8493 - protein, 131 aa, Prunus avium
LCFIMSNGSYVYFQFVQQWPPTNCRVRIKRPCSSPRPLQYFTIHGLWPSNYSNPRMPSNCTGPQFKRILSPQLRSKLQTSWPDVESGNDTKFWESEWNKHGTCSKETLNQMQYFERSYAMWMSYNITEILK

SEQ ID NO: 8494 - protein, 272 aa, Bacteroides fragilis NCTC 9343
MKLVKPKKFLGQHFLKDLKVAQDIADTVDTFPDLPILEVGPGMGVLTQFLVKKERLVKVVEVDYESVAYLREAYPSLEDNIIEDDFLKMNLQRLFDGHPFVLTGNYPYNISSQIFFKMLDNKDLIPCCTGMIQKEVAERIAAGPGSKTYGILSVLIQAWYRVEYLFTVNEQVFNPPPKVKSAVIRMTRNETQELGCDPKLFKQIVKTTFNQRRKTLRNSIKPILGKDCPLTEDALFNKRPEQLSVQEFIHLTNQVEQALKVPIEPVSQIENP

SEQ ID NO: 8495 - protein, 320 aa, Solanum virginianum
  misc_feature (135)..(135): Xaa can be any naturally occurring amino acid
  unsure (1)..(320): unsure at all Xaa locations
MGSKNSKAKTSVDDTSNSSYQIRVESFRVPFVALQEATNNFDENWVIGMGGFGKVYRGVLCDGTKVALKRCTPGSSQGIKEFLIEIEMLSRHRHPYLVSLIGYCDERNEKILVYEYMENGNLRRHLYGSDLPTLXWEQRLEICIGAARGLQYLHNSAVIHGDVKSTNILLDDHFVAKITDFGLSKTQTELDQTHFTTVVKGTFGYLDPEYIMRGKLAEKSDVYSFGVVLFEVLCARPALDRSLSSEMFSLVRWAMESHKNGQLERIIDPNLVGKIRLDSLRKFGETAVKCLAESGLDRPSMSEVLWNLEYALHLQEPVIQ

SEQ ID NO: 8496 - protein, 962 aa, Shewanella sp. ANA-3
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVIVTVAADIMALVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTIRTDIEALFDVILGAGHGLDVAALDAQIVAQGSQSIPASLVRQDAILSHPTFNRYQSETEMMRYIKRLESKDLALNYSMISLGSCTMKLNAAVEMIPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDPAFDSRPYSREVAVFPSAAVRTNKFWPTVNRIDDVYGDRNLFCACVPLSDYE

SEQ ID NO: 8497 - protein, 322 aa, Oryza sativa (japonica cultivar-group)
MATSAHRRGSAGGITLVVSGKSTEDQHLLAAAGGALVLGEGDSVEDITVSLDSGAGAGAGAGFDAGAYMAALRASRFGRNFAKLPVGVVCVADVQFKGRGRSKNVWESPPGCLMFSFTSQMEDARKLPLMQYVVCLAMTEAIKELCCAKGLSELDVKIKWPNDLYLKGLKVGGILCTSSYQPKVYNICTGIGLNVDNEEPTTCLNAALKEMNANLPTLKREDILASFFNKFEVLFEIFTNEGFQALEEQYYNSWLHSGQKVVVQDGPEAQHADSVVTIQGLTPAGYLYAIGEDGKSYELHPDGNRVSAKEDGNVVLHEYIHR

SEQ ID NO: 8498 - protein, 727 aa, Nocardioides sp. JS614
MGVLGLLVVGDGGPVADGAGARYRARGGEQSLRECGLARSCRAHEHHVADPVRAARRQILTRCSPVSAALFCHDRSSCHGSRCWDLGPTQLLIGPGNKGCWSRFASLTLVAPCLGWWVVSPCSRRSGTPSVKARRHPYSGSAWSTLKYDVPWPAPARSTAHLQGRTRGPRHAGAPAPPPGRHGARGCSGPPRQRVNPSLHGVSKGFLPTTRCSLRSRRIQGDTLPSACQRFHPRSRGARLGSMNGLDLLGPTQRGLLIGGTWRDAEGGKRLDVIDPADGSVLTDVADGSVADAVDALDAAVAAQADWAATPPRQRGELLRTAFELIIERSEQFAHLMSLEMGKTVAEAAGEVTYGAEFFRWYAEEAVRIHGRWMQAPGGGSRLLTIKKPVGPCLFITPWNFPLAMGTRKIGPAVAAGCTMVVKPASQTPLSMLALAAVLEEAGLPAGVLNVVTTSHTGEFSETLQADDRLRKVSFTGSTGVGRVLVRQSADRLQRVSMELGGNAPFLVFEDADVDAAVDGAMVAKMRNMGEACTAANRFLVHASVADDFAEKLGKRMGALSLGRGQDDGVDVGPLIDERAVESVSQLVTDAVHDGATVVTGGRPVDGPGYFYPPTVLLGVPADSEINVQEIFGPVAPITTFDSEADAIRMANDTEYGLASYVYTRDLARTIRLAEALEFGMVGVNTGLISNPAAPFGGVKSSGFGREGGFEGIEEYLETTYVALPAG

SEQ ID NO: 8499 - protein, 159 aa, Brassica napus
MVKARTVGVGMDYSPTSKSALRWTAENLLDDGDTIILIHVQPQNAEHTRKILFEETGSPLIPLEEFREVNFSKQYGLAYDPEVLDVLDTLSRAKKVKVVAKVYWGDPREKLCDAVENLKLDSIVLGSRGLGPLKRMLLGSVSNHVVTNATCPVTVVKAN

SEQ ID NO: 8500 - protein, 252 aa, Streptococcus pyogenes MGAS8232
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIICCGESLETYEAGKAAEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 8501 - protein, 250 aa, Bordetella parapertussis
MYKLVLIRHGESQWNLENRFTGWTDVDLTETGREQARKAGELLKREGYAFDLAYTSVLKRAIRTLWIALDALDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 8502 - protein, 107 aa, Arabidopsis thaliana
  misc_feature (55)..(55): Xaa can be any naturally occurring amino acid
  unsure (1)..(107): unsure at all Xaa locations
EILSGSPAELIFQSFFRGLLDYLLSRPVFSMIWEGKNVVFTRRKITGTTHPPPSXPGTIPGTLLFTLGRNVIPGIDSFESARKEIAFWFPDGPVHWHSTLHPWVYET

SEQ ID NO: 8503 - protein, 829 aa, Arabidopsis thaliana
MMTRFACLHLFTMFLFTLLSGSSSAVITTESPLSMGQTLSSANEVYELGFFSPNNTQDQYVGIWFKDTIPRVVVWVANREKPVTDSTAYLAISSSGSLLLLNGKHGTVWSSGVTFSSSGCRAELSDSGNLKVIDNVSERALWQSFDHLGDTLLHTSSLTYNLATAEKRVLTSWKSYTDPSPGDFLGQITPQVPSQGFVMRGSTPYWRSGPWAKTRFTGIPFMDESYTGPFTLHQDVNGSGYLTYFQRDYKLSRITLTSEGSIKMFRDNGMGWELYYEAPKKLCDFYGACGPFGLCVMSPSPMCKCFRGFVPKSVEEWKRGNWTGGCVRHTELDCLGNSTGEDADDFHQIANIKPPDFYEFASSVNAEECHQRCVHNCSCLAFAYIKGIGCLVWNQDLMDAVQFSATGELLSIRLARSELDGNKRKKTIVASIVSLTLFMILGFTAFGVWRCRVEHIGNILMTLLSNDLLLLFNSFACKRKKAHISKDAWKNDLKPQDVPGLDFFDMHTIQNATNNFSLSNKLGQGGFGSVYKGKLQDGKEIAVKRLSSSSGQGKEEFMNEIVLISKLQHRNLVRVLGCCIEEEEKLLIYEFMVNKSLDTFLFDSRKRLEIDWPKRFDIIQGIARGLLYLHHDSRLRVIHRDLKVSNILLDEKMNPKISDFGLARMYQGTEYQDNTRRVVGTLGYMSPEYAWTGMFSEKSDIYSFGVLMLEIISGEKISRFSYGVEGKTLIAYAWESWSEYRGIDLLDQDLADSCHPLEVGRCIQIGLLCVQHQPADRPNTLELLAMLTTTSDLPSPKQPTFAFHTRDDESLSNDLITVNGMTQSVILGR

SEQ ID NO: 8504 - protein, 238 aa, Zea mays
ISLAVASKRRTHRPIEPMAMVTAKLSSPAAARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVMSFLFIMFQYE

SEQ ID NO: 8505 - protein, 507 aa, Candida albicans SC5314
MLILLPIAVIAASIYYIAEYWKRESIKRKYDCQPVKQAPLVTWYDIFGIKALVDNSNLTKSGYFYQDIQRKLDNLDTTTMKTTALGKNQIITIEPENFRTMCSSADLNNWTIGTRPIALKPLLGNGIFSSEGESWKHSRIMLRPIFAKEHIKQITAMESYIQSLIKVIKLQQQGEGEFDLQHLFHCFTIDYATDFLFGESCDCLKSILGETSISTMSEEEKSKFAPNFDVMQYHMTKRLVFGYFSFLVNPPEFKNAVKHLHEFVFHFVDRAINFTDEELNDPSKNYVFLYQLAKQTKDRKVILDELLSVLLAGRNTTASLLSFMFFELAQNKPVWNKLKKEITEHFPDVESITFETIHNCEYLRWCIHESLRINPPVPINTRTANRDTVLPKGGGKGNNYPIFVRKGEQVIFPLFSSNRQERFFGPEPEKYIPERWANLPRNGGVAFGPFGTGPRLCLGQQLALVEASYVTIRLLQTFSQLDSNHTECRRSVGATMRLMDGCQVTLK

SEQ ID NO: 8506 - protein, 366 aa, Bacillus cereus G9241
MIRTEEMLLNVGPQHPSTHGVFRLVIKIDGEIIKEATPVIGYLHRGTEKIAESLQYTQIIPYTDRMDYLSAMTNNYVICHAVETMMGLEIPERAEYLRVLAMELGRIASHLVWWGTNLLDIGAVSPFLYAFREREMIINLLNELCGARLTFNYMRVGGVKWDAPDGWIEKVEEFVPYMREQLAGYHDLVSGNEIFLNRVKGVGIYSAEEAISYSLSGANLRCTGVNWDLRKDEPYSIYDRFDFDIPVGSVGDAWDRYVCRMQEIEESLKIVEQAVQQFPKEGAVLAKVPKIIKAPKGEAFVRIESPRGEIGCYIASDGKKEPYRLKFRRPSFYNLQILPKLLKGENIANLITILGGVDIVLGEVDG

SEQ ID NO: 8507 - protein, 194 aa, Hyacinthus orientalis
ATSGIFFRQTSLAGIHQSEDAIRKLFRIPADAPMGKSVATAIELCKEAPVEGQTRRCVTSAEDMIDYVVSSLGAKSSLTAKSTSNSNGLGSDVLIGEVKAAGGGELGRVVSCHHTTFPYLMYRCHSVPKTVLYDVEILDPETKGRINLAAAICHFDTSVWSPRHATFQALVYERGMDACHWVFPMDMAWTAAAE

SEQ ID NO: 8508 - protein, 231 aa, Streptococcus pyogenes MGAS8232
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFGDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 8509 - protein, 505 aa, Acidobacteria bacterium Ellin345
MSNLNDKITKVATHVSQNEDLIFEKSSPGKKAYRLPPLDVPDVDERALLGAEYVREDLGNMPEVSEIEIIRHFTRMSTWNYAVDYGMYPLGSCTMKYNARINEVVARLDGIAGAHPYQPEKLSQGNLRIMKMLADQLVEITGMDSITLQPAAGAHGEMTGILLIRAYLESQGNPRKKILIPDSAHGTNPATAAICGYQVENLKSNSAGLTDIPSLVAQMNEDVAALMLTNPNTLGVFEQEIHKIADILHEKGGQLYMDGANMNALVGKTRPGDFGVDVMHLNLHKTFSTPHGGGGPGSGPVAIKKHLEPFLPKPVVVANSDGTLRLDYDRPKSIGRVRMYFGNFGMHVRALAYIMANGPDGLRLTTEDAVLNANYIRKKLAGIYDLPYSTPSMHEVVFSDRNQARKGIKTGDIAKRLIDYGFHPYTTSFPLIVPGALMIEPTESESKEELDQFIEAMKAVAEEAENNPEIIAGAPYNTRVSRMDETAAARKPILRWKPKAKSAAE

SEQ ID NO: 8510 - protein, 443 aa, Acidobacteria bacterium Ellin345
MRYLPKSQSDRDQMLRELGCATIDDLFAPIPAEYRLTRDLAIPRQYGESEILDFFKQRASENANGYSIFIGAGAYNHYRPVVIDSLISRGEWFTAYTPYQPEISQGTLQAIFEFQSMICELTGMEVANASMYDGSTGAAEAIMMAVRLTGRHSAIIANTVHPEYREVIATYAQHQGLPISHVGYNAETGRVDIKALEAAITDQTAAVLIQSPNFFGTIEDVAAIADLVHKKGALLVVSISEALSLGLIKPPSEADIISMESQSFGVPLGYGGPYVGVIATKEKFVRQIPGRLCGQTVDRNGKRGFVLTLSTREQHIRREKATSNICTNQALIALIASIFMTVYGKQGLRELAKQNLAKTAYAVSAFEKAGAKVLFKNSPFFNEFVVQTKSDSRELNDKLISDKIIGGFPLKKFYPELGNSAVWCVTELNAKAAIDAAAKGVAQ

SEQ ID NO: 8511 - protein, 304 aa, Azoarcus sp. EbN1
MSIQWFPGHMTSARKKAAETMALTDVVIEVLDARIPEASSNPMIHELRRHRQRVCLKVLNKADLADPVATRAWLDFFNSQEGVKAVALSCKKPGDVARVPGLCQGLAPHRNDGTKLLRIMIMGIPNVGKSTLMNALLKRRVAKVGDEPAVTKSQQTFDLGSHMTITDTPGLMWPKIAHDSDGFMLAASHAIGRNAVIDEEVATFLGDLLLERYPALLAARYGIAPERLEALDGVGVIETIAARRGCRLKGGAPDLEKASQIFLNDYRSGVLGRISLETPESRRKMLSAATSAASRAAEAIGPDA

SEQ ID NO: 8512 - protein, 324 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSK

SEQ ID NO: 8513 - protein, 131 aa, Solanum melongena
DPKKKPVTRSVKAGLQFPVGRIGRYLKKGQYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 8514 - protein, 152 aa, Ashbya gossypii ATCC 10895
MSHSKISEGEADLYLDQYNFTTTAAIVGSVDRKIFVLLRDGRMLFGVLRTFDQYANLILQHCVERIYIPEEGQYGECERGVFMVRGENVVMLGEVDIDKEDKPLEQLERVPFEEAARYRDGQNETKFKVETQKSKELARYGLIHDFNKSDMY

SEQ ID NO: 8515 - protein, 458 aa, Listeria monocytogenes str. 4b F2365
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQVLKASNRKTKIRHN

SEQ ID NO: 8516 - protein, 322 aa, Oryza sativa (japonica cultivar-group)
MSVIDILTRVDAICQKYGRYDAEKLHGSGVAGEDPFARLYASVDADLNECLEKAEAAKQEKNRATVVALNAEIRGTKAKLLEEDLPKLQRLALKKVKGLSKEELAIRGDLVTALPDRIQSIPDGSATSSKKTGLWGSSGSRAGTGIKFDSTYDLEWKLIYVGSAEDENYDQLLESVLVGPVNVGTYRFVLQRPVLILHWTCCIFAAILDADPPDPSKIRKEDIIGVIVLLLTCSYMGQEFIRVGYYVNNDNDDEQLREEPPAKLLIDRVQRNILADKPSVTKFPINFHPETSAGAGQEQQQQQQSGSPENHPNQGSKPNPDQ

SEQ ID NO: 8517 - protein, 347 aa, Clostridium thermocellum ATCC 27405
MKGKMKVCVLTGKEKLEWVERDIPQPGRGELQIKLKHVGVCGSDLHFYKEGRLANWELDGPLALGHEPGGIVSAIGEGVEGFEIGDKVALEPGVPCGECEDCRKGHYNLCKHIKFMAIPHEKDGVFAEYCVHSASMCYKLPENVDTMEGGLMEPLSVALHATELSNAKIGETAIVLGSGCIGLCTVMALKARGVSEIYVTDVVDKRLEKALEVGATRVFNSQREDIVEFAKTLPGGGADQVYECAGSRVTTLQTCKLIKRAGKVTLVGVSPEPVLELDIATLNAMEGTVYSVYRYRNMYPIAIAAVSSGVIPLKKIVSHVFDFKDCIEAIEYSTNHKDEVIKSVIKF

SEQ ID NO: 8518 - protein, 87 aa, Neisseria meningitidis
VAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 8519 - protein, 215 aa, Synechococcus sp. WH 5701
MGWTVDDIPSQEGRIAVVTGANIGLGLETTRALAAKGATVVMACRSRSRGEAARRQLLDEGLTGLDLLEIDLADLRSIERAIAVLSDQYGHLDLLLNNAGVMAPPRQLSPQGHELQFAVNHLGHMALTQGLLPLMASQTDPRVVTVTSGAQYFGTIRWDDLSWAQGYDRYGAYGQSKLANVMFALELHNRLQSENSSVKSLAAHPGIARTNLQPA

SEQ ID NO: 8520 - protein, 477 aa, Nocardioides sp. JS614
MSSGLWIDGGWQESRGDRGEFAVVDPATTGVLARVVDGSVEDMAAAVDAASRTHETWAETPARERSVVLRRAWELMTERSEELARLIVLENGKALPDARSEVVYAAEFFRWFSEEAVRAHGDMRRSPSGQNWIMVTEEPIGVALLVTPWNYPAAMATRKIAPALAAGCTAVLKPAAETPLTALALAELLADAGLPDGVLNVVCTTRAGQLVEHALGDPRVRALSFTGSTEVGRKLLALAARNVVRASMELGGNAPFVVLDDADLEEAVEGLMVAKLRNGGSACTAANRIYVADRVADEFVERFTARMAGVRHGNGLDEGVELGPLVNEDTQRKVGELVDGALREGASLATGGGHDGLPGYSYRATVLTDVKPDAEILKHEIFGPVAPIVRFGEDAEAVALANDSEFGLISYLYTRDLDRGLAVSRRLRSGMVGVNRGVVSDPAAPFGGVKQSGIGREGAAEGLREFTEMKYTAIPYR

SEQ ID NO: 8521 - protein, 208 aa, Nicotiana glutinosa
YVEFAQDFDFFYFVQQWPGSYCDTKQSCCYPKTGKPASDFGIHGLWPNNNDGSYPSNCDSNSPYDQSQVSDLISRMQQNWPTLACPSGTGSAFWSHEWEKHGTCAENVFDQHGYFKKALDLKNQINLLEILQGAGIHPDGGFYSLNSIKNAIRSAIGYAPGIECNVDESGNSQLYQIYICVDGSGSNLIECPIFPRGKCGSSIEFPTF

SEQ ID NO: 8522 - protein, 341 aa, Zea mays
MVMETGDPGKLLRGHSLSRVPPASPFPRLRPQGDLVRAGDERARASGMPGEEDVRKVSREDIQLVQNLIERCLQLYMNQKEVVDTLSFQAKIEPSFTEIVWQRLEEENRDFFKAYYARLMLMNQIVSFNKLLEQQHQIMNKDHHYGMPAMPSTAPNGSNTNMLNQAMPFLPDTIPSTAMQDNSLRNGGSSSIVNGAPSDDQFMYTGKVVHGLPGVMDASSSLLAAHKSTVGQFNGHNGTTTKTESDYSSNSDFGLGNETVFLEQSFGDISGGSFSSSELNGQPVGSSSYGFLSQIPCNFSLSDWTDCFSQSSEILENYGRSPFIPSDANNFPESTAEEHTG

SEQ ID NO: 8523 - protein, 950 aa, Pseudomonas fluorescens PfO-1
MTQVNLGTANEFIARHIGPRAGDEQAMLNSLGFDSLEALSASVIPESIKGTSVLGLDDGLSEADALAMIKGIAGKNQLFKTYIGQGYYNCHTPSPILRNLLENPAWYTAYTPYQPEISQGRLEALLNFQTLISDLTGLPIANASLLDEATAAAEAMTFCKRLSKNKGSHQFFASIHSHTQTLDVLRTRAEPLGIDVVVGDERELTDVTPFFGALLQYPASNGDVFDYRELTERFHAANALVAVAADLLALTLLTPPGEFGADVAIGSAQRFGVPLGFGGPHAAYFSTKDAFKRDMPGRLVGVSVDRFGKPALRLAMQTREQHIRREKATSNICTAQVLLANIASMYAVYHGPKGLTQIANRVHHLTAILAKGLSALGVTVEQTSFFDTLTLATGAQTAALHDKARAQQINLRVIDAQRLGLSVDETTTQADIETLWGLFADGKTLPDFAALAAAAQSTIPASLVRQSPILSHPVFNRYHSETELMRYLRKLADKDLALDRTMIPLGSCTMKLNAASEMIPVTWAEFGALHPFAPAEQSAGYQQLTDELEAMLCAATGYDSISLQPNAGSQGEYAGLLAIRAYHQSRGEDRRDICLIPSSAHGTNPATANMAGMRVVVTACDARGNVDIEDLRAKAIEHREHLAALMITYPSTHGVFEEGIREICGIIHDNGGQVYIDGANMNAMVGLCAPGKFGGDVSHLNLHKTFCIPHGGGGPGVGPIGVKSHLTPFLPGHGHMERKEGAVCAAPFGSASILPITWMYIRMMGGAGLKRASQLAILNANYISRRLEEHYPVLYTGSNGLVAHECILDLRPLKDSSGISVDDVAKRLIDFGFHAPTMSFPVAGTLMIEPTESESKEELDRFCDAMIRIREEIRAVENGTLDKDDNPLKNAPHTAAELVGEWTHPYSREQAVYPVASLIEGKYWPPVGRVDNVFGDRNLVCACPSIESYA

SEQ ID NO: 8524 - protein, 391 aa, Bordetella pertussis Tohama I
MSAQISPLNAGAAPESFGIASVPEIIAELRAGRIVILVDEEDRENEGDLVMAAEFVTPEAINFMVTHGRGLVCLTLTEERCRQLDLPLMASRNGTRYGTNFTQSIEAAEGVETGISAADRARTIQVAVARDAQPSDLVQPGHIFPVRAVPGGVLVRAGHTEAGCDLTAMGGLTPAAVICEILKPDGTMARLPDLVEFAREHKLKIGTIADLIQYRSEHESIIARMGERMMQTPWGDFRCIAYRDDATRSPHLALVHGNIDPERETLVRVHEPASLFDVLDTGASPHSWSVGQALHAIAASPAGVLVLMNCQSSTEHLFGQIANWAGPAERAAAQEGDRFGLRTYGIGAQILRDLNVGRMKLLARPRKMPSMAGFALTITGYDCVPPNLRND

SEQ ID NO: 8525 - protein, 324 aa, Zea mays
MCPTKPDRPGQAAAGSGEKSWREEAVAACSLRLVDLDRGTNGWASPPGDLFHLRARGYFSSGGGKRGKAPSAADWLLRPAGVDWLRSHARLDHVLARDDNRVAAAFRRARLRKDPSAHFLLAVNLQVPGRPDAYSAVFYFAAEAPIPPDSLLGRFIHGDDAYRNARFKIANRIVKGPWIVRATVGNYAACLLGRALTCRYHKGDDYLEIDVDIGSSAIASAILHLALGAVTSSTIDMGFLVESQSEEELPERLFGAVRIAQMEMSAAKYVELPPDEAMPETAGRAGAGFRVSSAKVVNHSRQQDHAGGKVGRSMSCPERESGGK

SEQ ID NO: 8526 - protein, 423 aa, Arabidopsis thaliana
MSEDKDYMSEPFIVKKIDDEESLLDDYNPQGNTSFSKTCFHGINALSGVGILSVPYALASGGWLSLIILFTVAITTFYCAILIKRCMEMDPLLRSYPDIGYKAFGNTGRVIVSIFMNLELYLVATSFLILEGDNLNKLFSNVGLNFMGLEFQGKQMFIIMVALIILPSVWLDNMRILSYVSASGVFASGVILASIFSVGAFEGVGFKNNDSEVFRLNGVATSVSLYAFCYCAHPVFPTLYTSMKNKRQFSNVMIICFTICTFIYASVAVLGYLMYGSDVESQITLNLPTDKLSSKVAIWTTLVNPIAKFALMVTPIIDAMRSRFSRVLPNKRASGFLLSTILVTSNVIVALLLPFFGDLMSLVGAFLSASASVILPCLCYLKISGKYQRLGFETLVLIGITLTGIVVVITGTYQAVKDIFGRF

SEQ ID NO: 8527 - protein, 261 aa, Pasteurella multocida subsp. multocida str. Pm70
MARRPLVMGNWKLNGSKAFTKALIEDLKTELAGVEGCDVAIAPPVMYLAEAEAALKCSCSCGGKAIALGAQNVDVNVQGAFTGDISTEMLKDFGAKYIIIGHSERRTYHKESDEFIAKKFAALKQAGLVPVLCIGESEAENEAGKTEEVCARQIDAVLNTLGAEAFNGAVIAYEPIWAIGTGKSATPAQAQAVHAFIRGHIAKKDNAVAEQVIIQYGGSVNDANAAELFTQPDIDGALVGGASLKAPAFAVIVKAAAKAKN

SEQ ID NO: 8528 - protein, 418 aa, Bordetella pertussis Tohama I
MAEIKNYTLNFGPQHPAAHGVLRLVLELDGEVIQRADPHIGLLHRATEKLAEHKTFIQALPYMDRLDYVSMMCNEHAYVMAIEKLLGIEAPLRAQYIRVMFDEITRVLNHLMSLGSHALDVGAMAVFLYAFREREDLMDCYEAVSGARMHAAYYRPGGVYRDLPDTMPQYGDSSKYRGEKEVRAMNDARSGSLLDFIEDFTNRFPSCVDEYETLLTDNRIWKQRLVGIGVVDPDRAKALGFTGPMLRGSGVAWDLRKTQPYEVYDLMDFDVPVGVNGDCYDRYLVRVAEMRESNRIIRQCVEWLRNNPGPVMIENHKIAPPSRTAMKSNMEELIHHFKLFSEGFHVPPGEAYAAVEHPKGEFGIYLVADGANKPYRLKIRAPGFAHLQSLDEMARGHMIADAVTIIGTQDIVFGEIDR

SEQ ID NO: 8529 - protein, 627 aa, Geobacter sulfurreducens PCA
MTDTMLGQAVVYLAAALFCVPIARRLGMGSVLGYLLAGILIGPFCLGFVGREGEDIMHFAEFGVVMMLFLIGLELEPAHFWRMRTTILGLGSLQLALTTCALTAGLLLLGLDWRGALAAGLALAMSSTAIVLQSLKEKGLGNSHAGLSSFAVLLFQDIAVIPILALLPFLAIQAGGGAVHGDAPSLLDGLPVWMKAGSVLFAVVAVVVMGRSIVVPFLRIVTKASVRELSVAAALLIIVAIAYLMELVGLSPALGAFLAGVLLANSEFRHELESDIEPFKGLLLGLFFIAVGASINFRLLTDKPATIISLVLAVILVKAVVLVVAGRLFRLSFDQNSIFAIGLSQVGEFAFVLFAFIDRLGIIGRDWTDTLMAVTAISMTMTPLLLLANERLVLPRFGTREREEQEADLIDTEHPVIIAGFSSFGSTLGRFLRANGVEATILDNDSDQVDLLRRMGFKVFYGDATRLDILRSAGADSARVLFIAIDSPATVNKLVATARKHFPHLKVMARAGTNLDAHELLDLGVRDIYRDFLDTSVRAGVDVLASLGYRRYGATRAGQDFIRYDESAMHHLAPHRHDESSYISTAREQIRLQEQLLAGDRTANHTHHDHAWDTSTPVTAAEGETQP

SEQ ID NO: 8530 - protein, 468 aa, Novosphingobium aromaticivorans DSM 12444
MSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 8531 - protein, 433 aa, Synechococcus elongatus PCC 6301
MVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPATYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 8532 - protein, 536 aa, Streptococcus mutans UA159
MQKHWWHKATVYQIYPKSFMDTNGDGIGDLKGITSKLDYLQKLGVMAIWLSPVYDSPMDDNGYDIANYEAITDIFGNMADMDNLLTQAKMRGIKIIMDLVVNHTSDEHAWFIEAREHPDSSERDYYIWCDQPNDLESIFGGSAWQYDDKSDQYYLHFFSKKQPDLNWENANLRQKIYDMMNFWIDKGIGGFRMDVIDMIGKIPAQHIVSNGPKLHAYLKEMNAASFGQHDLLTVGETWGATPEIAKQYSNPVNHELSMVFQFEHIGLQHKPEAPKWDYVKELNVPALKTIFNKWQTELELGQGWNSLFWNNHDLPRVLSIWGNTGKYREKSAKALAILLHLMRGTPYIYQGEEIGMTNYPFKDLNELDDIESLNYAKEAFTNGKSMETIMDSIRMIGRDNARTPMQWDASQNAGFSTADKTWLPVNPNYKDINVQAALKNSNSIFYTYQQLIQLRKENDWLVDADFELLPTADKVFAYLRKVREERYLIVVNVSDQEEVLEIDVDKQETLISNTNESAALANHKLQPWDAFCIKIN

SEQ ID NO: 8533 - protein, 226 aa, Methanothermobacter thermautotrophicus
MEVFMNLKKMAALRAVDEIDDGDVVGLGTGSTTHYFIEELGRRVREEGLEVMGVPTSYQSMFLAAESGIKVTSLAEHDVDVAVDGADEVDPDLNLIKGGGAAHTLEKIVDSSAASFIVIVDESKLVERLGAFPLPVEVIPAACRPVKLKLESMGASVNIRSSEGKDGPVVTDNGNFVLDAAFGVIDDPGAMESRLNNIPGVVENGIFAGIADMVIAGTSEGLKILR

SEQ ID NO: 8534 - protein, 181 aa, Zea mays
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 8535 - protein, 235 aa, Synechococcus sp. WH 7805
MLVGDSLAMVSLGHATTLPVTLEQMLQHTQAVCRGLRKPPSDQPLVITDLPFLSYQCGLDRAVAAAGHLLKHSSAAGVKLEGAEPEVVKVIERLVRMGIPVMGHLGLTPQSVHQLGYRRQAKDPVSQERLLRHASHLETAGCFALVLEHIPEGLAGQVRRNLQIPVIGIGAGQDCDGQVSVTADLLGLTPTQPPFSPALLEGRTLGVEALRSWLEGQRGSATTPTTAPPPPGSDC

SEQ ID NO: 8536 - protein, 812 aa, Pseudomonas aeruginosa PAO1
MPDSQDQTPSAVQTLKASILAKLRYSVGRDPSTACPHDWFEAVALAVRDHIIDHWEEATPQGEAPARKRVYYLSLEFLIGRLLLDNLGNLGLLEETRQALAELGVDLQRIVALEPDAALGNGGLGRLAACFMESMASLDIPAHGYGIRYEHGLFRQVLTDGWQQEQTETWLDFGNPWEFERPEVSYYIDFGGSVQVDSEHSGRAIWRPDERIRAIAYDTPIVGWRRASVNTLRLWRARAEEDLQLDRFNAGDHIGAVVDVVKAESISRVLYPADSTEAGQELRLRQEYFFVSASLQDLLDRHLRHHHDLRSLPEQVAIQLNDTHPAIAVAELMRQLVDVHQLAWPDAWALSVATLSYTNHTLLPEALESWPVALMERLLPRHMQIIYLINAFHIDALRAQDIHDFDLLRSVSLIEEGHGRRVRMGNLAFLGSHQINGVSALHTELMRETVFHDLHRLYPQRISNKTNGVSFRRWLFQANPGLTELLVETLGADLLDTPERRLPDLEEHVEDARLRARFAEQRRQNKTALARLVLDSLGVAIEPEALFDVHIKRIHEYKRQLLNLLHTVALYQEIRNDPTADRVPRVKIFAGKAAASYHQAKLIIKLANDIARTINDDPTVRGLLKLVFLPNYNVSLAEAIIPAADLSEQISTAGLEASGTSNMKFALNGALTIGTLDGANVEMSQRIGLEHMFIFGLSAQQVEQRRQAGELEMGGVIAASPRLEEALEAIRSGLFSADDRSRYEGLVDGLVHDDRFMLCADFEAYWHAQCRVEEVWREPDRWWRSALLNVARIGWFSADRTISEYARDIWKL

SEQ ID NO: 8537 - protein, 207 aa, Neisseria gonorrhoeae
NISVGTIFSILAKPEGALATESFLQTGRQQLAAGYVLYGPQTQLAFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 8538 - protein, 94 aa, Zea mays
IHGLVELLESRNPTPEPTAKLQDKVDGCWKLIYSTISILGKKRTKLGLRDFISLGDFLQIIDVKQVSKGHTCCKVFPLRVLVWMLSIDLNPHVL

SEQ ID NO: 8539 - protein, 486 aa, Listeria monocytogenes str. 4b F2365
MKKETHGEIRRDLKTRHLSMIAIGGSIGTGLFLASGNAIHTAGPGGALVAYIAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALILCILVIVGQDYAAFLKPEFTNPAWWQKIGISYIGLPIFLVFWLSFKFTNKTKVIPLEDCKFDQK

SEQ ID NO: 8540 - protein, 398 aa, Acidobacteria bacterium Ellin345
MKAVCWNGRHDMRVETVDDPKILNPRDCIIKVTRTAICGSDLHLYNGLIPTMEAGDIVGHEFMGEVVEIGPQVKKLKVGDRVVIPFTIACGNCFFCRQQLWSSCDNTNPNAYIAEALMGYSPSGLFGYSHMTGGYAGGQAQYVRVPFADIGPLKIESDLTDDQVLFLSDVFPTGYMAAENCDIQPGKGQTVAVWGCGPVGLFAIKSAFLLGAEQVIAIDRFPERLYLAEQAGAETLNYSEIPDLIEVLKELTGGRGPDACIDAVGMEAHGVSIDALADEVKQVMKVETDRPLALRQAIQACRKGGVVSVPGVYGGFVDKIPMGAFMNKALTMKTGQTHMMKYMKPLLEHIEKGDIDPSFIISHRVTIDQVPEMYDVWLKKQDHVTKIVIDPWAENIAA

SEQ ID NO: 8541 - protein, 140 aa, Bartonella henselae str. Houston-1
MAVERTFSMIKPDATRRNLTGAITKMLEDAGLRVIASKRVWMSQREAEKFYAVHKERAFFSELVELMSSGPTIVQVLEGENAIAKNREVMGATNPEDAQEGTIRKVHALSIGENSVHGSDSAETAKTEIAFWFSEVEIVG

SEQ ID NO: 8542 - protein, 1100 aa, Pseudomonas aeruginosa PAO1
MARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAEMDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAEQARRLLERLPALLERLPLLARQAAGGLLIRVHGDLHLGQVLMVQGDARFIDFEGEPARSLEERRQRHSPMKDVGGMLRSFDYAAAMVLRNAQSTDSSEQADSARRKVAMRYRSEARDAFLAGYRAAAAGLMHAWHGREGEGAALALACLEKAAYELLYEADYRPDWLEVPLAGLAELTEHLLKGKNR

SEQ ID NO: 8543 - protein, 205 aa, Triticum aestivum
LDWSEGHNWTVEKDLPANRLIEFKFLLQDSLGKFHWQNGPNRTLQTGETTKTLVVYEDWGNAKNQKVAEEGPPERRFFSFFSPKPPPPTHQTGSCLVAGADPRINYEAAPRSPGSSSSPQSHTSLLRAVGWLDWIGMEKEATTPRPVCAQEALALLNCAAENPYDRDKCLSLLDALRECIAQKKVKKFSLAEAGSTSTTEAPKSK

SEQ ID NO: 8544 - protein, 504 aa, Glycine max
MAFHGYAAAPTIAALFCFLYFFHRRLCCRHPLLTDYPILGMLPQLLFNLWRAHDFFTEILKRHGPTGEFTGPWFTSMDYLVTCDPINVHHMLSKNFHNYVKGPEFRHIFQAFGDGIFTADFEAWKYNRDLFHSLFKQKSFEVFLVKTIHNKVHNGLLPILDHVQQQGRVVDLQDVFNRFTFDNICSIVLGNDPNCLSIDFSEVGIEKGFNEAEESIFYRHVVPRCVWKIQRWLQIGQEKKMTEACKTLDQFIHARIASKREELSKYNENEMGEAHHVDLLTALMREGKAHDDKFLRDAVFNLFVAGRDTITSALTWFFWLVATNPSVEAKILEEMKEKLGTKEKSLGVLSVEEVKRLVYLHGAICEALRLFPPIPFERKQAISSDMLPSGHRVNSGTMILFSLYAMGRFEETWGKDCFEFKPERWISEKGGIVYVPSYKFIAFNAGPRTCLGKDSSFIQMKMVATAILHKYRVQVVEGFVATPSLSIVLLMKDGLKVQITKREL

SEQ ID NO: 8545 - protein, 146 aa, Triticum aestivum
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECK

SEQ ID NO: 8546 - protein, 462 aa, Schizosaccharomyces pombe
MVEVRHSIPCEETKRLELSLSQQTYSQQYASIYFARLTALRPRITEAASKKWPDKQRLERVLDVKSDEDCWVVATAYMTTALKPNVMNDVTQLHTIVTTTEESPYVSPEDAASGDIEYALEDDYGRIDCSGSFLYDAGVVTGVVLAVLGHEDEQGRFVVVDVCFPGIFSHSIPMTTDESQAQPEYIAAVSGLGLSNDGIEGIQVHQLVDFLRGTLPHVSSFSPSSIKRLIILGNCLAPSIEIADSASASVPIGKKKVKRYGYDTSAYNPNPTFQLDNFLDQVCSSIDVTLMPGPYDYSSTILPQQPLHPALLTKSKVWLGSSLQTVTNPTWLSLGNHFVLATSGQNINDLRKYHPKKSSLQCMENTLLWNHITPTSPDTLWCYPFTDKDTFVMEEMPDLYLCGNQPKFGCKTVINEGNRIQLVSVPEFRKTGVLVLINMHTLNVEIIQFRPMSVKAETPITS

SEQ ID NO: 8547 - protein, 346 aa, Novosphingobium aromaticivorans DSM 12444
MKALRYYGARDIRHESMDDPTPQSDRDAIVKVDACSICGSDLHIYHGHGFSEDIGFCVGHEAVGEVVEVGRGVHRLKVGQKVMIPAAVGCGACRSCLAGVVNTCENNGSGCYGLSAKLQGSQAEAVRVPAADANAVAIPEGVSTEQALMMTDALATAWFGARQADIRPGSSVGIIGLGPIGLMAAESAFVMGAHVVYAIDPVPERRAIAESLGAIALHPDEASARIKEDTHGRRLDCVVEVVGSDATVDMALRLVRVRGTVSVIGVQQSRRFPFPLERAFAGGLTFRVGTCSVPEELPALFPLVASGRLRPERYISHRLPLSQGAEAYRMFEAREAGALKMVLVPD

SEQ ID NO: 8548 - protein, 170 aa, Zea mays
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8549 - protein, 397 aa, Streptococcus pyogenes MGAS8232
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAIRRLHVFMESNEIN

SEQ ID NO: 8550 - protein, 166 aa, Listeria monocytogenes str. 4b H7858
MYDLTIVINGVSKAYSMTGWRIGYAAANKEIIAGMSKLADHLTSNPTANAQYAALEAYVGSQEVPEKMYKAFEERMERFYPELSSIPGFKPKKPDGAFYFFIEVKEAAHKKGFQDVDAFVAALLEEAKVAVIPGSGFGMPDYIRLSYATNPDLFQEAINRIKSFMK

SEQ ID NO: 8551 - protein, 122 aa, Candida albicans SC5314
MIRNNIIRNIRLSNIYKYNSSINQRTISPFLSSKRNYSTPQEESEPMDEYESKIYNILQQELNPVNLKIKDVSGGCGSMFSIFIESEKFKGLTMIKQHRLVNEILKDEIKKWHGLQLRTKKV

SEQ ID NO: 8552 - protein, 959 aa, Pseudomonas aeruginosa UCBPP-PA14
MTDNLNLGTIDLGTDDEFIARHIGPRAADTQAMLQRLGYDSLDTLIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESAIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQADVETLWGLLAEEGQALPDFAALAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 8553 - protein, 494 aa, Colwellia psychrerythraea 34H
MTEVTCNLEAAGIKDSQLIKPFSYINGSWHSSETQFPVINPSTGEVVAQVSNADVAETELAVSAAKGALKMWSAKSANERATLLRNWFNLVMENQDDLGRILTLEQGKPLAEAKGEIAYGAAFLEWFAEEGKRVYGDTIPALSSDKKIVVIKQPVGVVASITPWNFPNAMIARKAAAALAAGCTFVVRPSESTPLSALAMAELAERAGIPAGVFNVVVGSNSRGMGQVLTQHPDVAKFTFTGSTGVGKLLLTQCATTVKKVSMELGGNAPFIVFNDADIDAAVQGAIISKYRNAGQTCVCTNRILVQQGVLEEFTEKFKNAVAELHIGDGLVEGVNLGPMISDKAVCDVEKLVADSIAAGAKVAFGGQRSEAGELFYQPTILTGVTNDMPIAANEIFGPVSPIIAFETEEEAIELANDTEYGLAAYFYSRDIGTVWRVAEGLEFGMVGINEGIISNAAAPFGGVKQSGNGREGSKYGLDDYLEIKYLCMGGLDK
